United States Patent 7,745,391 (HUMAN THROMBOSPONDIN POLYPEPTIDE) - sequence listing, part 250

SEQ ID NO: 707672 - DNA, 1144 bp, Homo sapiens
  misc_feature (42)..(42): n is a, c, g, or t
  misc_feature (1101)..(1101): n is a, c, g, or t
  misc_feature (1125)..(1125): n is a, c, g, or t
gggcggcgttgggggtgcagcatgcttgctgctgcggcgcgngggggcgggcgtggagggcggcgccgctgcagtgcggggacccgctcgctcgctcgccagccgtccccgcgccccgcgtcccgcgcagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaatcgtggtccagggagagcctggggacgacttttacatcatcacggagggccaccgcgttccgtggcttgcaanggcccgggttcccccccaatgganggaagttacccttggaaag

SEQ ID NO: 707673 - DNA, 106 bp, Homo sapiens
tgggtcacaacattctcctctccctgactggtgcagattcatcaaacaaaaaataaatctcgaagaaaaaaatgcacttacatgtgcttatttggcttttctcatt

SEQ ID NO: 707674 - DNA, 1230 bp, Homo sapiens
  misc_feature (42)..(42): n is a, c, g, or t
  misc_feature (1224)..(1224): n is a, c, g, or t
gggcggcgttgggggtgcagcatgcttgctgctgcggcgcgngggggcgggcgtggagggcggcgccgctgcagtgcggggacccgctcgctcgctcgccagccgtccccgcgccccgcgtcccgcgcagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaatcgtggtccagggagagcctggggacgacttttacatcatcacggagaaaaatttgccgggtgtggtggcacatgcctgtaatcccagctacttgggaggctgaagcaggagaatcgcttgaacccgggagatggaggttgcagtgagccaagatcacaccattgcactccagcatggacaacagagtgagattcngtctca

SEQ ID NO: 707675 - DNA, 293 bp, Homo sapiens
  misc_feature (274)..(274): n is a, c, g, or t
cgtctgtagtttagtgggttggatgagcgggtgcgaggacggactgaggccggagcggtaggacggatatcagtctgatgatctgagaatgagtgcgactgaggctaagctaggatagtgagcgagagagagagaagcgaagggagctgagagccaagctggggtttgaagtgcgagtgggaaagatcgaagtctgggaattgaccgagagaatctctggttgcagggatagagtagagagcagactggcgtgtccttccagcgaggagcgacngctggatgagccttatgtg

SEQ ID NO: 707676 - DNA, 3024 bp, Homo sapiens
agagagttgggagatgtaggtgtgtggataggatgggagaatggtaggtgtagtgtaggtggagctggtgatatgggtaggtgtatgtgagtcgatggtaagactggtggtggtggtagagaggaggtgtttatatgggagtgtaagggggaataaggttttgagagagatgaaagggatgggtagtgtggttggtgagttattaaggattgttgggggatgggttatagtgttttataattgttgataattgtagttttgatttgtggagggtgtagatttggtgtagggagatttgtggcatgttagttgtgtcattaatagatgttagggtgcggtgtcccggaggtcccagggtgttgcgtggtttccgcgtttctcgacgcgtgtgttgggtggcgtgtgccgtgtcctttgcgtgtgggatttcgcgtttcgtttttgagtgggggtcgcccgctggggtgcgaggtgatagtgtcgtgggtgagggtgtaaagctgtggtgggcgcgcgttggtgggagatatggtgtggaggggtgccggcctgtttttgttgttttgtttttttttttttaaaacaaatatttttaattaaattttcaaacatgaaagtataaacgttaatatttgttgaaaaatatatacggcatttcccccgtgtgaacacaatggcttccggtaacactacccacttacaatgagatcttttaggcacttgggtgtagaatgtgcgagagggaaatgcaactttactttcctgctacctataggggcaaccacaattagatctcatgaaatattgttttcaacactgttagcattaacaccgacttaaaacatacggtgaccggacatataacctttaaagtcccagtatatttaaaacaggagaaatctggtaagttgttaggattctaaattccttttagtctgttcactgagatattaaatttcagtagacagaacccaaaaagagatttcatttctttctaatcactttggcttctttcttttttgttaagtaggtaaaaaccttcttggtgggcacctaagcaggatgcagccaatagttcatgaaccagctgcgcacgtgaggcttaaaatctaagatgctgctgaagtggctgcgggaggagcggctgcgacttacttttaatttcaaatcagctgcagatgtttgggagccctctcgatgaacagaacaaatcacataacatgcagaatccactcagaggctgttattccagggaaagagcgggcaggtgtcctgaggagtacattcttgctgtcacagtctcactgctggcacagaggtgccttgtttatgagatttaaaggccacaaactctggctcaggtactggacactgctctgatagtaggattttgcgttggcacccttgacacactgcagccaggtgaccaaggtggaggcggctgccatcctcacatcgttggacacgtcatctaggcgttttaagagttcaggataaatcttgatgagtttctctggatccgtcatgccgcccgaggtttttaagaacgtgttgataatacggcatgagatcagtcgcgtcatcttcgaatcctcctccagggtggtcaggacctggggcatcagtgtttcctgcacgtcccgtatctgctctgccgacaggacctcgctgctggtgagcgcccagaggcaggacacggcagccgtgcggatggccgcggctgtcctccccgcatgccactgcagattgggggccaggatgtcctttgtcaccgtctcgaggtagctgggaaactgcccctgggagttgatggtgtccgtggctctgagcagcacggtggacaggatggagaacagcttcaggcgcatctgcgggtcttgggagggctgcagacaggccctcagcgtgggcacgacgtgtggcagggcttctcccagggcagggcctgactgtgcgacgatgacactgaactgcaggagctccggcgagtgtgcggtccagtcaaggtgcgacgcggtcacccgctccaggaggggaccaatgtgcttgcggtagaggtcctggcagctgctgacaccctccaccatggccagtgagtccatcgtctcctgtgccttgtccctcaggccggtagcacctgcgagggccactattgtcagcagcacgtccaagagctgcaggctggccacgccacagtcctcatgacacacagacaccagagcctgcacacacagcagcaggcgctccaggtagaggtcgttttcagatgcctggcagatgtgggcctgtgccagctctgtggcgatggctgccaggtgcggctggagggcttctcgggggcaaccccgcatggcggaggccagcaccaggaggccggaggcagagggcgtcttcttcagcgtcgataagatcagcttcagaaacacctcagggctgacaaacgtcccgacgagctctgcggatctggtacaactttggaccacggctgcctcctcgtcggtgcaggcctggaacagggtccggaggacgacctccaggtgctgcgtggcgtggtcctcggcatgcagcagcagcactgggagcagctgtgccgacttcactcgggtccccaccacccagtcggtgatgtcgtggcacagggcagggaggatcttggagaggttcctgaagacgagctcccggcagcccagcacagggcggcgctcatgtggagggtaatggggtggggtgggaggggcaaagtccagcttgtccttcaggtcctcctcattctccttctgccactgcaggccaacgtcctcccagaggctggcagccagctgcctgacctcaggcacctcgtcgttgaggctactgagcagcagagggatgagcttgtggaagaaggagtaacggtcacgcagacacagcagccagccgcccaccacggaggccaccgcccgccggacctgcgggacgtcatcaaacagtcgctgagcaaaatgggaaagcacggtcgacgcggccgcgaatttagtagtagta

SEQ ID NO: 707677 - DNA, 1151 bp, Homo sapiens
cggaagcctggcgcgtgtcaactattcgccttagaccttgtaaccgcaacgccggcgcggttgtgtgctcgccgagcggagtacgactaatctcaccgttgtgggccttcatccagatccggcgtgcggctaactattcgcgcttatacctatgtaaaccagggaatgctgacaatcaagggtcggactggacttcgtaggacaccaaatgtccagtgaggatttagcatccaggtccaacagacaagggcgccaatccctgaaggagcacattgcacagtgttggtggaggttgtggatgtgaatgacaacgccccggaaatcacaggcagctccgtgtacagcccagtgacccgaggatgcccctctggggactgtcatcgctttggtcagtgtgactgacctggatgctggcgagaacgggctggtgacctgcgaagttccaccagtggtcatccgttacagccttactgcttccctcacgaatatacttcactagggaagaagcagagcagacctggatcgggagactgtgtcacgaatacgaagctcagcatcaccggaccgagacggcggaacccctatcacctctcagcccttacaatattgcgtgttcaaagtgtaccgattcaatgagaaacctccacgaaacttctcaatccttctacgacgtatacatcggaagaacacaagctccgcggggctccaataaataaacctagttgctgggaacccgaagacccgcagcattgctcggactacttacctcacccttggagcaaggaggtgagaccggacatagcaggggaccggcaaaatcagacactacatccgtgcaacatctgggaatagtggactccctaagtggccccatacaacacaaaggacggctgtcgcaactctggcactaaacagagccacttacaggcaagagggggacccaccgggagccaacaaataacaatcacacggtcaacataattcggcaatcgtcggaagtcacaaatgcctcaaaagggaaaacccaagcacacggacaccacaggaacatgagccatgatgatataccaggcccacagcccacgacgcagtcaacacaatgcaccctagtcatcaaaacccaccacaaaccgccacgccaccatgccccc

SEQ ID NO: 707678 - DNA, 1808 bp, Homo sapiens
  misc_feature (42)..(42): n is a, c, g, or t
  misc_feature (1201)..(1201): n is a, c, g, or t
  misc_feature (1217)..(1217): n is a, c, g, or t
gggcggcgttgggggtgcagcatgcttgctgctgcggcgcgngggggcgggcgtggagggcggcgccgctgcagtgcggggacccgctcgctcgctcgccagccgtccccgcgccccgcgtcccgcgcagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggtcgcctctccctgtgatggagacagcacgtcgtggagcgaaagcagcatatgatgtgacgcaggagttaccttcagcgacagggtcatccattcctacgaggtccatggcagtaaggtgagtgcatgcgtctgatcacgtgagcgggagtgccgctggtgagtcgcacgcttcactagttgtattgagagcatgtgaggaagagataaatctggtgtgtaccaaggggaagagtcctgcgggacagaacttgtatacatttcatcgacgggatgtgctacacgcgatccagtgactgacgagcggccggtcaccgctaaanttgaagtgacgatacngttcggacgagttggggcgcgaagccttttggcgaaccatcgtagaacatacgtgtcttgcgtcgatgacttcggtcatcgcgttgcatgaaacctaggccctcgggagtgtggctcagccttgatcagtgggtcctgtaggggccaccatacgaagaagtgggttggtggagcgacgtgagcagacggaggccgcggggtatctcctgaagtccggtggtgggctagggggagtcccgcttgacgtccgtggaaggactcacatctagataacggaaaacctatttgcgagggtgttgttactagacgacgtctctccaggtctactcacttcaaccccgtaacttgtaggcccttcatgtttgccccggtacgctttgctatgtacactcaaggcgtacccccacaacatgtgttggggtcgggccgctgtggctcgcctggggtcgtttactggttgctcaagcgaggcacgcgcagttggcaggacacttactggctgcttgacggttggtggtgtgcccgggggttgcccgctgtgggtggtgccaccgggcccgtggttgcggggtgctttcgcccgtatgaacg

SEQ ID NO: 707679 - DNA, 962 bp, Homo sapiens
gaaactacaagaacttaacttggtataggccaagctcagggagaagagtagaggaaagctgtcatgccagcgagtacttcttgagtggagatcatccgcttgttgactgggtcaggtgggcctgtcaccatggataccgtgcggtacccttggaacctagtttaagggctgttctctctctgtcttgcttggatgatagcagtggttgcaagcattgttgttggccgaggtgtaagtgtctctctctgcttgtatggggctgtggtgcccggcagtccttgaggtgttctgccctctgacatgtggtccccgttgatctcattaatgtgtttatggcttctggtcccacttattcgtgggtatggtgacccggagtctaagggcgggtcagcttggaggggaattgggagaatgtaaactactgcacggcttttatggtgtggcttgcgaatcgcatgtacgtcatccacagaaactctgttttggaaatataaatatatcgcgcttggcggcaattggtgctgacgaaacgagatagaaatttctaggtataaatatggagttggataactggtagtataggtattgactgggccgataaatagtatgtgtgtgtcctggaaggaagtttatgagaagggatctcatggtgaaagctactgcagggcaggaccgaggctctgtgcgtttcagtgttatccagagggatcgttgggcaaacgtgaaggcctccgagggggtagttgccgcgcatagataactgtgggggcgaaccaatgccgtggacacactgggtccaacggggcggggggggattactccgtaagaggatacggcacggtcccctaacaattcgggagagtgctcaggtgccaaaaaaaaattgggccgcgcaagacaccgaaagggggacgcctttagaaccgtagccaccataagggagcgcattattacaacaggaa

SEQ ID NO: 707680 - DNA, 935 bp, Homo sapiens
  misc_feature (32)..(32): n is a, c, g, or t
  misc_feature (433)..(433): n is a, c, g, or t
  misc_feature (548)..(548): n is a, c, g, or t
  misc_feature (564)..(564): n is a, c, g, or t
  misc_feature (568)..(568): n is a, c, g, or t
  misc_feature (763)..(763): n is a, c, g, or t
  misc_feature (771)..(771): n is a, c, g, or t
  misc_feature (798)..(798): n is a, c, g, or t
  misc_feature (835)..(835): n is a, c, g, or t
ggcgccccaaacagagatgacagcagagtccncgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctctctctctctctctctactgagctgtaacaaagcctctgtaaatcggtgtatccttttgaagcagtcctttctcatattgagatgtactgtgatttcactgaggtttcatcacaagaagggagtgtttcttgtgccattaaccatgtagtttgtaccatcactaaatgcttggaacngtacacatgcaccacaacaaaggcccatcaaacaggtaaagtctcgaaggaagcgagaacgaaatctctcattgtgtgccgtgtggcccaaaaccgaaaacaatgaagcttggtnttaaaggataaagttntctnttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaattnttaaaatngaaattagatcagtcattcttttcttntctcaagatatctcatggctgacactgaagaagaaangtaattcataacttgcactaaatgtatattttttttcttaaaaatttaccattcttatttatatttttatggattaaaatttataaaatacaaaaaaaaa

SEQ ID NO: 707681 - DNA, 426 bp, Homo sapiens
ggatttgaacgtcactgtcatcaattatatacacatgtgcagtctagactgtacttctgtatattttttaaatgcctagaaaaaagaggcatgtaaactgtaaaaatcaaattagatttgagacttactctttgatatgggttatttaaaagtatgttatcgaatttccaaaaatttgaggacattccgggtatccttctgttactgagttctagtttaagtctgttgtggtcagtgaacataatttgcatcatttcaatgcttttacacttattgaaatttacttaatagctcaaaatatgtctacaatgagtatggcatgtgcatttggacaaaaaactgtattttgctgttgaagggcacattctataaatgttgattgagcaacactaccggtcactctgattctcatcactccacaactga

SEQ ID NO: 707682 - DNA, 1599 bp, Homo sapiens
agagagttgggagatgtaggtgtgtggataggatgggagaatggtaggtgtagtgtaggtggagctggtgatatgggtaggtgtatgtgagtcgatggtaagactggtggtggtggtagagaggaggtgtttatatgggagtgtaagggggaataaggttttgagagagatgaaagggatgggtagtgtggttggtgagttattaaggattgttgggggatgggttatagtgttttataattgttgataattgtagttttgatttgtggagggtgtagatttggtgtagggagatttgtggcatgttagttgtgtcattaatagatgttagggtgcggtgtcccggaggtcccagggtgttgcgtggtttccgcgtttctcgacgcgtgtgttgggtggcgtgtgccgtgtcctttgcgtgtgggatttcgcgtttcgtttttgagtgggggtcgcccgctggggtgcgaggtgatagtgtcgtgggtgagggtgtaaagctgtggtgggcgcgcgttggtgggagatatggtgtggaggggtgccggcctgtttttgttgttttgtttttttttttttaaaacaaatatttttaattaaattttcaaacatgaaagtataaacgttaatatttgttgaaaaatatatacggcatttcccccgtgtgaacacaatggcttccggtaacactacccacttacaatgagatcttttaggcacttgggtgtagaatgtgcgagagggaaatgcaactttactttcctgctacctataggggcaaccacaattagatctcatgaaatattgttttcaacactgttagcattaacaccgacttaaaacatacggtgaccggacatataacctttaaagtcccagtatatttaaaacaggagaaatctggtaagttgttaggattctaaattccttttagtctgttcactgagatattaaatttcagtagacagaacccaaaaagagatttcatttctttctaatcactttggcttctttcttttttgttaagtaggtaaaaaccttcttggtgggcacctaagcaggatgcagccaatagttcatgaaccagctgcgcacgtgaggcttaaaatctaagatgctgctgaagtggctgcgggaggagcggctgcgacttacttttaatttcaaatcagctgcagatgtttgggagccctctcgatgaacagaacaaatcacataacatgcagaatccactcagaggctgttattccagggaaagagcgggcaggtgtcctgaggagtacattcttgctgtcacagtctcactgctggcacagaggtgccttgtttatgagatttaaaggccacaaactctggctcaggtggggacaagggtgtgccgtggctgaaaccagcgtggtcactgtgtggctggcacggcctgcacatgctgcaggagctgctcgcagtaggtggccgagcggtgcttgtggatgacggcctccgtctccctcaccaggagatctgggaacagcccgctgccctctttgaggacctctgtaaaacagaaaaacaccttgaacatgccagaaacaagcatgaaaccaatcttacctctcg

SEQ ID NO: 707683 - DNA, 441 bp, Homo sapiens
caaagatacagaatcaacctaagtgcccatcagtaacagattggataaagaaaatatggtacacatacaccatggaatagtatgcagccataagaaacaatgagatcatgtctcaggaacatggatagagctggaggctattatccttagcaaactaattcaggaacagaaaaccaaataccacatgttctcagttgtgagtgggagctaaatgatgagaactcatgaacacaatgaagggaacagacactagggtctacttgagggtggaagatgggaagagggagaggagcagaaaaagtacctattggtgatgaagtactctgtacaacaaacccgtgacaagagtttccctatataacaaaccttcacatatacccctgaacctaaaagtttttttaattgtaaataaatggatcattaaaaaaaattttaataata

SEQ ID NO: 707684 - DNA, 1830 bp, Homo sapiens
gtttatgaagaaaagaggtttaattgactcacagttctccatgggtggggaggcctcaggaaacttccaatcatggcagaaggtgaaggggaaccaggcacatctaaaattgcatcctggatggccctctctggatcgtcaaggtgaaccagcaactctcggtacaggtactggacactgctctgatagtaggattttgcgttggcacccttgacacactgcagccaggtgaccaaggtggaggcggctgccatcctcacatcgttggacacgtcatctaggcgttttaagagttcaggataaatcttgatgagtttctctggatccgtcatgccgcccgaggtttttaagaacgtgttgataatacggcatgagatcagtcgcgtcatcttcgaatcctcctccagggtggtcaggacctggggcatcagtgtttcctgcacgtcccgtatctgctctgccgacaggacctcgctgctggtgagcgcccagaggcaggacacggcagccgtgcggatggccgcggctgtcctccccgcatgccactgcagattgggggccaggatgtcctttgtcaccgtctcgaggtagctgggaaactgcccctgggagttgatggtgtccgtggctctgagcagcacggtggacaggatggagaacagcttcaggcgcatctgcgggtcttgggagggctgcagacaggccctcagcgtgggcacgacgtgtggcagggcttctcccagggcagggcctgactgtgcgacgatgacactgaactgcaggagctccggcgagtgtgcggtccagtcaaggtgcgacgcggtcacccgctccaggaggggaccaatgtgcttgcggtagaggtcctggcagctgctgacaccctccaccatggccagtgagtccatcgtctcctgtgccttgtccctcaggccggtagcacctgcgagggccactattgtcagcagcacgtccaagagctgcaggctggccacgccacagtcctcatgacacacagacaccagagcctgcacacacagcagcaggcgctccaggtagaggtcgttttcagatgcctggcagatgtgggcctgtgccagctctgtggcgatggctgccaggtgcggctggagggcttctcgggggcaaccccgcatggcggaggccagcaccaggaggccggaggcagagggcgtcttcttcagcgtcgataagatcagcttcagaaacacctcagggctgacaaacgtcccgacgagctctgcggatctggtacaactttggaccacggctgcctcctcgtcggtgcaggcctggaacagggtccggaggacgacctccaggtgctgcgtggcgtggtcctcggcatgcagcagcagcactgggagcagctgtgccgacttcactcgggtccccaccacccagtcggtgatgtcgtggcacagggcagggaggatcttggagaggttcctgaagacgagctcccggcagcccagcacagggcggcgctcatgtggagggtaatggggtggggtgggaggggcaaagtccagcttgtccttcaggtcctcctcattctccttctgccactgcaggccaacgtcctcccagaggctggcagccagctgcctgacctcaggcacctcgtcgttgaggctactgagcagcagagggatgagcttgtggaagaaggagtaacggtcacgcagacacagcagccagccgcccaccacggaggccaccgcccgccggacctgcgggacgtcatcaaacagtcgctgagcaaaatgggaaagcacggtcgacgcggccgcgaatttagtagtagta

SEQ ID NO: 707685 - DNA, 632 bp, Homo sapiens
ttttatttttagacaacctacatgacatgttgtctcttaaaaacaatgcgctccactccaaagaaatcagaggccgataaatgacgagctcaagatgagatcgagtcccatgtggagtggaggcatcgctaatagaagaacaaatgtcaaataagaagtcgaaaaattatacgcgtaagccgaaaaaaaaaaaacgaggcgcccggcacgtagcagcaacgcacacggaaagggcccggcacatggacaaacgataccaaaaagtcgcacagcgaaacacaccgtgggcacacacaaaacagaaccgcacaactcataaaccacaagcgccgcggcaccggacacacacaacaacaccccgcgcccccagcaaccgcgaaaccaccaccgcaccacgctgacgacagaaccctcgcgcgcacccaagaaacactccagcacccgccaggctgcaggcgcaaaaaacgacacaaaacaccaacacaaccaggacaaactcgaccaagcacaacccaaggacacaacacaaagccaagcaagcacaacaacacgccacacaacaccaccagcgaaaccacgacacgccagcaggacgacaaaacacaacaacgaccaacaacacagcaaaccac

SEQ ID NO: 707686 - DNA, 166 bp, Homo sapiens
atggaagcaattttggaggtggtggaagctacatgattttgggattacacatcagtctcaaattttggccctgaaggaggaattttgaagcagagtctggccctatgccgtggagccatacttgcaacccgacccagtgctatgcgtccgcgcgctgcttgctgcg

SEQ ID NO: 707687 - DNA, 698 bp, Homo sapiens
cacaccatcgagcacctcttgccccatcttcctggctcagactgaagggatgagtgcctctgaggtacctggttgaacatcatctctatacctggactgtgtgaacgaggtgattcggcatccggcagtctgtcccagtccctgcctccctgcccacttgtggcctctggcctgcaggagcgccaagtggcggggtgcggttgcgccatcatttgatgctacattgctcctctctctggcctggatccgctggcgcacgtggtagttctttgtatgtagcaaatttaacatccttgttgcatggcctggcgttgtggagtcaattgtagtattgaccatactccgcgaagtgcctatgtccagcctaagacatatcacttgaataagcaacgctaatgtagtgcagacgacatgtatttggtgaacggaagttgagagctccaatgtccaacaagtacaataccaccaaggttcttgcgaccattgtccgtgagaagcgcctcaaactaacctgcaaccggccatttaactatcgcatgcattctgccgacttcgaagtggtgcgttgtcgtgcatgcgttctgttcggaggcattcgcaccgagttcagcgcagccgacatggcaccagtggcgtgagccccaccgggtatcctggcctgtctagttgggcctttgcgtgcgatcgccgagttttcg

SEQ ID NO: 707688 - DNA, 541 bp, Homo sapiens
  misc_feature (505)..(505): n is a, c, g, or t
tcaacgcttatacttcatgctctacatcatcttcttttttttttttggagacagagtctggctctgtcccccaggctggagtgcaggggtgcgatctcagctcacggcaacctccgcctccggcgttcaagcaattctccagcctcagcctcctgagtaactatgattacaggcatgtgccaccacgccgggctaatttttctatttttcagtacagacagggtttcaccatggtgggccagggcgggtctggaactccttgacctcagggtaatctggcccacctacagcctcccaaaggggcggggattaacagggggtgagccaccgcaccgggccaactcattgacaccttttaatcccaggcggatttatttctttttcttagtataattggtttcatgaaagcaaagttattttagtattaacaaaatatattggagatgaaaaatctgagggggaacatttcactagtgagctctgaaggccagacagaaatcacggncaaggggtagtaaggcggttcctcagaggactaggt

SEQ ID NO: 707689 - DNA, 726 bp, Homo sapiens
  misc_feature (136)..(136): n is a, c, g, or t
  misc_feature (141)..(141): n is a, c, g, or t
  misc_feature (147)..(147): n is a, c, g, or t
  misc_feature (159)..(159): n is a, c, g, or t
  misc_feature (161)..(161): n is a, c, g, or t
  misc_feature (166)..(166): n is a, c, g, or t
  misc_feature (170)..(170): n is a, c, g, or t
  misc_feature (187)..(187): n is a, c, g, or t
  misc_feature (189)..(189): n is a, c, g, or t
  misc_feature (191)..(191): n is a, c, g, or t
  misc_feature (217)..(217): n is a, c, g, or t
  misc_feature (219)..(219): n is a, c, g, or t
  misc_feature (248)..(250): n is a, c, g, or t
  misc_feature (256)..(256): n is a, c, g, or t
  misc_feature (271)..(271): n is a, c, g, or t
  misc_feature (478)..(478): n is a, c, g, or t
tgcgcatgagtccggaagggagtgagtgcacaagtcgtcagcatgaatcacgtggtgctgttacgatcagtgaccagaagccttggtctggtattgttcctgatgacgctgcgtgtggctgtgtggctgcctgagngactnctggantgactccctggncnacccngccntccgtgcgctctgccancngngcgctcagcagagaccccgggctgcngnctgcacttgctgagtgcctctcccctgcnnncgcagnccagaggcgcccagnacctggagctcactggagctgagggtccgagctgagcgggctgttgtaaagccgaaaggcgagtcagtgactgggacctctgtcctggtggcgacggagagaaacagtgagcccgaggggcgcgggcacagaactgtccagctccgagaactggggtccgccagccggcggggaaagcagctgagcgcggaggcgagtgagcggacncgtccggggtctttgcagtccccgccgtgcccaatgggcacctgactctcggtcagttgggctgcggcagggctgggaggggcgcgccatggaggcgccgggtcgcgcctagtatgcctccatggccaagtgaagcggtccggctggggtcggcgggaccccgctgggccatgtacggcgacatattctaactgcctcgtggcgtgcccgaggcggctggtaggcagcgctgcttggcccaggagcct

SEQ ID NO: 707690 - DNA, 356 bp, Homo sapiens
  misc_feature (268)..(268): n is a, c, g, or t
aggctggaatgcaatgccacgatctcagctaaccacaacctccgcctcccgggttcatgccattctcctacctcagcctcctgaatagctgggactacaggcgcccgccaccacacctggctaattttttgtatttttagtagagacggggtttcaccgtgttagccaagatggtctcgatctcctgacctcgtgatccacccgcctcagcctcccaaagtgctgcgattacaggcgtgagccaccacgcctggccttaattattganttgaaataatttatttctttgggaaggactcaagatgctttttagtgatattcttggatcatttttctttacaaattcaccttaaaaa

SEQ ID NO: 707691 - DNA, 1019 bp, Homo sapiens
ggcgtggaggtcgcgcgccccttccggcgcggggagtggcgctgaacgatctggggccgctcgtgccgcaggcctgcctccagcgccgcgggatgtacgctgctggtgggacctgctggtccccaagcagagcccggcctgcccggcttgtctaccatcacgagggagatctctgccccctggggctgagagaccccaaacctttccccaatgctgaacgctgcagtggtatttgacgtgtaccagcccagatgtcttcccacaaacggatctgtggtggcacagggcgacctggggctccttgccagtaacagggaagctgacactggttggaacttggctttgaactgtggacccctgctacgacgacgaagggcaaaccgggtaatcgccaacccacccaaagctgaccggaagagcgaaacatgcccaagtgccccaggaagaagaggaggacggtgcgggtactgacacttccccttgcaaggcccacacgccatggcggaacgcatgtgaacgagctttagctcgtacacagcgtcctgggcacgggaccgttgggaccggaccatcacccaataatgaatggtggcccccatgtgactgtgctatcacggcacaccagagctatatcccgcgtaacacctgtgtctcatacgacactctgcccactagtgcccgtctcgcttatataggggcgactgtggaacagcaacggacgcactcgacccgcggcatcatcaatagcacgcgaacactgtggagcaaaccacgtgctgggaccccgcaatactcgcagctggggcttcactggcagcgctggatcgtcaacctgtaacagggggacgaaattcgggaggaccgccagcggccgtccacaaacccagaaagttactcagcacctaccagggcgcgcccgcaatataaccagaacacaagcggtaggccagagcgggaaatgacgaccttatatgggattcacgtgcgcccatcccgcactagcaccctctcgtggcgtc

SEQ ID NO: 707692 - DNA, 726 bp, Homo sapiens
  misc_feature (136)..(136): n is a, c, g, or t
  misc_feature (141)..(141): n is a, c, g, or t
  misc_feature (147)..(147): n is a, c, g, or t
  misc_feature (159)..(159): n is a, c, g, or t
  misc_feature (161)..(161): n is a, c, g, or t
  misc_feature (166)..(166): n is a, c, g, or t
  misc_feature (170)..(170): n is a, c, g, or t
  misc_feature (187)..(187): n is a, c, g, or t
  misc_feature (189)..(189): n is a, c, g, or t
  misc_feature (191)..(191): n is a, c, g, or t
  misc_feature (217)..(217): n is a, c, g, or t
  misc_feature (219)..(219): n is a, c, g, or t
  misc_feature (248)..(250): n is a, c, g, or t
  misc_feature (256)..(256): n is a, c, g, or t
  misc_feature (271)..(271): n is a, c, g, or t
  misc_feature (478)..(478): n is a, c, g, or t
aaaacagggagcgcatgcagcctggagtggagttgggacaagctcgctgaacactggtgcgtctcgacatgtggaccatgagcctgcagggacttgttcctgatgacgctgcgtgtggctgtgtggctgcctgagngactnctggantgactccctggncnacccngccntccgtgcgctctgccancngngcgctcagcagagaccccgggctgcngnctgcacttgctgagtgcctctcccctgcnnncgcagnccagaggcgcccagnacctggagctcactggagctgagggtccgagctgagcgggctgttgtaaagccgaaaggcgagtcagtgactgggacctctgtcctggtggcgacggagagaaacagtgagcccgaggggcgcgggcacagaactgtccagctccgagaactggggtccgccagccggcggggaaagcagctgagcgcggaggcgagtgagcggacncgtccggggtctttgcagtccccgccgtgcccaatgggcacctgactctcggtcagttgggctgcggcagggctgggaggggcgcgccatggaggcgccgggtcgcgcctagtatgcctccatggccaagtgaagcggtccggctggggtcggcgggaccccgctgggccatgtacggcgacatattctaactgcctcgtggcgtgcccgaggcggctggtaggcagcgctgcttggcccaggagcct

SEQ ID NO: 707693 - DNA, 1184 bp, Homo sapiens
ccttgtttgtgaccgttcgttgcccttagaggcgccaatcgccgtgcgcgtgctgtccgtgcggattacgttatccgggggactgtttctggccttctggtctgtcttcccgtgtggccccgtcgtttcccgtttactcgctcttgcacatcccgggtaccccgtgcttgctggtccctttgctgggccctattggtcactgggtcccgaccttatcttgtctcgtcgggcttcttttagtcccattggtcgtgcgtctgtttagcgttgctccgggaactttcccgtgtgttacgtacgttgtgtgcctattgtgtccctcgggcggtccttcgatgcagtagtgcctctatcgttccccctctcgtggtgggctactcttaacattcactgcttatcccctggcttgtgttcccctgcagcgcttcttagcagccctctgtaccctctatctggacgttatgtcatgaaagtatactatcctggccgcatggaatctacctgtggctcacccactccttgccaagttctatcatatctctctttcgatttaacgtcccgggagactgcagtcgtgtcaacgctatcgagtccgtctcatatgcctaaccgcacagtgccatttgcttgctaggcctttctgtctcagagggcctgcccatcgggggatatacccgtagatgcagccatatcgtggcctcgtccggcctccgggatcacctggtggatgtagtatgtgaacttgcgaaggagttatgtgcattatctatatgaggtctgatgcatggagagatcgccatgctctcgcggctgtgacccccagctctcacacctgcctctggttcccgcctggtcctccgagcttcaggaccccacctccaaaggcccctctgctcaatgcctacctccctagggccctagctgtgcacatgaggggcctgagtgcccatcgcaagggctctcaaggatcaccggtaaggcctccaggtcagtgagccctcacttctgccgttacacctctgcctgggacccgagtctgggctccgtgggaccattggtctcccagaagtatggcggcatagggcctcgaccgtccaggacagagaagggacggggtggactgaggcagtcagggaaggagggtcgcccggatccgacattttggagagattcatttactccgc

SEQ ID NO: 707694 - DNA, 208 bp, Homo sapiens
ccccaaacccttaaaaaccaaaactggtttgggtgttaaaaaaggggtaattaatggtttttgttagttcccttcagcttaataaggatttattgcaaatttgctatgtccccagtgggcccccacttaaagatatgtatcataaaaataaaatctgttaaccctagggaatggttatataaaaaacataaaatttttccatttttga

SEQ ID NO: 707695 - DNA, 351 bp, Homo sapiens
catttccggaggttttaaatttataaaaattaggggaaataaatccaatttggttttttaaatttttttaaataaaaaatttcttaaaatttttaaaattcatgtccatttccttttttccaacccataatttttggctgcctttttccaataaaaaaaaattttcagggggcaaaaaaaatcatttctgaaaatacctttaaccatgtttccggaaaaaacccaaaaaattacctcctgtaacaagaccattcgggggcggttaatttttcgggggaccctttcttttctggccataaaggtttggggaatttaatacctgggggggaaaaatggaccctgggggctttc

SEQ ID NO: 707696 - DNA, 260 bp, Homo sapiens
ggcacgagggcggagtctgcggccgttcccgcggcctcctcctcctccccgttcccttcacccccaccccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcggaggcagacagtggggaggaaggaattggcccccgg

SEQ ID NO: 707697 - DNA, 690 bp, Homo sapiens
  misc_feature (28)..(28): n is a, c, g, or t
  misc_feature (130)..(130): n is a, c, g, or t
  misc_feature (177)..(178): n is a, c, g, or t
  misc_feature (185)..(185): n is a, c, g, or t
  misc_feature (196)..(196): n is a, c, g, or t
  misc_feature (203)..(203): n is a, c, g, or t
  misc_feature (298)..(298): n is a, c, g, or t
  misc_feature (537)..(537): n is a, c, g, or t
  misc_feature (578)..(578): n is a, c, g, or t
  misc_feature (589)..(589): n is a, c, g, or t
  misc_feature (597)..(597): n is a, c, g, or t
  misc_feature (599)..(599): n is a, c, g, or t
  misc_feature (610)..(610): n is a, c, g, or t
  misc_feature (622)..(622): n is a, c, g, or t
  misc_feature (642)..(642): n is a, c, g, or t
caatttttaccttttttttaaataagtnctcagaaatgggaacagttgcatctaatttgtgtgaaaagctgtttaaaacttcttacgttttcaggtaattttactccctggtgaaattctgatctacaangatagaaagccccaggaatttctcttagcacattatcagttcattannaaaaacnaaaaaaaaaangaaaaanaagaaaaaaaccttctacaagaaaaaaatgaaaacaaatagttagtggttggtaactgccttgaatgatttacctttatccttaaataacatgtnaacttacaaattgccgagcagaatacctataatgtttgttaaactctcactgtttgttaatttgcctaattttatttcatttttttgttttgttttaaagggggttttcacttacactttttggtatgatgaattttttgttaaataaacagatacaatagaattaaactaaggaccaattagtgcaaaaatgcattaaatacagctctccaggatttttaggatatgcctcatttctnagccataaaattaaaaggaaaaatcactatgatccacattncttttaaaagngaagctgnancagccatcttnttaataagaaancccatccagttagcaaacancattctcaggaaagagatcaccatgctctgggaaactataacctaatt

SEQ ID NO: 707698 - DNA, 262 bp, Homo sapiens
  misc_feature (179)..(179): n is a, c, g, or t
cgtcagaagcactttcacagcacgacggcttatattctggggctcattctaaaactagttccacgtgggataccggaatttaagaaacttccaaatcaccagtgtgttagttgaagatgataaagttgggaccagatatgctggaggagccagatcactgcttttgaggactatgtcgnagtccctggatgtggctgctttcccaccagattttaaatccatcctggatcatggcatttataattaaagattgaaagattta

SEQ ID NO: 707699 - DNA, 664 bp, Homo sapiens
aatcgagctcctacctttgctgaaggtcaagaagaggtgatcacgataggtgggagtgaaggacgcttgctggcatgtagtgggagggaaattagtgtgtggaggaaagtgtgtggcaaagagaagttgggccaggtgcagtaatcacgcctgcaaatcccagcattttgggaggccgaggcaggtggatcatttgaggtcaggagttcaagaccagcctgggcaatgtggcaaaaccccatctctacaaaacattcaaaaattagttgggcgtggtggcaaacacctgtggtctcagctacacaggaggctgaggttagaggctgcagtgagccgtgatcataccactgcactctagcctgagtgagagagcgagaccctatctgaaaaaaaaaaaaaattttttttttaggattttctttcacacacacacttaacttaagatttaccagattgccaagtgttcacacatagttggtagcgtccgaggagtcaagaggagcggacgtattctctagggagcccggagaaagtctgtttgcggtgtgtccattttctccctagtaggtcttgccattgccaaccaatctggtgaacctatctcctccttccaaacccagaagctggatcttcccggttacctttagaatttaagccttaggcg

SEQ ID NO: 707700 - DNA, 399 bp, Homo sapiens
tttttaaaaaaccccccgccccccggggctttgggcgggaaaaacaaaattttttttcaaaaacccaaggcctgggaccccatggggccccaaaaaaaaactcccccggggaaatttccccgtgccccccccattaaaaaaaaagccccaaacctttgggacgggggaccccccaatttaaaaatttttctttcccattgttcccacaaaacccatgggaatttgcccctaaaatgtttttaaaaaaaaaaagttttttttgaactttaaccttttttcccccccccccgggtttttttttttttgccaaaaaaccaaaaaaattggggttccccgggaatgggggggggaattttttttaaaaaagctttaaaaaaaaggggccatttcccagggccc

SEQ ID NO: 707701 - DNA, 601 bp, Homo sapiens
agcggagtgtccgaggaacttttcgccggcgccgggccgcctctgaggccaggcaggacacgaacgcgcggagcggcggcggcgactgagagccggggccgcggcggcgctccctaggaagggccgctacgaggcggcgtggcccggcgggcctcccggaggaggcggctgcgccatggcacgagccacccttcagcagaggcggcttctggagcaggcgctgggcgagccgtgcgatctggacgcggcgctgctgaccgacatcgaaggtgaagtcgcgcgctgggtgcaggggctagggccaacggcctggtacgccccaagggcgggcgcatgatcgctggatgccactggcattgcactttcgagagacatgcttcagcgttatcaatcaaccaaggactagtgacttccctgcgcctatttgagcccacccgtatgcttcggagttggggcaggtgggcatcgagatccctgccagtccgccgataccgagctccctcgggcacgcttgtctccacctcctgccatcggttgagctcctctctctgaagccttcctgagcgggccgcaggcagcgccctcagccgtgtgcccttcg

SEQ ID NO: 707702 - DNA, 418 bp, Homo sapiens
cacatgaaatttgttactttgcggcatgcagtgattttatgtacaattatattattaataacatacagtaagtcacattagaattagaggattttcccatacttttggaacatataccaataacacatttatacaaataacagcccaaagaaaaccaaacaccatttcacatttgataatgcttcctgagcaatttttgcaccaaataagccaaacgtcactcttgcattagtgcactgttgatgtcaaagccaattaattcttaatgaaatcttatagacaaatgtgttcaaacttaatcagtttggccataaggtaagtttctcataagcctttgataaccctttacacatttttattaaagagcaggtcataggcaggtttttgctcgaagaaaaaacctgttatgcttttattc

SEQ ID NO: 707703 - DNA, 2493 bp, Homo sapiens
  misc_feature (166)..(166): n is a, c, g, or t
  misc_feature (173)..(173): n is a, c, g, or t
cctatcttgtgtgtcgacaagagccagcgtgattgcagaaggcacaccgtgctaatattgcgcccactccctccctctctttttcaaagctattaagccaatcgtacattccaagtgtgagatggaccagcggattttaatgcactgagcgtggaaggctctgtgntgtgtgncctcaggccctgtgctgtgagtgaccttcaagggacggcctgtgtcgctgttggcgtggtattgaagaagtcccacgcctatctgaaaaggctactaaaatactcttcttttgtccaactacacttgaagccacaggcgaggccagattattttccacgtatttcagccagagccatacacatcatgactgactgtatggaagatgtgaaagtccagtgtcttccatcaagctacacatttaagacatttgcaaaaatcgttcttgcagatgattttgttttggaaagtatttttcaaaaacacaagccatctgtgtcaatatatactgggcttactattgttattttaaacaactaacaagtattctagaatactctcagttttgatttctgttagaggaaatgtcagcagctatcaccacaaagacagccgctctcagggtttgccaagaactcaagagtgtgccaggccggagctgaggcccctcctgtgccccagggccctgtggccggtcacacggctcagctacagatgcccgtggcaggcgccgaaagcaggcatcggaacgaaggccaagccgtcggagtctcatctaaaattgcatcctggatggccctctctggatcgtcaaggtgaaccagcaactctcggtacaggtactggacactgctctgatagtaggattttgcgttggcacccttgacacactgcagccaggtgaccaaggtggaggcggctgccatcctcacatcgttggacacgtcatctaggcgttttaagagttcaggataaatcttgatgagtttctctggatccgtcatgccgcccgaggtttttaagaacgtgttgataatacggcatgagatcagtcgcgtcatcttcgaatcctcctccagggtggtcaggacctggggcatcagtgtttcctgcacgtcccgtatctgctctgccgacaggacctcgctgctggtgagcgcccagaggcaggacacggcagccgtgcggatggccgcggctgtcctccccgcatgccactgcagattgggggccaggatgtcctttgtcaccgtctcgaggtagctgggaaactgcccctgggagttgatggtgtccgtggctctgagcagcacggtggacaggatggagaacagcttcaggcgcatctgcgggtcttgggagggctgcagacaggccctcagcgtgggcacgacgtgtggcagggcttctcccagggcagggcctgactgtgcgacgatgacactgaactgcaggagctccggcgagtgtgcggtccagtcaaggtgcgacgcggtcacccgctccaggaggggaccaatgtgcttgcggtagaggtcctggcagctgctgacaccctccaccatggccagtgagtccatcgtctcctgtgccttgtccctcaggccggtagcacctgcgagggccactattgtcagcagcacgtccaagagctgcaggctggccacgccacagtcctcatgacacacagacaccagagcctgcacacacagcagcaggcgctccaggtagaggtcgttttcagatgcctggcagatgtgggcctgtgccagctctgtggcgatggctgccaggtgcggctggagggcttctcgggggcaaccccgcatggcggaggccagcaccaggaggccggaggcagagggcgtcttcttcagcgtcgataagatcagcttcagaaacacctcagggctgacaaacgtcccgacgagctctgcggatctggtacaactttggaccacggctgcctcctcgtcggtgcaggcctggaacagggtccggaggacgacctccaggtgctgcgtggcgtggtcctcggcatgcagcagcagcactgggagcagctgtgccgacttcactcgggtccccaccacccagtcggtgatgtcgtggcacagggcagggaggatcttggagaggttcctgaagacgagctcccggcagcccagcacagggcggcgctcatgtggagggtaatggggtggggtgggaggggcaaagtccagcttgtccttcaggtcctcctcattctccttctgccactgcaggccaacgtcctcccagaggctggcagccagctgcctgacctcaggcacctcgtcgttgaggctactgagcagcagagggatgagcttgtggaagaaggagtaacggtcacgcagacacagcagccagccgcccaccacggaggccaccgcccgccggacctgcgggacgtcatcaaacagtcgctgagcaaaatgggaaagcacggtcgacgcggccgcgaatttagtagtagta

SEQ ID NO: 707704 - DNA, 243 bp, Homo sapiens
  misc_feature (176)..(176): n is a, c, g, or t
gccaagtctagaggatcggaaaaataactatgggtactaggcttaatacctgggtgatgaaataatctgtgcaacaaacccttgtgacacaggtttatctatgtacaaccctgtacttgtagccctgaacctaaaagttttttttaaaaaaaaaagaaagaaagaaaatacagatnagtctgagcccaaagtatttacccaacaatggtaaagtattttaataaattactttattactggttt

SEQ ID NO: 707705 - DNA, 936 bp, Homo sapiens
catacacagatgccctcctggacgaggctaacatcccgaacttagccgctaccctgcatctgctgcgtccccactcccttggtgtttgttgggtgatcgttgctctctgggcttttgggtttagggggcgcccggtctctgctccttctactgttccgctcctggtcttcccaatagatagtcgagccgtgttgcgtagaggtatccccatgagccgttgaaaaggggcaccaagagcccccgatcttcaatccgtgtgcaacagcccatacttctcacgtgcgccatgtcaagcatgcaagtgtggatcaatggagcggtgggtgctaggacccgcagggattcaccacaaggcgtagactttgtgctgtccgtccaattcgtacgtggggggctcaactttgttctatgcgctgtaccctcacatttccccttaactaccccgcgttacgtcacgggtttggtgcactatgccaccgcttcctggctcatcagcggcaagggagtgacgcgggttgacgtcgcccttagttcccctcttgtacacttagtggctccgacaacgtctcgcccctttttgccccgtcccggctcttgtgcccattcgtgaattccccattattcgtggggctgatatggatcgattcgtccgacacttgtgtatatgctgcaaagccgctagatcggctgcgaattgacgcgcgctggatggtccctgggcgaccattgagggtcgggtgccctaggtggtccttggtatcgccgggttaaaacccttgacctgtgtggtcgtttcctggcgcacatctttcccttattttactccaccgtccgtcaaggaaatgggggcaacctccttgacaaaggttgggcgttcggcacgaggccttcgatttgaagcccaccacactatttttcgccacctggttcgccttg

SEQ ID NO: 707706 - DNA, 110 bp, Homo sapiens
ttattgttgtaagaggaactattagaaggattatggatgcggttgcttgcgtgaggaaatacttgatgacagcttctgtggcaacgagggtttacttttttcggttagaa

SEQ ID NO: 707707 - DNA, 208 bp, Homo sapiens
gatctagcaggatctcctcccataatgtgtgccactctgcatttgcaagcaggggtgtaggattaagccagaagctaacagccatccaccactgggcgactctgtgcctccatccccttccctcccatgtagctaggtttcttgcctcccactgcatccctgtgcagccccactatggcttccatgcaatggcccacctcacactctg

SEQ ID NO: 707708 - DNA, 517 bp, Homo sapiens
gagcagggaactacggactcactgctggagctgagcaaacacagtcatgtaccaggaaggtactgaagccccgaggcaggagcatactccaggaccaggatagaggaaggtcccagggacaataatgagtacattgccagacgaccagataagcaggaaggggctttagaccccaaagaatatcctcacagtgcgacagatgaagcacatcctgttgaatcagcctagaggagaagcagcaggaatgatgctttgatactctggaggagaagttaactcaagatgggattcatgttctgatttgaggaatgaaaatgagatgatcaggcaggaaactgacattccaaggatctaatccaggaagtactctcagtggggaccacctgctttcatcccctggacattgtgggagaaattttgcaatgtatgctaatcaaaatgtctttatatgttctctgctgatgttttatagaggtctgtgaagaaaattcaacctcaggaacttcagaaaatgtcc

SEQ ID NO: 707709 - DNA, 795 bp, Homo sapiens
gagcaaaccagactccagcctgttttgatggatgaggagactgtgcgcagagcactctgatgcccgagggcgagactgcgccgtttgcattcacctgctggggatgcagcatggcccctcttgtaattgaattctacattatatctgtcgtgctgctaatttaccgagcccgggagattatagagacctatttatgggattcctgtagactctctctcgcacatacatacatacatatatatgtatgttacatatatatagaactacagctctctatattgtatatataagagatgtgtatactgtctcttatatctgcagggctgttgttatatggtgtctacactggaagtatcctactgttgtggacttgagctgagaggagactgtcgctactctagacctctctctgatatacgcggagatgacatactctcgcatgagctttccttcgtatcacttgcaggggcgagagtgctctcacttggagcagactgtgacatgtgcccgcatgctggcctatattaccctgctttgtgagctctgacaggatcagacatggctctgagcctatctaccccacttcatagcagacagttatactgatgcaggttcttgatgaggtcactgcatcttaccaccagttcgtggagcatcaggacacttgctgagctgtggtgtagccttcacatgctggacgcgcatctcaccgaccagggcgctagcgtggtttatgcttgatgcctgacggcctgtgggtactctcaccagcttttgagctagcctcacgacgct

SEQ ID NO: 707710 - DNA, 404 bp, Homo sapiens
aaataaaaatgcccgtcgaccagtaacaatccgatctctctttctcgtccccacaaatactacatgttctcacttataagtgggagctaaacaacaggcccacaagaacatacagaaagaaatagtaggccgggcgtggtggctcacacctgtaaccccagcactttgggaggccaaggtgggtgcatcatgaggtcaagagattgagaccatcctggccaacatggtgaaatcccatctctactaaaaatacaaaaattagctgggcatggtggcatgcacctgtagtcccagctactcgggaggctgagacgagaatcacttgaactggggaggcagaggttgcagtgagccgagatcgagtcactgcactccagtctaagtaacaagagtgaaactttgtc

SEQ ID NO: 707711 - DNA, 941 bp, Homo sapiens
  misc_feature (31)..(31): n is a, c, g, or t
aggagaacaaacttacggctaggtacgaggnctgggtgtgctagagcccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttcggtaatggtttcatttcagttccgctggctattcttcctaatctatatccatagatctaaggggcaaacagatactagttaactgcccccacctctgtctccctgtcttctttagatcggtctgattgattttcaaaagtggacccaaacttagggaattctggattaaggggtggctggtggcaaggaggggcaggggatatggggacgtgactgggacaggttcctgccttatcattttctccctaggacattcccttgtagcccccagaattggtctgggcccaaaattgaatagaagcagaaaaacatttaggggataaccatcagggccagtagaattaagcctctccacctgttcccaaccataaaaagggtctcccagctttccatctctggccaatatgctttatcccaaaaaaaagcgataacgttcagacgtcggccattagaaatttaagggaatttccagcagcaagcatgctttgatatctggttcagactatcatcaggaaga

SEQ ID NO: 707712 - DNA, 1045 bp, Homo sapiens
  misc_feature (31)..(31): n is a, c, g, or t
  misc_feature (1040)..(1040): n is a, c, g, or t
aggagaacaaacttacggctaggtacgaggnctgggtgtgctagagcccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttcggtaatggtttcatttcagttccgctggctattcttcctaatctatatccatagatctaaggggcaaacagatactagttaactgcccccacctctgtctccctgtcttctttagatcggtctgattgattttcaaaagtggacccaaacttagggaattctggattaaggggtggctggtggcaaggaggggcaggggatatggggacgtgactgggacaggttcctgccttatcattttctccctaggacattcccttgtagcccccagaattggtctgggcccaaaattgaatagaagcagaaaaacatttaggggataaccatcagggccagtagaattaagcctctccacctgttcccaaccataaaaagggtctcccagctttccatctctggccaatatgctttatcccaaccaataagcccccccaggaataaaggctttgttttggggatgcttaaatcttgactggcacttcccggctgtgggggctggggagccacttgtaacatttctgtgcagattttatgttagccactgctatgtaaaagcacgttcaaaatgaatttcagcagattatgtgttaccataatgaataaacgtcctctatcnccaaa

SEQ ID NO: 707713 - DNA, 688 bp, Homo sapiens
  misc_feature (194)..(194): n is a, c, g, or t
tcaaacagtaaaaacctgaggatgtgtacacgatgggctaatctccaactgtggcgttcaacctggtgaagttaggtttctcatctgggcgtggtgggtttcgcctgtaataccatctgtttgtaaggtcaggcatacggttctctttagcccaggttcttatgattaacaccacaacttatcactatcagtcnagctgtgttaattcaaacataaagctcttggaccttcatgtatttttcatccatgacagggtatggtctctccagcataagtcatggggcattcatctgcactttccacccaatggtatgttttgactgtcatcacgtggaaagggcatatggcaccatacataatccgccattagatccccttttagattagtgccatgctcagggggtaataaagtcatcatcccaggaatgtagcaatctataaccgatctaagcactgtaacatacgccctggtcttgtacggagcatgctgtgatccagtgaagattcctcatgctttgcctgtgtcagtgtaacctcaagttctccagtatggcatgctcgcaccaatctgttacaggcagtgcaatctgggtggaagttcgcatactttgctctcaaacaaactcgaatcttagttagatttcctgactagcattacgtcaggttgacataataaacatcttgtagt

SEQ ID NO: 707714 - DNA, 458 bp, Homo sapiens
  misc_feature (30)..(30): n is a, c, g, or t
  misc_feature (158)..(158): n is a, c, g, or t
  misc_feature (453)..(453): n is a, c, g, or t
aagtgaccactggaatgttttaatttcccnaagcttttttttcccccataaataagtttcactctttggcgattttcttcacttgtttaagataacgtgctagctattccaacaggtaacagctttcacagttctgcccctggcctgtctcccccatncccccaccctattcctgccagtgagtccttcctgtgcttctctcccttctcccctcccagccagctgacttcagtcacccctgtcccccctcccctgccaataagcccccccaggaataaaggctttgttttggggatgcttaaatcttgactggcacttcccggctgtgggggctggggagccacttgtaacatttctgtgcagattttatgttagccactgctatgtaaaagcacgttcaaaatgaatttcagcagattatgtgttaccataatgaataaacgtcctctatcnccaaa

SEQ ID NO: 707715 - DNA, 219 bp, Homo sapiens
aggcaatggggagatagtactatcatagaacacacgtcgggagaaggacactcctggtgaggcagtggcgtgatcttggcctcccaaagtgctaggtgattacaggtgtgagccacctcacctgtgctcaatgcctgtactgagtagttattccatatgggtgtactagaaatcagacaggttaaagggacagtactagataattgtagggggggggga

SEQ ID NO: 707716 - DNA, 375 bp, Homo sapiens
  misc_feature (333)..(333): n is a, c, g, or t
  misc_feature (364)..(364): n is a, c, g, or t
  misc_feature (374)..(374): n is a, c, g, or t
ctaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgctgttagtatcagctactcaagaggctgaggtgagattatcgcttgaacccagggaaacggaggttgtagtgagcggagatcgcgccacttgcacttccagccttgagttgacagagtgaggaatccatcttcaaaaaaagacaaaaaacaaatttgnttgctaaaaggaagttggtctccttgaggtntttaaggacnt

SEQ ID NO: 707717 - DNA, 170 bp, Homo sapiens
gagacggggtccccagctggggatcccaggtgggggccagtgacccccccccagctttttgcggggttgcccccctggggttaaaccacccccctggaaggggggggttgcagtgagttgagattgggcccgggcccccccgcctgggccccagagccaggttttgtcca

SEQ ID NO: 707718 - DNA, 550 bp, Homo sapiens
  misc_feature (18)..(18): n is a, c, g, or t
  misc_feature (65)..(65): n is a, c, g, or t
  misc_feature (73)..(73): n is a, c, g, or t
  misc_feature (79)..(79): n is a, c, g, or t
  misc_feature (85)..(85): n is a, c, g, or t
  misc_feature (89)..(89): n is a, c, g, or t
  misc_feature (93)..(93): n is a, c, g, or t
  misc_feature (104)..(104): n is a, c, g, or t
  misc_feature (106)..(106): n is a, c, g, or t
  misc_feature (121)..(121): n is a, c, g, or t
  misc_feature (125)..(125): n is a, c, g, or t
  misc_feature (133)..(133): n is a, c, g, or t
  misc_feature (148)..(148): n is a, c, g, or t
  misc_feature (165)..(165): n is a, c, g, or t
  misc_feature (174)..(174): n is a, c, g, or t
  misc_feature (178)..(180): n is a, c, g, or t
  misc_feature (191)..(191): n is a, c, g, or t
  misc_feature (200)..(201): n is a, c, g, or t
  misc_feature (213)..(213): n is a, c, g, or t
  misc_feature (221)..(221): n is a, c, g, or t
  misc_feature (227)..(227): n is a, c, g, or t
  misc_feature (239)..(239): n is a, c, g, or t
  misc_feature (248)..(249): n is a, c, g, or t
  misc_feature (258)..(258): n is a, c, g, or t
  misc_feature (270)..(270): n is a, c, g, or t
  misc_feature (274)..(274): n is a, c, g, or t
  misc_feature (301)..(301): n is a, c, g, or t
  misc_feature (311)..(311): n is a, c, g, or t
  misc_feature (316)..(316): n is a, c, g, or t
  misc_feature (326)..(326): n is a, c, g, or t
  misc_feature (328)..(329): n is a, c, g, or t
  misc_feature (335)..(335): n is a, c, g, or t
  misc_feature (339)..(339): n is a, c, g, or t
  misc_feature (341)..(341): n is a, c, g, or t
  misc_feature (346)..(346): n is a, c, g, or t
  misc_feature (352)..(352): n is a, c, g, or t
  misc_feature (360)..(360): n is a, c, g, or t
  misc_feature (391)..(391): n is a, c, g, or t
  misc_feature (409)..(411): n is a, c, g, or t
  misc_feature (413)..(413): n is a, c, g, or t
  misc_feature (420)..(420): n is a, c, g, or t
  misc_feature (436)..(436): n is a, c, g, or t
  misc_feature (457)..(457): n is a, c, g, or t
  misc_feature (460)..(460): n is a, c, g, or t
  misc_feature (473)..(473): n is a, c, g, or t
  misc_feature (537)..(537): n is a, c, g, or t
gcttttagtttagggggngtttccatgaagccacaaactaaactaattatcaaacacattagttntttccagnctctantagatnctcnttcnaccaataagcngngaaagaagcttttcntgtnctctttcnttttgctataaagcnttttttcttttgactanatgcaaggngagnnnttgtttttttnctccttttnnttgccctcagangatgcacnatctanttcaggagtaanacgtttttnngggtgtttntcttcttccttncttngggggtctacaaccagcatatcttcgnggcggtgaanttcgnggcgggggantnngcggcngtcngngggangttccngactatcnatcacggcgggatgctcgttgctctcatcgntggcttgccgcttatatnnncngggctgntgggggcggggggttncagcccgctggtcatccagcngcntcgcttcatagcngtccttcccgcggctgtcccaatcaggaggcgcgttcaggtcctgggcaacggggatggccttntatgcaccattca

SEQ ID NO: 707719 - DNA, 357 bp, Homo sapiens
  misc_feature (20)..(20): n is a, c, g, or t
aataccccctaattatgatnggatagccatatacctcagacattagaatgggtagaccacccctatattattttaaaacaccatattaatattattccattaaaatataaccctatggaagattaaacatcactttggcaatcctctgtaacctaaacatgtcaaataatcctgtttaccctctctcttggatgctctaggggtcctctagcatccaaaagctaggggtcaggaaagacaatttttgaagctgaagtttgattttgggaaatatgttaaatatatatgttagaggttcaaaagcatgtgatattatggaatagaattccagattaccgtaagttcttttgccaaaat

SEQ ID NO: 707720 - DNA, 376 bp, Homo sapiens
  misc_feature (54)..(54): n is a, c, g, or t
aactcggccgcccgcctgccgcctcccgtaaccccgggcgcccgccagcggcangcatcgcgcctaattctcgtacggtttcacgccgggtgcggcctggactgcggaccagccgggccgctgcgcaatttgcgtacaacggcgccgccaggcgatttgggttgttggcggtagcgggatcggggagccggagccccgggtccccacgacctgagccggctctcccatcagcgatctggtgcgttccaatcgcttgtactcatatctgatcatgcaacgtggacgcggtgggggagggtggggcgggggcagctttcgagaattacgaggacaggaggcagaggcctccccatccgcattattggaggagagagag

SEQ ID NO: 707721 - DNA, 114 bp, Homo sapiens
accctcacgtctcatgtcacaaacgccgggcccacgcagccttctggtggcctgctgccctcgtgggatggggcaccctccacctccgaggtgtacccctgtacccagagacct

SEQ ID NO: 707722 - DNA, 244 bp, Homo sapiens
tgcactgtgtatgcgcgcgggaggaggaacgccggtctttagggtcgggccggctggcatggattcaatgcctgagccggtccgtgtcttctgcttcttcccttgctgctgctgctgctgttgtagtgccggccctggagctgggcccgagccaggccggagctgaggagaacgactgggttcgcctgcccagcaaagctaaatagcaaatagtataaggctcactggaaaatgtggctgggaa

SEQ ID NO: 707723 - DNA, 482 bp, Homo sapiens
ttactaatatgctgtctcacaattcagcttctataagcaagaggcatttttttctacaccggccctagagaaggagtaaaacagttttgtttctagaccataaccatgaagcaggtcatagtatttctgcaacttttttttttattggtggggttttctttgtgggacagagtctcgttctgtggccccggttgaagtagcagtgcccatttaagcaatatttgcttcattgcacaaagcgggcatttcacatccaaccacccaaaaaaaagtttttcagcagagttttaaaacacaaaacaaaccaaaacacacaaaccccagttctgaaatacacatctttgcgatggaatatttcacaaaatattaggagcctttacattcttacctagactatgatttcaatataattgggaccctatgttatagatgtcccataatattcttctaattatcctaaccaaacttcagtttaaaaccaa

SEQ ID NO: 707724 - DNA, 852 bp, Homo sapiens
  misc_feature (467)..(467): n is a, c, g, or t
  misc_feature (694)..(694): n is a, c, g, or t
  misc_feature (729)..(729): n is a, c, g, or t
ttcagattgggtgactgagacgcgtgatcactgtggacactaaggcggcaggcaaaggcaggagtgacgtgcaccagtggtgcatcgccctgatggactcaagaggtgtgactgtggcacgtggtgcgaggaatgacgcgacgggcactttcgacatcttctacacggccccccagccgggctgatacgatcatctgtgatgcgctttggtgtggcgagcacgtgcccaatcagccccttccaagtgacgggtctctggctggggacctagtcgcctcgtgtgcagccccctctacggtctcagctgcgtggccccgacaggtacacctacgcgcagggcggccagccagacttgcgagccccggataggcccctggtgggttgtcaatgggcttggatgtgccagcctgaggccctttgaccttgtcatccccttcaccatcaagaagggcgagatcacaggggangttctggactgccctgcatggcagaggtgtgcgtcgagcgcgcacctatctagctgacaagcaaagatcggcagccgtgaccgtggcggtatgcacccagcgaggctggcctgcacgagatggacatccggctatgacaacatgcacatcccaggaagccccttgcagttctatgtggattacgtcaactgtggccatgtactgcctatgggcctggctcacccatngagtagtgaacaagcctgccaccttcaccgtcaanaccaaggatgcaggagaggggggcctgtctctggccattgagggcccgtccaagcagaaatcaggtgcactgacaacaggatgggacatgcagcgtgtcctacctgcctgtgcctgccgggga

SEQ ID NO: 707725 - DNA, 139 bp, Homo sapiens
acccttttttttttttccccccttttcccccaattttttgggggtttttggcctccttttttttcccggggtggcccccggtttattccccggtgttttttgttccaaaataaaaaccccctgttgcccttggggggga

SEQ ID NO: 707726 - DNA, 137 bp, Homo sapiens
aatggctgtgtgcgggacgctgctatctgggtgggctggcagtagcccgacgatgactgggctcttctctggggagtccaacctggttccctacagaaatccaaggcgaatcctcggaagcttcgtcggatcaccac

SEQ ID NO: 707727 - DNA, 105 bp, Homo sapiens
gagaaaaaaacacaaaacagcaccacagaggaagagagacagacgcgagataaagaagaaacagaaaacgaagaaagaaaaaagaaaagaaagaacagaacagga

SEQ ID NO: 707728 - DNA, 530 bp, Homo sapiens
cgagtcaacttccggcagagggctcatggcagggcgagtaacaagcgtcggggcggtcctccaggccctcccatcagccggtggactgcccctttgtggagtgatggctggctgaaccacagttcccatcagcaaaggtagccgccccattgacaccttcacagattcaccaaggatcaccaagcctggctccatcgattctaacaaccagctctttgcacctggagggcgattgagctggggcaagggcagcagcggaggctcaggagccaagccctcagacgcagcatcagaagctgctcgcccagctactagtacttggaatcgcttctcagcccttcaacaagcggtacccacagaaggcacagatcctagacgtgtggtgcagaggagtagcttgagccgagaacgaggcgagaaagctggagaccgaggagaccgcctaaagcggagtgaccgggaaggggaccgtggggaccggcttgatcgtgcgcggacacctgctaccaagcggagcttcagcaaggaag

SEQ ID NO: 707729 - DNA, 297 bp, Homo sapiens
atcgagtcggtacctgcatactgggcgtatgctctgtaatagttgctgatccagccaatcccagcagcgtacttcaaccactcacagcagctgactgttgaaactgtattcaaataaggtaaacgccaagctgtaaccaacccggccgtttctgtacctcccttccgttttctgtgtgtagcttttcttttttgtctataaatttgctctgacaggacatccttggagtctctctcaatctgctgtgattctgggggcttcctgatttgcaaagtgtttctttttttttttttggag

SEQ ID NO: 707730 - DNA, 870 bp, Homo sapiens
ggaccaagccgtgggccctttcttgcttggcacacccggagcggagccgatctctggtttcacgtgatgtagggcaagcctagtgtgaggccccaggcctccgagcggccgagagagtatgctctagggcttcacgaagaggctcgccatcgtagtgtcgcatcgcgatagtggcaagaagaaggtctggttagaccccaagtgagaccaagtgaacatcgccatatgcctaagcgtcctcgtcagacagatccggaagctcatcaaacgatgggctagatcatcctgcaatgcctgtgacggtccattcccgggctcgactgtcggaacaaacaccttggccctgccggaacgggcacggcacatgggcatacgcgtaagcggaagggtacaggcaatgcccgaatgccagagaaggtcacatggatgaggagactgaggattttgctgccggcgtgctcagaagataccgtgaatcgtaagaagatcgatcgccgacatgtatcacagacctgtacctgcaaggtgaacggggaatgtgtgccaaaactaagcggattctcatggaacatatcgcagaagctgaacggcagacaacgggccgcaagaagctccatggctgaacaggctgagtgcccggaggtctaagaccaaggaagcacgcaagcgccgggaagagcgcctccaggccaagacggaggagcatcactcgagattttatccatggagggaagagaccaagaaattgagaactggcaattagtctgtgcatgacgtggcctctgtgattacatagatcaagccattaacataaacgaggcttaaaaagaaataagagagatcgggggttatattaaggggggggaaaag

SEQ ID NO: 707731 - DNA, 1209 bp, Homo sapiens
  misc_feature (169)..(173): n is a, c, g, or t
  misc_feature (178)..(178): n is a, c, g, or t
  misc_feature (319)..(319): n is a, c, g, or t
  misc_feature (518)..(518): n is a, c, g, or t
gaattttgctcttgttgccaggccggagtgcaatggtgcaatctcagctcactgcaacctccgcctcccgggttgaggcgattctcctgcctcggcctcccgagtagctgggattacaggcatgagccaccacgcctggctaattttgtatttctagtggagatgaggnnnnncatgntggtcaggctggtctcaaactcccgacctcaggtgatccacccacctcagcctcccaaagtggtgggattacaggcatgagccaccgtgccgagccttccttgaagttttttgtttggttttgatttgttttgttttgttntgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatnttgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttggggggtcaagtctctttggggtgtttggttttatgtatataaaaaatggattttggtgttccccttcccatgtaaagtaccactttatatgggaacttcccaatcataatgtaaagaaaaaatgaaagcctggtgttttgttcttccagatgcctcccttatggataaaatctccttggtaaaataaaatattgccttgtaaatcagtcttcccatccatattaattattaaatattaaagaaattttaaattcc

SEQ ID NO: 707732 - DNA, 868 bp, Homo sapiens
  misc_feature (177)..(177): n is a, c, g, or t
caggaccagcctggccaacatggcaaaaccctgtctctactaaaaagtaaaaaaaattagccgggcatggtggcttgtgcttgtagtcccacttcagtctaagtagctgggactacaggcacgtgccaccaggcccagctaatttttgtgttttgttagagatgaggttttgccatnttgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttggggggtcaagtctctttggggtgtttggttttatgtatataaaaaatggattttggtgttccccttcccatgtaaagtaccactttatatgggaacttcccaatcataatgtaaagaaaaaatgaaagcctggtgttttgttcttccagatgcctcccttatggataaaatctccttggtaaaataaaatattgccttgtaaatcagtcttcccatccatattaattattaaatattaaagaaattttaaattcc

SEQ ID NO: 707733 - DNA, 287 bp, Homo sapiens
ccaaaaaaaaaaaaaaaagggggggtggggggttggttttaaggggccccccccccaccaatttttttggttccccccaaattgggattccgggggtttattttaaaaccaaaaaagggcccccggtttttagccctggcctggataaaaaaaaatgccggttccccggaaggttatggggtttttccttttttgggaaatgggcttttatcctggaaaaggaaaccctagttttggtgcctttttttaccgggtttttggtgccaaaaaaaagcggctggaattta

SEQ ID NO: 707734 - DNA, 197 bp, Homo sapiens
ccccccttgggtttttgggggggggggggggggggttttaaaaaaagccgggtttccccaaaaaaaaattttaaaaacccccttctttttaaacaagggtggtgttgggccgggggcccgcccccccggggtggggccccctgggtttgcctttttgttttttggcccaaggaaaaataaactgtttttggggggta

SEQ ID NO: 707735 - DNA, 90 bp, Homo sapiens
agctagggaaaaaccctccagctccttattattttttgatcttccgttggatttttgtgaatattttaatacatctttttccatttttga

SEQ ID NO: 707736 - DNA, 194 bp, Homo sapiens
cttgacccaaatatgatggcagtttctacaactctctttagtcttgaggacttaactgttgaaagtatattcatatttagttcaccccttttgtaccccttatactccttctgacctataacaaattctgtctttactagaaatctttcagcattctaacgttcttcgttagctctctcacgacatcgtgatta

SEQ ID NO: 707737 - DNA, 507 bp, Homo sapiens
  misc_feature (1)..(1): n is a, c, g, or t
  misc_feature (11)..(11): n is a, c, g, or t
  misc_feature (261)..(261): n is a, c, g, or t
  misc_feature (340)..(340): n is a, c, g, or t
  misc_feature (407)..(407): n is a, c, g, or t
  misc_feature (421)..(421): n is a, c, g, or t
  misc_feature (436)..(436): n is a, c, g, or t
  misc_feature (442)..(444): n is a, c, g, or t
  misc_feature (478)..(478): n is a, c, g, or t
  misc_feature (493)..(493): n is a, c, g, or t
  misc_feature (504)..(504): n is a, c, g, or t
ntactcaatcnttggatcctgttcataagtaagaacatgtgataattttctgttcctatgttagttcacttaatagacctccagctccatccatgttgctgcaaaggacatgatcttgttctttttagtactccatggtgtatatgtgccacattttctttatctggtctaccactcatgggcatttggattgattccatcgaaagactcctatttggaggaccctctgtagaggcccgcttcatcaagtggccacgttgnccactctgacttttagttatcttggaaattggaagattaattgaagtcttagcagaacttagaactgtcatgccccagnggtgcctgagcttaagacttgttagcccttaagtttagccattttcttggcttaacattcattccgncaaattgtttaggntagggtaggattgtnacttgnnngggcaatccccaaagatacaaggaactgagattnggggaaaacgcttanccactgggtancaa

SEQ ID NO: 707738 - DNA, 368 bp, Homo sapiens
accgttaatatttcggagaatgcatcatattttcaagacacttcaaagtgaatctctactcccatctcctaatactacccagccaagaagtacaactatactactatcactagatataactataccaaatattacacctggtaagatactctggtattaaactatagactgagtgtatcagaaatagaaaaaacatgaagatttataaagcatttaaaaaataatcatatatagcacgtccttaaaagccccagatgaaaaaggcagtactccacttctaataacacctatggtttatgttgcgtaatattcattaacaaaacagcatactgaccaatgataatttataggaaattcatttgccaagt

SEQ ID NO: 707739 - DNA, 748 bp, Homo sapiens
  misc_feature (163)..(163): n is a, c, g, or t
gaatcgcgtttccggagagacctggctgctgtgtcccgcggttgcgctccgtagtgactccgcgggccttcggaagatgcaggcctggggtagtctcctttctggacgtgagaagagaagaagtggagaagccccctcttcccattagttgccttgtgcatgnggtttggcttgtggctacaacagcactggtgggttcctggtgggatcgtggggctatgtaaaaacaggcagcgtgtcgtccctggctgcagggcttgctcttcggcaagtctagccggcctgggtgcttaacccagctgtatcaggatccaaggaactgttggggtttcctagccgctacatctgttacttggtgcggggtaatgggaatgagatcctgctactatggaaaattcatgcctgtaggtttaaatgtgcaggtgaccaggttgtgctgatggcgccaaagttggagttcgtaatgttgatgacatctgattagcagaaagtcatgttccagctgtggactcattgaagggattacaaactctgcatcttccactaattcttcaactgtatttagagaaaataagtgcagcattttgtgatctggacattgtaacctaaaaaaaacaaaggacaccaaatttgggggaggggggggaaaactcaggttggtaccatttattacccttaaaagaggtggtgggagcttgtaacatggagcttaatggggaccttcatagagatgatccgggtaaagggg

SEQ ID NO: 707740 - DNA, 1397 bp, Homo sapiens
ggtcgttgtcgtgggtggggtgacggacgggtggttcgtgttgctctgttgtggtcgtgttgttggtcgtgtctgtgtttgtcgtgtgtgggttttgttgtcggttcgttcgtctgttgtctgtgctctggtttgtgtggtcgtcatgtgttattgtggtgtctgtggcagttgttttttgtgcagtttttgtttgcttttcaggtggttggtatggttgttactgttggctattcttttaagaagtttttgcttattgttttctgcggatgtggtgttcgtggctcccaggtgttgggccccgcgcgcgcctgtggtggggacgctggggtcttggggactgcttgtctgcgctttcctcgtgagggatgtttgccggaagttttctctgggggaaacctttttttggccccgtggtcccccgttggggcggggggagccttgctcttgtgctttctttggtggtgagatggtccatgttggggggtcaccttggggggtgtttctctgggtggttataatgggtgcctgtttttaaggggcccgccctgcgctctccctgttatggggtttatatggttggacgtgggaggcgttgcaaagtgttgtgtgctgaagggggttcccccctcttttgtacgccactgtctagtgatacttgggcgttcctgtgttgctgtaggtttggggattggggccccgggtccgtgcccccccctgtgtataggaggtctgggctttttcttgcgccacagtttcgcaaatcccccgtttgtagggctataaactctgttggggggacgcccaacattgtggggttatactgttgttaagaccactgtttgcaacgcgggaaaaggggaagaattgtttctgaatttcttataaattgtggaagagtttgtaatgtcctcacgggttcccccacgccccacgggttttgtcacttccacgcccctggaagagcacttgtatgggaaacacccctcgttcacgagccccgggctttgtaaagagtgttcccctggaaggcccccagaggagtttagaagggagaaaaggtggattcctcgggtataactcgttccacggattgctcccacggtgttgagatggtaattgctataaattttaaattctaacccacggaaaccccaaccccacaccttttataaatgttctttctattctccacttgtattttttttaaacctgcccccactgatagcaaagtcttttgctgaaatgagttttgatgagtttcttgtttatcgctttataaaaacggaaaagaacatataccccactcttgacttttgtgactttcgtgaaggtttctttaaagaatcgtccattcccttctgcttgctttttagttaatgttttactaccgggga

SEQ ID NO: 707741 - DNA, 1786 bp, Homo sapiens
caactaacaaaaacaaggtactctttataacccatttctagttcctaacctaattattcttcttaaatgcttgaatataaatgtgaaattgaacaaatttgaggttcttgcatcactcctatatctaaagtatctgtttcactagtgtatgttaataagagtgtgggaaaatggtgctttaataatcgtgaggttagatgctcatctgatgttcgcagctatgttatattaccaaccattttctcttttgtgattgaccaatgcccacacattgatgatttttaaatatttaaatatcattatgcttctttggtttttcaataattttaggaaatgattagctaaatctccatacttcttacgaattttatgaaatataagttaaaagagtaaagccggtactcaaaacttagcatgtttgcattaactgtcatttatctatatttatacctctgtatataaatacagaaataattacaaaaatgtaattgtaaaaatataaacatctgtatttatatatctgcgtctctatatatcggcagaggagagagaaatacaaagacagagagagagagaaagctatttggatacattttaatttctgataataaagttatatgtttagggatttacaataaccttacttattaggaataagcagtggcatcaataataaaagaactttgcatgtcttcagcttctacatttggatcaaaattttcttgacataatctatatctattttttaaggtgagaactggtgactcactttagtttcttttttccccaaaaattggatatttaaattgacaacctcaatctcttccagctttatggaaatacacaatctgtatatactcattcatatgcatagtgatatttgttgattaactcactagtcctcaattatagccattaatttccttgtgttgataataattctttcttgatatagcaccatgcttactgagatttttctgtaaaatatttcataaagcattatacttcgatacttacttttggaatattagatttgatagttacaaaaataaagatgaataacataacataataattattaattataataattattctcaaaatcgtttgttgtaaagggcatattgttaaaaatatcttcactcccctttcttcccttttactgtgggatgaatatattttcatgccctattaatgttaggcttaggtttgtgacttgtttgtgcaatggcatatgaacaaatgtgatatacaaatgtccaataaatgctaattattggcacttctcatgaggttctgatagatgcctgcagaataaaatgttttatataacagacattaattcattctcggtactaggataggaaaacacatcatgcaaaccttagcactctgttcagcctgaatctaaaccaagtcaacattaagagagttaaatagaatcatagccaacccaaagactcagtactgataaatatgtgtttactacaattcatgagatttgtgagttacttattactgcaccaaaggctggctaatacattatgtttagaaaagatatatatttgaggtgtcttttgttgtaaataataatcatatcaatataaacaactgctgttgcttagtcaacatggtttatttttttcacagacaaaacaatgaatacgaagtacttactgttggcatttattatgcgtctcttggtgtttttaggtttccttcatttatctcaagatggctgctgtagttctagatattgtgtcagcattcagtgcagaagaactgg

SEQ ID NO: 707742 - DNA, 392 bp, Homo sapiens
  misc_feature (21)..(21): n is a, c, g, or t
  misc_feature (23)..(23): n is a, c, g, or t
  misc_feature (49)..(50): n is a, c, g, or t
  misc_feature (53)..(53): n is a, c, g, or t
  misc_feature (83)..(83): n is a, c, g, or t
  misc_feature (85)..(85): n is a, c, g, or t
  misc_feature (87)..(87): n is a, c, g, or t
  misc_feature (115)..(115): n is a, c, g, or t
  misc_feature (123)..(123): n is a, c, g, or t
  misc_feature (143)..(144): n is a, c, g, or t
  misc_feature (148)..(148): n is a, c, g, or t
  misc_feature (182)..(182): n is a, c, g, or t
  misc_feature (184)..(184): n is a, c, g, or t
  misc_feature (198)..(198): n is a, c, g, or t
  misc_feature (237)..(237): n is a, c, g, or t
  misc_feature (282)..(282): n is a, c, g, or t
  misc_feature (286)..(286): n is a, c, g, or t
  misc_feature (303)..(303): n is a, c, g, or t
  misc_feature (347)..(347): n is a, c, g, or t
  misc_feature (365)..(365): n is a, c, g, or t
  misc_feature (370)..(370): n is a, c, g, or t
  misc_feature (378)..(378): n is a, c, g, or t
ggatttaatttctgatgttcncngaaaaggtgatatgtataacccagtnnccngttgggtcaactgttttctctctttcaccncncntgttagatagtgtctaataattgttccntaaaagcnttttgagaaactagtctcgnnttcngaattttctaatacttgcccagtacccaacaccngntaggtgtttgatcncgcggtgtattgaaattgaattaaattgtgaaggatacnaataagactcctgcatgtgctgtgttttaggaatattcaccccancacngtgctcacgcctattcnggagggtaggggtttggggcggtggggaggatcacttgaagccnggagttccagaccagccntggcnacatagcnagacaccatctgta

SEQ ID NO: 707743 - DNA, 845 bp, Homo sapiens
  misc_feature (272)..(272): n is a, c, g, or t
  misc_feature (280)..(280): n is a, c, g, or t
  misc_feature (304)..(304): n is a, c, g, or t
  misc_feature (340)..(340): n is a, c, g, or t
  misc_feature (346)..(346): n is a, c, g, or t
  misc_feature (360)..(360): n is a, c, g, or t
  misc_feature (389)..(389): n is a, c, g, or t
  misc_feature (393)..(393): n is a, c, g, or t
  misc_feature (426)..(426): n is a, c, g, or t
  misc_feature (431)..(431): n is a, c, g, or t
  misc_feature (433)..(434): n is a, c, g, or t
  misc_feature (442)..(442): n is a, c, g, or t
  misc_feature (451)..(451): n is a, c, g, or t
  misc_feature (461)..(462): n is a, c, g, or t
  misc_feature (465)..(465): n is a, c, g, or t
  misc_feature (467)..(467): n is a, c, g, or t
  misc_feature (486)..(486): n is a, c, g, or t
  misc_feature (494)..(495): n is a, c, g, or t
  misc_feature (526)..(526): n is a, c, g, or t
  misc_feature (534)..(534): n is a, c, g, or t
gagtggaccgggatggcgcattttcttgcaccaactaatgcggtgtcgctggcggtgaggagggcggagagttctgtggtgaaatagtgggaaggattcatgtaggcatcgggaagagcctaagtccacattataaaataggaagtgatgcggggtacagttactcccggaccggggcgtgaaagtcgtgatatcatcgttgaactattagctttgaagtttaaatccaatggagaagactcaagaaacagtccaaagaattcttctagaancctataantacttacttcagttaccaggtaancaagtgagaaccaaatttcacaggcatttaatcatnggctgnaagttccagagganaagctacagattcattatggcagtgaccngaantgttgcataatgccagtttactcatcgatgatntgganannaaactcanaatccgacngtggtttccnngtngnccacagcatctatggaatnccatctgnncatcaattctgcaaattacgtgtatttcctngggttggngaaagtcttaaccttgatcacccagatgcagtgaagctttttaccgccagctttttggaactccatcagggaccaggctagatatttactggagggatcattacacttgttccactgaagaagaatattaagtatggtgctgcagaaaacaggtggactgtgttggattagcagtacgtctcatgcaagttgttctctggattcccagaagattttaaaccggttacttatacacctgggctcctttttccaaatagggatgattatcgtaatctacactccaagagtttttttacaccacagttttcgta

SEQ ID NO: 707744 - DNA, 187 bp, Homo sapiens
agacgatgctagcgattcgactgcttagaggccttgagagacttttgggtttgggaaaaagactgtacatctgaaaaaaattcagtaccaataagattaactgaaacataggtatgtcgtaaacagataggaggaagtaggttatttcaagtaatatgagtgggagtagaacggctgttgtatgatt

SEQ ID NO: 707745 - DNA, 288 bp, Homo sapiens
  misc_feature (31)..(31): n is a, c, g, or t
gccccggggtcccccaaatttgggaaatccnccccccccccagggggggggggccccccgccccccaaaaaaacccggttttacccaaaaccccgggggtgggggcaaaaaccccgggggggggtttggggcccaatggaaacccggggttttttgtttttgttttgggggaagggggaggcccccccccccagggggttaaagggggtttttttttttgcccccccccggggggggggggaaaaggacccggggggggggggcccgggaaaaagggtttttttttta

SEQ ID NO: 707746 - DNA, 167 bp, Homo sapiens
atcgtaatctctactcatcagacaggctgaggcacggagaatcaccttaacactgaaggtggaggtgcagtgagccgagagcccgccactgcactccagacctgcgagacagtagcaagactccatcagcaaagaaagaaagacagaaagaaagaaagaaagaaata

SEQ ID NO: 707747 - DNA, 106 bp, Homo sapiens
gagaccccctgtgagaagtgcctagaaagcaagaggtgagccctctgtcatgcccacataagggtccgttgctccttggccaacgagtaatgcagtgctgggaagg

SEQ ID NO: 707748 - DNA, 352 bp, Homo sapiens
gcacgaggtaaccatgttgactatgggggagagacgatgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaccaataatctgatcttggacttttaagttttattgcacatgcagggcggacgtgggccaaataagtctacccacacgaaaaaagaaatttgccttgtccgtttgtgtacacccatgaaaaactgctcgttggctcacagaagttgtgacattaaaaaatacta

SEQ ID NO: 707749 - DNA, 364 bp, Homo sapiens
  misc_feature (29)..(31): n is a, c, g, or t
  misc_feature (35)..(37): n is a, c, g, or t
  misc_feature (39)..(39): n is a, c, g, or t
  misc_feature (41)..(42): n is a, c, g, or t
  misc_feature (44)..(45): n is a, c, g, or t
  misc_feature (48)..(48): n is a, c, g, or t
  misc_feature (50)..(50): n is a, c, g, or t
  misc_feature (87)..(87): n is a, c, g, or t
gcgagttgctgagaagcacaggtaaaacnnngtannncntnncnntgnantagggtgggaggcctgtctggcgggactcggcccttnggaatctaatgctatgtcccggtagatagcgtcaccattgaattagaagacacacatatgtgagaataatcattctggtcatttgctgcatgtcttattgaaaatatgtaaccacatcctttatcctgaccttatggcacctgggttgagaaccatgatttgaaccagacgttggtctgtcactttctcagtttgaaactttcttttgcctttagcgttttgctgttgctttttcgttgtcttttgtttcgtttcgttcctaagttacagagccagg

SEQ ID NO: 707750 - DNA, 202 bp, Homo sapiens
gatccggatcacctgtttgaaaccatctcccaaaccatgctgaatgctgtgggccgggatgcagtgtcaggcatgggagtcattgtccccatcatcgagaagggcaaaatcccccccagggccctgaagggccgaatgggctaaccctgttcccagagcccccttttttttctttttttgaaataaaaaagcctgtctttca

SEQ ID NO: 707751 - DNA, 446 bp, Homo sapiens
  misc_feature (134)..(134): n is a, c, g, or t
  misc_feature (441)..(441): n is a, c, g, or t
catctcgtgaccggcgattatcaccatgtacagtctgcgtttctgtttgtaagtttgataaattttaacttttttttttggagagggagtatggctttgtcacccagggtggagtacagtggtgcgatctcggntcactgcaacctactgcctcccaggttcaagcgatgctcccgtatcagcctggatgtgtgtattttatggtagtaaatcataaaagactagtatctacatatatttcatgcattcatgacatacctttttaattttttccatatttctaggctatgtaggttcatctgcaagttttttcaaattgtagcaaatctccaaaaaaatttacaagtgaactcgtgcagttcaaacctgtgctgtgcaagagtcaactgtatttgcttatttcctcaaaaaggaatgcctaaaggataatcgccggtcacngagat

SEQ ID NO: 707752 - DNA, 949 bp, Homo sapiens
  misc_feature (136)..(136): n is a, c, g, or t
  misc_feature (597)..(597): n is a, c, g, or t
  misc_feature (647)..(647): n is a, c, g, or t
agcggatcctgcagcctccgggccggccggcgagccagtgcgcgtgcgcgggggaggtctccgcaagcgaccggtggagcggaactgaccggacgggcagggactagtcgatgccaggacgagtggtgaggcagcngaggcgcaggccgaggcctgcgagcgactatgggggtaccgggaagcaagactgcgtgcatgcggagcgcggtttggaccgaggcacggcggaggcgcatacggatcgatcatggctcgtccggcatatgaagggctgcgtgacagcagcttgaagtgaatcctcgtcttccatatgcaatgatcgatacatctccgtctctgatggcctacacacgaatgttggttgtgtgccagtggcgatcttcactggcatggtcattcagcatcgattgagccatgcatagacacgcatggttgcatggcaaacggaagaagaccatgtgcgagaaaacgtttattgcttaaccgggaagcaagacttgcagcaagggaagtctggacgtacagactttgcatgtgatcgtcctggtcattctgcgttgagcagaggttcctggaatactaaggagactgtgagantgaagtttccaagttattgaggacgcacagggttggtcttgactcctgcnagaattcgacaggggtggagtatacttacctctggctatcgttgatgcatgaggggtccgctatcgtggcgggaccgaaggaaacatagcgagtcggttggatcggaaaggccttcgttgcaagcatggtccctaccgagagggaaaggaccttgttcgagaattccaaggctaaacagaagcctaggaattgccaatagaccgatggcattccccaatcgcgtgcttggggaccctgggccccttcaatagggttcgtcccgatggttcctaacttatgttgacagagtcacacgaaaatg

SEQ ID NO: 707753 - DNA, 231 bp, Homo sapiens
gtggggcagaggggagtgacgtgcctgggccaagatactcagcacccatctggagattgcatgaagtgccaagacgtgctgctgagccagtgtcatggtaaagaagccggattccagtgccagctggagccaggagtaacccacttcccaggactgcctgaggaccaatgtgcaggaagcaaccaacaccacacccagcatagtcggcatctagggagctgtgaagccaca

SEQ ID NO: 707754 - DNA, 335 bp, Homo sapiens
gagtaaccagactggtatacggtcacagcatatacagagaaaagataggagcataaatacaaaactaaggcaaaatagacgcttagctgcagatctacagagaacttctggtacattaaaagatttcaattcatagcaaacaggtgtattaaactattgcagtagctggaacttaaaagtgtaaccagcatatataggagaagtgaatacacaaggaaataaagatagagtaaaagccaagatgatgctcctcacgaactggagagccagtttatcttacgtctgcctccagaatatgcctctactgtgagaagggcagtacagtcagatcatgt

SEQ ID NO: 707755 - DNA, 724 bp, Homo sapiens
tggaaagtgaaaggatggtttttacccctaaaggaaaaaaaacttttttaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacgggggggggcgctaccaatatactacaaccgcccggaggagagcaccaaacaactcatacaccaccccccacgttctgtatacgaaaaaacaaacggcgagcaccacacgcaaacggagtcatacataataataaataaagcgcgagaccgcgcgcggagcataacacaaacacgtccggacgaagagaagaacacaacaaatacatgctcgaagagagaaactaaatacgaaacagacaaacacccactcccacctctgctctagggggagcggacaacccacacatgatggagcgccagaccacacaccacccccaccaaaaagcacgtagcaaaaacagcacgccagcgcaacgcaaaaacaaaaacccacacaagtacccaaacgtaccgtcaaccagatcagcgactcacaacacaaccaagacaaaaagacctagtaacacaaacaccaccaacacaacacaacaacaccaccaaaccacatcgcacaacaactcatcaaagacgccaacaataaatacacaccacagccagagcccgcacaactgcaccaaacacacgagggt

SEQ ID NO: 707756 - DNA, 380 bp, Homo sapiens
caatttaaaggcaatgctaccaaatactaattgagtgtatgtaaacttctgacccactgggaatgtgatgaaagaaataaaagctgaaataaatcattctctctgatattattctgacatttcacattcttacaataaagtggtgatcccaactgaactaagacaggaattgtgaaaaactgagtttaaatgtttttggcaaaggtgtatgtaaacttccgacttcatctgtatctacaactcatgctttactttctaacacgatgtgcgtaggtcaactcaacccactataggatatgaatcagccaccctaacaagacatccccaaccacaaactctttatatgagtgggctaagaatggatagaatttcgtcgacgc

SEQ ID NO: 707757 - DNA, 425 bp, Homo sapiens
ggccacgctgcagagcctggggcggtggcagcagcgtcgtcataggtaatattggggccctggatgggcgccacccacaagtatctcgatagtggggggggtggggggtagccagcagctcccagaacctctttttcctttttggcctaaatcttccaggtaggaactagaaccttgcccttttttttttttttttttttttttgagatgggttctcactatattgtccaggctagggggcagtggctattcacagatgcgaacatagtacactgcagcctccaactcctagcctcaagtgatcctcctgtctcaacctcccaagtaggattacaagcatgcgccgacgatgcccagaatccagaactttgtttttcactctccccaacaacctagatgtgaaaacagaataaacttccccccga

SEQ ID NO: 707758 - DNA, 1528 bp, Homo sapiens
  misc_feature (1312)..(1312): n is a, c, g, or t
  misc_feature (1346)..(1346): n is a, c, g, or t
gttccagatcgcttggtgacgtgaatgcttcgtccaggacacgcatgggatgccagtgtgtggcagtcgacttccgatgcgatgttgcctggtcgtggaccctatggagttgaaggcccgtcaatgcgttcgagtagatcgtagcggtacacttcacttgaatggacgcattgactgctgagataagtatccctccttgcgctgtccataatgcggtcctgcgtagccttcttcgtgcttcgcgtactacccagggaatgtgtgtcttttaagacattgatccctagcactacgcagtacagaacgaagtaatagctagtccatcgtaggctctcgtagcacatagattgctcagtcgtccggttgcatctacgccggcgatcgcacgcagtgactcgtagaggccgagccgcacatggtatcttctccgtcaggaggcgtctctcggcggacttcgttccccctgcagtttgtgtaggggcgaccttggcattgagcacttgaactagccgccgtgcatgtttggcctggccgagttgctagcggggcttggtgcttcgtgtcgcaaaatggaacgggcgacatggcagagggtacacccatggtggattgcatcacgcacgcgcgcgcttatccacccgatggtagagtctcttccagtctagactgttccgaagtggggaagttctattcgccgaaaccatagtccatcggattcggcaatttgaggaccgcctgtgagtttttggagggcccagagggcctgtgaaaagaaataggccaaagaaacccattcgttgttgtcggggccctgcaagcccatggactttgaggccgcctttcccatttcccacagtttgcatcccgatgtaggcgctgtcgcttctccgccattcttaccccttgttggctttgtggttccgttaccgcatggtgccgagtcgttgccgttctaccccatttctgaggcgttcggttatcctccttgttccaagaccggtcgggaaggcaagggccgacactggttttccgtgtgccgaacgggctgaccttttccaccttcgggaaaggggaggttgagaccctgtgaacccttcgtccaaaatgtgaacgctttcttatggcccaaagccaaatggacagcggttcgcgaaaggccccaaacttggttgggccaagcgtggaacagaagacgctgaactcaatgagttttccgacaccaagttcaatctttttgccggggccattggggccccctcatgggggcgcccctgttcaagggagcaggtttgtttcctcaacttctccagtncggtttgcgcacggttacccacgttgtgcggaangccctcgcccagagagctgaaagtgcccgtccgggggggaatccccataacccgagaatatttccccctgggagagccaattttcttttactccccctttgtacggtgggcgcctcttcccggaaaaggtccgcccaaaaagtggcgtccttttatccctttttacctttctttatcccggg

SEQ ID NO: 707759 - DNA, 301 bp, Homo sapiens
cctcgcgcaggtatactccagagctgtgactggtgccacatgcattctagcctggatgacaaagcaagacgctgtaccaaaattaaaacgttaaacaactgagataaatacttgaaatattacaattattacaatagttgttttccccactggaaacaaaagttgagcagagcggtgtcttaagcactccagaaaaaactctaactctagttgaaggctaagtgactcttctcaaacagcaagcccttcaccttttaactttcctatagcacttacttttggaaaatcaaggagtaagcac

SEQ ID NO: 707760 - DNA, 514 bp, Homo sapiens
  misc_feature (5)..(5): n is a, c, g, or t
  misc_feature (80)..(80): n is a, c, g, or t
  misc_feature (86)..(86): n is a, c, g, or t
  misc_feature (135)..(135): n is a, c, g, or t
  misc_feature (169)..(169): n is a, c, g, or t
  misc_feature (183)..(183): n is a, c, g, or t
  misc_feature (290)..(290): n is a, c, g, or t
  misc_feature (344)..(344): n is a, c, g, or t
  misc_feature (346)..(346): n is a, c, g, or t
  misc_feature (399)..(399): n is a, c, g, or t
  misc_feature (431)..(431): n is a, c, g, or t
gaggnggaagaccacggggatctgggccagggggggggggggctccggcaggcccgggagccacgtagccatcggcgccngggcangagcacccgccagtgcacagggcgaagacagggccttccgccacggcanggaggtcaaacgcggagggggcccagccactccncacatactccaggnccagcggcatcgggtagaagaggttccactcctccggcgtctcttccactttccctctcctccgggggcagcaagtcagcgcggaggagggggtaaaacacacacgnggggcggagcacagggagaaggggcccgcaacaaagacaggccgggcgggaggntngcgggccagggcggcctgctgatcgggactctggattcctacgatgtggggcngggggggatctgctgcacctgttgagtctttnggcaaaggaacctggtagatggtgaccctggcactaaggtcaggctccatgtgccgcagcaaaacatggccagctccacaggg

SEQ ID NO: 707761 - DNA, 491 bp, Homo sapiens
gaagcatcctaacaggacacatacagactatgaggtcccgttccagccaatggaaaccggacacagcagtagggtggacgcatcaggttacaaactaaccctgtctcttagttcggtgtactctcgtggcaaaactgctggcgaatgtaccctttctgcgggaagtaaaactggccttgcagagtaaattcacatttctgttcaagtgctcatttcttcacggccacggggccacacagcatttcaacacacttgcattagagcttatgtcaactcagcacttctttcacaccaggcgtggtcagctcacacctataatcccagtacttagagcagccccaggatccagcctaggcaccatcagtgagcactccatctctgcaaaaaaaatataatttccatccaacaccattcattcaatcacaaaccgctttcacacaattcataccaggcgtagtggcacacacctgtagttccagccactagggagg

SEQ ID NO: 707762 - DNA, 598 bp, Homo sapiens
attttcccatctttcttttcagtccttgcgcaccgggggaacaaggtcgtgaaaaaagaaggtctagcgtgaggtgccgtgcattctcatctgtcctcattctctgcgcctttcgcagagcttccagcagcggtatgttggtgcccacgacgcatccggaggttcacaatctctgtggtccgtaggagccactagtgaggagggccctgggaaccaatttgccattttgcatgtggaaaacaagtggtcgttactagctaagatgtgtcgtacttcggatctgtatttgctacaaccttccttgtagtaaagacgaccaaatctgcgttaagaacgataagggatgttgcatgttcctccattcaacagatatgaagagcattttaagaggtgcagcctctggaagtggatcaaagtagaactcagtattgccatactagatatgttggtcaatagaattatgacgtgaatgataggaaggtaaaagatagaattaggctctctggaaagattattccagaataccaggtcttatagtggaatagcagatcggaaaagaatcaggaagtagagatgagtggaaatgctttggtaatga

SEQ ID NO: 707763 - DNA, 689 bp, Homo sapiens
gagttacacagtgatactatgctcttaccattattacgatagtaacaacgcgtccagcttagaccgttcttgacttggaaagaccttgcgtgtgaagagatccttcgcatcatgttgcttcagtttaacctatttctaaagtgactactacatgcagaatatgtacaaactactcggactgaaaagtacaaagacgtatactcctacaagatgtatcgaataccttttcctaaacatcaagatacccgcctcaaaacactttaataacaagatttggtctacttaggcgtccggcttgacagctaaacacttttagtaccacacaaagttaacatcatgttacatacgtcgttacagtgcacgttaccccaatctgtgaaaatcaaccaccatgaaactcatgcagcattacttagctcttgtctttagtgcctcaggtatcacagcatcacttagtagacagaaatcttatcttccccttaaagtagttgtcatgccatacagactttttaatattcccaaaaattaagaaaaacatccttggaaaatatattatcagaggaattgtatcgtactgaacaggtaagtcatccctcagcctgagattagtctacttcttccatgcgtgatgtgtcgtcatctccttcaacgggtggcatttcttcagttacagcagcactggtatcatc

SEQ ID NO: 707764 - DNA, 1142 bp, Homo sapiens
  misc_feature (842)..(842): n is a, c, g, or t
agcgtgggttccgtgtcgtgctgctgcatggcgtccggcttagacgctttggctccggtgtgttccggacgccgtgacggacggagacggtggcgtcgtctcctgtgcgtgcgtgctggaggtcagataacgacggaccctgtgccgagcctgtgggactagcttcccgtgtcgcttcgcctgacgttggtggactctgtgtgaccacggatacttcgcacagtgaagaccaagtactagtaaagtgtagattgcacccaaagttacatgaggcacagtgtaagaaaggcaagcttgatttgtctatgaaccttatacacaatatcagagctattgactgctatcggcattaaaacactaaacaattttgcttagctaaaaggggttcccgagtagcgaccattgagaaatccattttgtaagcatcgtggaaactcatatattggggcaaaacgggtttcaattgcgcaccactaatcttgtgtcctgaaaacaattgttatttcctttgcggcatactttgcacttaccctgaaagggtaggccaatttaaatgcagttatgaacctgtgcatctattaacacttgtcgcaatggctatgtgagcaagcccaaggaatacagaacagggaagaagccttattgcgtttgttcacaccacatagacttttattgggtggtggcaaggttccacatacgtataatctgtgtgtaccccgtgggtaacccgtcgttaaccattgtttgcgcaagacttttcgacggggccgcacgcctttgaccctttgcgtgctccttttttgcgcccttggtgccctattactttttgtcgaaaaactagnttccttcaggtaaccgtaaacgggtgggagccggctttgacacacgagaatgtagccgaattaagacatacggctggtgcagccaatatttggctttcacgcgtaattgtaaacgcatgtccaggcgggaaaaaacctccgaagaaaactttaacaaccccaaaagataactttttgaatttcggctcaaatgtattgtgtacacagatgacaaagggcgctaatatttgtcatacaacttcttgcgacacacgagcgccctatggtgtaatttactaccccacatacacaattatctac

SEQ ID NO: 707765 - DNA, 129 bp, Homo sapiens
cacgctgaacaggtgcgcgaagtggtggtgcagccgtgggcagtcggtgtcgttcctgccggacgacattcatcagtcatccacgtcaccggcgatgagccgaccctgcatttccacctgtacggccag

SEQ ID NO: 707766 - DNA, 214 bp, Homo sapiens
aaaagatacatgaataaaaccttattacatccaccctcctctccctaggaggcctgcccccgataagcggctgatgcccacatgggcacttatcgaagacttcacaacacacaatagcctcatcatccccaacatcatagccaccatcaccctcattaacctctaattctacctacgcctattttacaccaaccccggtgccgatgaatagcga

SEQ ID NO: 707767 - DNA, 191 bp, Homo sapiens
gtctccagtcgcaacctggctggtcccccgtctcccgggcaggtctccatattgatgccgaacttatgtgcggacaccccatcggcattgcgcactactagccgcacaactcctgggctcattgtcgatcctcccatctcagcttcccataatgctgacattacaggcgtggtactcccgactgtagcgaa

SEQ ID NO: 707768 - DNA, 207 bp, Homo sapiens
catgggagggggcagctgtgccatcagaggcggctatggaagcagagccggaggcagctatggctatggaggcgccgggagtggattaggacacggtggtggagacggcattggcttaggtcggggtggtggagccggccttgctggtggctttgggggcctggtttccctgtgtgccccctggaggcatccaagaggcagtgtcaa

SEQ ID NO: 707769 - DNA, 716 bp, Homo sapiens
  misc_feature (297)..(297): n is a, c, g, or t
  misc_feature (687)..(687): n is a, c, g, or t
tggaggcaagggagccagcccctcttacatggatgcgccaggctaagagaccttgccagggaacctcccccttatatcggtccagccctcgtgagcctatttctatcattagaccagcatggaaaagccctccctccataatccatcatctcccatcaggtccctcccccacccatgggattatgggagctacaagatgatattggttatcttcacatttcaaaaccaatcatgccttcccaacaatcccccaaaggctcaactcatttcagcattaacccaaaagtccaagtccanagtctcatctgagacaaggcaagtcccttctgcctacaaacctgtaaaatcaaaagcaagctagttatttcctagatacaatgggggtacaggcattgggtaaatatagctattccaaatgggagaaattggccaaaacaaaggtgctacaggccccatgaaagtccaaaatccagcagggtagtcaaatcttaaagttccaaaatgatctcctttgactccatgtcttacgtctgggtcacactcacgccagaggtgggttcccatggtcttgggcagccctgccgctatagctttgcagggtacagcctccctcatggctgctttcacaggcagttgtggagtgtcctgagtcttttccaggcctacagtgcaggctgtcagtggatntaccactctggctctggagcacggtggcc

SEQ ID NO: 707770 - DNA, 749 bp, Homo sapiens
ctcatcgacgagggcagccacatggtgatgctggaatgccctgagacggtcaacacgctgctccacgaattcctgctctgggagcccgagccctcgcccaaggctctaccggagccactgccgtgcgcctccagaatgacaacgaatgtagccgctgggccggcggggcatcgcttgcgtgagcacagccgcagacagtgaggaggcccgagcctgcagcgcagaccagctgggcgggccgttcgctccggtgggtcggggccagtgtcagggagacgcccccaggctgcctgggctggggccgtggcatccgaggtgagcccatgcggacattccgctctccgctttccgtcccgcggggcccatcggccgtatctggggccgcaagccgggacccttcacggcaagatgaccttgtacacgaacgctcttccctcacctttccctccgcaaatcgctcgcggagccgagggcatggccccgaaagcgccggtgatcattccagttgtcgagcccgttgccttgaagtcctgggtagacccgacggaagacccgaactgggggaaccgcgtcgaggccaccaatccggattatcacggaggaacccctttgcctacgcctccgagtacccctcgggcggctggcggacgccactcttcctggccgacaagggagagcgctgaaattgggcatgcgctgtgcggcacaccgcacaccctgcgccttgtctccacctgggtactccacat

SEQ ID NO: 707771 - DNA, 797 bp, Homo sapiens
  misc_feature (138)..(138): n is a, c, g, or t
  misc_feature (170)..(170): n is a, c, g, or t
  misc_feature (272)..(272): n is a, c, g, or t
  misc_feature (300)..(300): n is a, c, g, or t
  misc_feature (458)..(458): n is a, c, g, or t
  misc_feature (742)..(742): n is a, c, g, or t
ctcttaacggctgatgcagggcaagaaacctaggtggtcctgtctgttattgactagctgtgagatgttgcacaggcctgttttattatctgtgacccacagttgtacggaagggttctggtttacatgtgagggtcntgtaaaaaagaaatttgaacatttcacagttngtttacagtttttcaggagcacatttgtttctctagagtaggtcctctttgcagtccactttgagaagctgatgaaagctatggattctcattgtccagacnttacacatacatgaacaatttacaaacnaatccaaggaatatgcactgatctttaagtccacccattgcccgggcgagatagagctttctttcctctgttgcttctttcttccttatggcccatagtggacagcagaactggaaatgggattcacgattctgatgtggacaccgtgttaataaaantaagaccactagaactattgtttaaagatacacgtggaaaataaaaaagtatgtctttcaaagggcttaagtctttttacacaaattaatgttttttcttgtaagtttttccagggtcgttgggtaagcaatagttactcctattccccagagaggagaaactgagccacagttaggctgcttggtaggatcagtggagtagtcaaactgctgttgcaggaactctaccccagtttgtcctttcatttagcaactatctggagcttcctctttgtgacaggcanacaggtagcatggcttagcagtgaaatgcaaactaataccccacatcatacaggc

SEQ ID NO: 707772 - DNA, 476 bp, Homo sapiens
ccatcgcccggcagatcggcaacgccgtccccatcccattgggcgccgccatcgcacggcaagtcctcgcgcagttctgagggcgatcccgagcgtcggctccgtcgatgcatcccaggattcccaatacgttgaacccggcgaccccacccatcgccggaattctttcggcattttctcctgtgttctcagcagcaggtcctaagcgagccttcaaccattccggttatggttcgcctgagcacgagatcagacgaccgggaggcggacacgcagatggcacgtggtgggaggggattccaaggcacagtgctcaaggcgctgcgggcacctgagcacaagctcacgatcaccgcagtgcgggagttggcgccctacacggagctgactgtccactgtccgagcctgctgggcaccggcgccgccatgctgccgcccaccgcctgggtgcgcatgtggatcccgcagggcggccg

SEQ ID NO: 707773 - DNA, 207 bp, Homo sapiens
gctcgaccgttccagcaggcgcgggcgattatcgcgccttgccgccgttcgtgaccaccgtcggcctgttcgtcaatgccagccgttgcgagctgggggaaatcctcgacgcggtgccgctggacctgttgcagttccatggcgatgaagcccgcgagcagtgcgaaggttatcaccgtccctatatcaaggccttgcgggtcaagg

SEQ ID NO: 707774 - DNA, 294 bp, Homo sapiens
cacgaaaaaaagatcaatggcacaggtaggaagagaaaagggagggtgtgccacagaagggctgacataaatccaagattatgaaaggagttatgtggtgttgaggaaacaaagtagcctgactaatctctgtctatccttaatttattgcacggttacaagcaacatttgcttgcaagtttagtcaccaggtcctgcaaatttggagcttatctatgttggggaggcttggggtacccggaggctcggaaatttcgtaaatcactgggtcataagctggttttcccttgttgt

SEQ ID NO: 707775 - DNA, 272 bp, Homo sapiens
gcgtcatgatcatctttactccagcagccataaaatgaatcatgtttctctcttgatttttgcccagaagaggcagttatgattccatgtttcttctttaagtgtttttaattgggctcaattaaggatcacaatccatattttgaagacaatatttcttcacgttgcagacacaatctgttctacattaggaggttgagaaaggcggagaaagccaaaccaaatggattcttttagctttaggatcttgtctgcttatgatattgacagag

SEQ ID NO: 707776 - DNA, 134 bp, Homo sapiens
ctatcggttcatgctggcgtacatcctatgcaggaactgcaaccattaggatatactggccaatttgttgtgcatttccataccactggccccactgcgcataaggttggggatatccaatttgattctgctgc

SEQ ID NO: 707777 - DNA, 981 bp, Homo sapiens
  misc_feature (387)..(387): n is a, c, g, or t
  misc_feature (389)..(390): n is a, c, g, or t
  misc_feature (393)..(393): n is a, c, g, or t
  misc_feature (395)..(395): n is a, c, g, or t
  misc_feature (420)..(420): n is a, c, g, or t
  misc_feature (676)..(677): n is a, c, g, or t
  misc_feature (679)..(679): n is a, c, g, or t
  misc_feature (682)..(682): n is a, c, g, or t
  misc_feature (709)..(709): n is a, c, g, or t
  misc_feature (717)..(718): n is a, c, g, or t
  misc_feature (744)..(744): n is a, c, g, or t
  misc_feature (749)..(749): n is a, c, g, or t
  misc_feature (758)..(758): n is a, c, g, or t
  misc_feature (769)..(769): n is a, c, g, or t
  misc_feature (785)..(785): n is a, c, g, or t
  misc_feature (793)..(793): n is a, c, g, or t
  misc_feature (860)..(860): n is a, c, g, or t
  misc_feature (867)..(867): n is a, c, g, or t
  misc_feature (873)..(873): n is a, c, g, or t
  misc_feature (895)..(896): n is a, c, g, or t
  misc_feature (921)..(921): n is a, c, g, or t
  misc_feature (925)..(925): n is a, c, g, or t
tccctggccgggagggctcagaagagaagtagggcatggcatcgtcctctgctgaccacctgcactcggctccccgtgcgctgcaggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgtatcctncnnccncnctccccgccgcccgctccccctctnccccgcgcgccccctccgtgccgccgccgccgtccgcctcctttactccccacccatgcccagcggacggcccggagcagtgtgagctagtgcagagcaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctnntnttntcgtccacgcctctcgccgcctctgancaccctgnnccaccccacctccactcccacctcanccggnctcttcgcntttgccacctnctgccccacactcccnccttaganctcgtcctcctacactgaaggactgagctggccaggcctgagaatctggtctgcgcttgggatgggngtccaancgggancgcagtgtttggcaccaatcannctcactcgaatgtcaatgtcccaancttntgcctctggctccccagtggatggaaggagcaaagcatgtgcaaacagctctgtgc

SEQ ID NO: 707778 - DNA, 578 bp, Homo sapiens
tctaaggatcccaagaggtaggaccggggctggggaagaggggacatcctggatccccgggcataaacggaggccgggggccgccgtcacggaagaggagcacaagcggtacgacgacatcgacttggacatagaggagttggccaaggatgtgggggcgcagatcctccggcacagccacaagaaagacatcctcatgcaccgatggcggtacccgtctctgtccctccagggcatcgaaggcgccttctcggggtcgggggccaagaccgtgattcccaggaggggggtgggcaagttctccatcaggctcgtgccgaacatgactcctgaagtcgtcggcgagcaggtcacaagctacctaactaagaagttggctgaactacgcagccccaatgagttcagggggtacatgggccaggggggaaagcccggggtctcggacttcagtcaccctcataaccgggcggggagaagagccatgaagacagttttggcggttgagccagacttgaccagggaaggcggcagattcccgtgaccttgacctttcaggagggcacgggcaagaacgtcat

SEQ ID NO: 707779 - DNA, 192 bp, Homo sapiens
cagaagtacttttacttcgtgtaagatttcacttcttttttaatactcgggttcggtaacctacatatacattaatacatgggagggtggggggataaagaagatagtctcttcctccttagggtcaaaaaggggcatgtaacttaaatggataagggtgagacggcactaaagtcaggggtaccgagctcg

SEQ ID NO: 707780 - DNA, 908 bp, Homo sapiens
tagttctagatcgcgagcggcgccctttttttttttggtttttccataactaaagtctttcacccagaagccggctctgttggcacttggctgccgactttgcaaacttttgggcagggggggagactgagtctcattctgtcacccaggctgggatgtgcagtgggcccgatctcagcttactggcaacctctggccctccagggttctgggcaattccgcctcagtctcctgagtagctggggattacaggcatgcgccaccacacccgggtaaattttggtattttaagtagaagaccaggtttcatcatgttggggcaggagtggtcttgaacccctgtgacctcaggtgatctgcccatcttcggcctctcaaagtgcgtgggattacaagtgtgagccatcgcgcccggcctgcaaactttttggtaggtatttcgggtaaacaaatccttaggttactcttggcgggtggtgggggttgggcttaagtcatgattccaaagtagaaatagctaggcattatttttggaaatatatgaccctatagtgtagtcaagaatccactgaacagagggaagcaaacctttgggaaacgggctttggggcagacggtaaacgtccagttggatgctggaagctttgaaacagctccatcaggtaggtactcctcacatctgatgagttggtcctttcagcctaagggggtcggacgggacgtcgcggacaatagcaaatacgctgtgttgactggcaacgtggtgtggcgacaaaggcgagttcccaacaaaaggataggtccggccgttgtttcatggctggaagcgcctggaaagtgctccccttcctttccgcctctggtacttgctgggccacagggccttactccaggctgaatgtgccgtg

SEQ ID NO: 707781 - DNA, 127 bp, Homo sapiens
tgatggctggtatcgatgacttctacacctcagcccggggctagcaactgccaccctggggcaacttcgccaaggccacctttcgatgccatttctaaggcctcacgctacctgacccccgacctct

SEQ ID NO: 707782 - DNA, 630 bp, Homo sapiens
  misc_feature (140)..(140): n is a, c, g, or t
tgtcagacccaggcagctctcgatctaagaaagcaggccgtgtgctcgtctcactgcgtgatggacgccagctctctgtcttggcaagatacacttaacagatgtttctacctcacatgaatgagatttgctaaacagcnctgcgcagtgggaggaggaggtatattatttcccacagtatctcctgggccttctggaatgaccatgttatcctgtggcggtgggtgtgtcattgcgcccgccgtcttccaaagccttacatccccaagctgccagccaggaggtgataaccacccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggcccgggtgttgtgcccccagccccgaccatctgttttgggaaatgccccaagggggggttaacccatgggcaaaaaaaacaaaagaatcccaaaggggtcctttgggaaagggtggtttttcttgatttgagttttcccaaatgaa

SEQ ID NO: 707783 - DNA, 202 bp, Homo sapiens
actccctccccgtactcatcatactctttcaccacagcacaagtcctacctccatcgctaaccccactaaaacactcaccaagacctcaacccaaaacaggcataattaacactttacttccatctctttcttcattcccccgtcatcctggagaaaagtgtgctgccagtaaaggtggcgccccactcactccttcaccca

SEQ ID NO: 707784 - DNA, 115 bp, Homo sapiens
  misc_feature (31)..(31): n is a, c, g, or t
gttggcacacctcgtcaagtgtttgttattngttcttaaggaagaggggcgcgagagagcaagcctatttttaaggctaagttgctgtgctttgcatggggcgctcttgctttat

SEQ ID NO: 707785 - DNA, 1067 bp, Homo sapiens
agcgggctgagtctgcttgccgagccagcggctggtggaggggcagctgcagacctctgcgtgcccgggcgggcgcggcgcgggagtcctgggcctgctggcggtgcaacgcctctgcccgacctgctgctggtgtgaatggcttggctgctgcttgccctgtgcctggagccagtggggcagtgtctgccgcaaagtgtgacttgtgggagaccttgcgggccgccctgggtacgcgcctcccggatcggctcggcctcggctcggactggaggggaggacggagtgagcaggccgagctgcattccgcgctggatgcttgcgagggagcgcaggagtggaagctgcgccagccggggtcctcggatctgggcccatgtgacggaatttttaaagtttggacacaagagcaatgaaaaaaagcaaaatcttgtcagaagcactggatgaccgctggccacttgaacatcatgaattagagcagtctctggtgaacaggctctccagcccggcagcatccttagcgaggacgagttctatgatgcgctgtcagataccgagtccgaaaggtccctgagtagattggaacgccgtgacaagcagcgctccttttgcacgagcgacgggcggagcatttggggcaggacgaacaagcaccaggaatgtccgaacgaagagcagacttgtggtggcgcgcgaatgctctcgtccaagtgcgaatcaaggacaccacaggaagcgaggtttgccttctcctactgggttagcccaggacgagttgcacttcaggttagtcttggcagccattggatccgagagaacaatggctaattgggacagtggggacgctactacccagagaatcgaccgcactgccaagggtagtacttctaacatgcggccgtccttgagggtttcccctaggaggcggcccttaacgcttgcacatacacattggcgtgcgcgaacaacgttacaccgtcgaagtcacacgaacgggcgcctcgggtgccacggtcttcgtgcactccgtttgtgggacagactgcgaaattcagaggtgcgca

SEQ ID NO: 707786 - DNA, 150 bp, Homo sapiens
acttctccggtgcatcctgtcatttcttcaaagaggtggggtgacacttcaccattccatatgaacatgtacccctcaggaaggccagccaccagctccagcagctcaaggtcaaacactaatacggcacggcggggcacttctccaccc

SEQ ID NO: 707787 - DNA, 343 bp, Homo sapiens
tttttttacccccctaaaaccacttttttttccccgggggaaaatttttttttttcccaaaaacccttttttatccggcccccgggttgttccggggggtggacatttaccccttttttccattttttgttttaaaccccgaaagttttttttttaaggggggggaaaaagcccaattccttccccttgggggggcccttgtgttttttcctttacccccttggccccctttttaaaaaggcccccccggttttttggtttttttaattttaaattttttttttttgggggggggggggtattttttggggggggtagggcttttttaaaatccccttttcca

SEQ ID NO: 707788 - DNA, 680 bp, Homo sapiens
cgaggcacgcaagtaagcgcccctgtcctggggcctctcctcgtaactccatgcttgccacaggttgtctgaagaagccagaaaatagttttccaagaacctgggcagcgccgtttgtcatgcacatgaagaggtaagagaagaatgggatctaggcagccctcggtcagcagacctgtgatccgcgtggtgctcggagccatttgcaattccggtctgtcgggtgctcggggatgcctggtgacgggcccggttcccggtggctcgcccccacctgcgggcgtcgggaaggatccctgtccagtctgctcagccgcagaggaggccctggcagcgccccggctgtagccatgcaaccccgaggagtcccgggcaccttcaccccaccgggaggggccacaaggacctgggcctcggccaccaagctttgtcccctctcgctgtggggggactagtgattctcctccgacctgacgattgcttggttttttcaaaagggagttttgtgcggtgagaagtgtgattctgtgtggctaactctgggctagcgtgccgtggccactgaaggcgtggcctcgcgtgtgctgcactcgtaagtaacgctagtattgactgctagtcagtcaggggaacgcctgcctgtgtcagtcgtaagcgcacaggttggattgttctataca

SEQ ID NO: 707789 - DNA, 338 bp, Homo sapiens
tcgagaccagcctgcccaacatggcgaaaccccgtctctactaaaaatacaaaaaattagccaggtgtggtggtgggcgcctgtaatcccagcactttgggaggctgagcatggagaatcacttgaactcgggaggcagagtttgcagtgagccgagattgtgccattgcactgggcaacaagaacgaaactccatctcaaaacaaaacaatgaacgtgtaatgctagaaaatgtttaacttagcagtattcagtgtatatgtatgggtgaacgagctggggactcaggcaggtcccacctcagtagcccctcctggctctccttctggggcccagcc

SEQ ID NO: 707790 - DNA, 130 bp, Homo sapiens
ggcatggtgagaatgtcacgcgtccacataagacctgctggatctggttacgcaggactcaagttctgtttgtcgatctttcttgatggcatagcgctgtcgtgctgtcacgggtgccgcaccagagtat

SEQ ID NO: 707791 - DNA, 1732 bp, Homo sapiens
  misc_feature (1732)..(1732): n is a, c, g, or t
ggcaggcccctactagaggccagccccgagccagccccagcacccagcccccgcgtggctgaacgaggctgcccccctcagccctgtcgagcgagcggggccgcccgcgcgcacccatggccagccgcatgggctactccacgcgccacagctcccccgctccccccaacagaacgcacacaagctaccagtacccacgctcccctttcctgcacaggacagcagccaaggcaacgcaagcagcagcaccctcgcctgacacagccccccctgcccgcctcacacccccctagcatcgcctgctacccggcagccgcacccccctgcgcgcatcctgacccagccgcctcccccgcgccgcccacccggtcctgcctgccttccctgcttccctctgctgctactcctgcccaccactcgcccccctcatccagcctcttcagtcctccctctcgccccctctcagcacgcggctcccctctctcctcccgcttgcaccccacgccccccggctgcttagccccccgggccccccttgcccccccacccttgctgctcgccctcccagggccccgccgccgcgctccccccccaccgcccgtggcccccgcctctgcgcccctcccttcctactgctatcccgctcctcgccctcttcctgggctcgtcccaccgaccacttggctcctccctccctccccccccattcgccctccgccgcggcccctccgcacgtcttcttggccccctctcgcccccctctccctccccgctccccctgccccccgccctctcccctgtcccccccctcccggccccctgcccccccctccctctccctcccctgcacccccctcccacccctctccccccttgccccgccgcccctcccctgcccctggctctctcacccccccccccctccctctctccctgccccctccctcgccctggactcccccccccccgccgctccccaccgccccccctccacagcagatccactcatacccccatcgaaccggcgcgaccgccgcaagtgaaactcatcgccgggccgcgacttcgcaccctggccgcggcgcctctccccacgcacccatgccatctcccgcatctccctcctcctcccccctctcagcaccttccgtagtcctcttctcgtcgctccgccccccatgccgcgcacctcagcggccaccaccgccccgcctccagacattcgcacccaccctaccacgacctcctctccccacccaccgctccctccgctccttctggcggctccacacgacactcggcccccgcacacacccccacccgccccgcttccgccccccccacctccctcgcccacccaaccccaccacccccccgcacaccccccagccactcacacaccgctccccctcccacccccacgaccccactccaaccgcacgcctcgccccccccactgccccagcccccacccccacccttctccctccgccccctcacctccctcccctcccccccctcccccccctcacccctctccccccctctccccccacccactccacccctcacatctccatcaccccgttcccccccgccctctctccctcaccacccctctccctcctctccccccctgccaccacaccctcaacactccactccaccctccccccacaccacccaccccacacacccaccccccaccccgaccccccatcccccccccccn

SEQ ID NO: 707792 - DNA, 800 bp, Homo sapiens
  misc_feature (3)..(3): n is a, c, g, or t
  misc_feature (87)..(87): n is a, c, g, or t
  misc_feature (92)..(92): n is a, c, g, or t
  misc_feature (94)..(94): n is a, c, g, or t
  misc_feature (105)..(105): n is a, c, g, or t
  misc_feature (114)..(114): n is a, c, g, or t
  misc_feature (118)..(118): n is a, c, g, or t
  misc_feature (122)..(123): n is a, c, g, or t
  misc_feature (125)..(125): n is a, c, g, or t
  misc_feature (129)..(130): n is a, c, g, or t
  misc_feature (134)..(134): n is a, c, g, or t
  misc_feature (140)..(140): n is a, c, g, or t
  misc_feature (142)..(142): n is a, c, g, or t
  misc_feature (159)..(160): n is a, c, g, or t
  misc_feature (166)..(166): n is a, c, g, or t
  misc_feature (169)..(169): n is a, c, g, or t
  misc_feature (173)..(173): n is a, c, g, or t
  misc_feature (185)..(185): n is a, c, g, or t
  misc_feature (189)..(189): n is a, c, g, or t
  misc_feature (205)..(205): n is a, c, g, or t
  misc_feature (246)..(246): n is a, c, g, or t
  misc_feature (274)..(275): n is a, c, g, or t
  misc_feature (685)..(685): n is a, c, g, or t
  misc_feature (773)..(773): n is a, c, g, or t
agnagagaaaagtggaggttgtctttttcgatggcaaatcggacccttgcgggctgagggggagagagctacgtcacgcacggaggnggggngntcccggggggntgtgggtcngggngganngnctgnncggnttgcgngngctcctgctggtggggnnccaganatnctgncaaagtgtctgngcgngcgcgagtgtgggggncgacgggcccactctggccacacggcggccggggggcaggnggggccctgcgtcccataggctgcctgnnggtgggtagggcggcctgcggcatagtggggtggctgtgggctcccagcctggcccctgggaaccgtgggggcgcagggacaagcacatggctatgggatgcagggtgacgccaagggcaagcgagtggcggggatctctactgtgaccatgcagaattgatcgcagtctgctgcgccaccaccacctcatgttcccgaggggaacagctgggctggcgactggcatccaggccgtaactgcaaatctatgctaggcggggtctcccttctgtgtgttcaagtgttctcgacttggattcttaactattttaaaaaatgcactgagtttgggttaaaaccaaccaccaaaatggatttcaacacagctctaaagccaagggcgtggccggctctcccaacacagcgactnctggaggccaggtgcccatgggcctacatcccctctcagcactgaacagtgagttgatttttctttttacaataaaaaaagctgagtnatattgcataggagtgccagaaactgc

SEQ ID NO: 707793 - DNA, 377 bp, Homo sapiens
cgcaggtttctctttttctgtagcagctaaacaagcactagcctcaagataagcagcattgaaacaaccgcagctcctccccctgccgaccctggccccacacccctgctccaccagccgtaactagagctttccttggacaagagactcgtttcagtaacttttccctgataagagaccctgaccatagacgggttctggctggtttacagagattgcaccctcatgtgccttcatgtcctgaaagtactttttgaggtataccacctaattgtaatacgcttacatgctgccttcaccccaaggtgaacatgggtcatatgtaacatgcatgtttatccagcacacgtgtccgaataaacatgcatgtatattcg

SEQ ID NO: 707794 - DNA, 1210 bp, Homo sapiens
  misc_feature (205)..(205): n is a, c, g, or t
caacctccgcctccagggcttaaactattctcttgcttcagcctcccgagcagctgggactacaggcatgcgctaccacgcacagctaatttttgcatttttagtcaagacggggtttcaccattttggccaggctgatttcgaactcctgacctcgtgatctgccctcctagggctcccaacgtctgggattataggcgtgccnccgcgcccggcctctcatttcttaattgtagacattgcgtacttccggagaaggtccctgagaacctggctgatcttccccgctgcacccctcacgtggtcctgttagctcccaaactgtcaacctgaaaggaaacccagaggcaggctctccaggacaagtgagttaatctgggaatcgcagggggttgcagcctaggctgttcgtgccatgacagatcataggcctatctgagagggccgggcgaaggggaaaatacagatgagctcacaaaagttgttttgtaacaaaaaccactggctgtgggcgcttgctgcaggagtgggcgttagcttgttgttggagagagccttaccaggccgacgtccttgtgcaagctgcttatctagaatactgcagtcctgaggaatttccctgcagtaagtccggttacaggcaaacgtgcaggacgtgcaggagcgtcttgtgaggaggcctgctgcaggtattcctgcatgagagctcccccttcgtggcctcccgactccatttgtttagggattggtggaagtagttccattttggtacctgcaactttcacagctgtcgtgatgaaatcaggcttagctcttcatgattgagtacctgctgttcactgctacagtataaaaccatgccacaattcctgtacaatctttttttttcttttgagttaataattacctaatattttcacatatctagctttttactaacccatggccagcctttttttcaagtaccccaacgtttttgccacatgcctaacgataccgttttccaaaggctcaaacacatccgttgtgtctaactgattctcctgttccgacctagaccgatcacttcctgacccggctgcacagctcttatctcgagcttttctctgctctcatccttgagactcactttgtctgtctcctttcttggattccctgtgtaaacgaaaaataaaatcctaagctctctaaaaaaaaaaaggcggccgct

SEQ ID NO: 707795 - DNA, 308 bp, Homo sapiens
cccagccccaggcgcggtggctgacgtatgtaacccctagcactttgggaggcccaaggtgggaggaatcgcttgaagccttgggagttgtagacccaacccaccctgggcaacatagtgagaccttgtctctgcaaaaaataaagtattatctgggtgtgatggtgcacacctgtggtcccggctacttaggaggctgagttgggaggatcacgggagaccgggagattgaggctgcggagagctgagattgcgcctctgcactcccagcctgagtgacccagtgagatcctctcttaaaaaaaaaa

SEQ ID NO: 707796 - DNA, 524 bp, Homo sapiens
gaatcggctaacgaagtcagaggaggcaagtacaagtagtgcaaagtgagaaagatctttgtgggccaaaaggaatcccacatctggtgactcaagatagcccgcaccatctgctaccccaatcccctcatcaaggtgaatagataccattcagattgatttagagactggcaagattactgatatacatcaagtacgacactagtaacctgtagtataggtagactggaggtgctaacctaggaagaataaggtgtagatacaccaacagaaagaggcaccctggatctattgacgtgctacacgtagaaaaatagccaatagcaacagctaagccaatacgaaaataaccaacatatatgtataataggcaagggccaacaaaccatggaatattctctaaccccgaggaaagggtaatccgcctcaccatatgctgaagagagagacaaaagacaggcggccaaacagagcagtgcgtgaacagggtaccctaggtaacatagtccgatcatagtaccgta

SEQ ID NO: 707797 - DNA, 422 bp, Homo sapiens
cggtccatgaaatactgaggatgcgtatttctccatgcacattattaactgcactaaccacaattatctagctgattgctaggatagggctctaaacatatggaggcaacaggttctcacgaatagtgtccggggcattatttaatcagtgttagttctgacaggtgaacaacctgagttggtctctgcagatagtacctatgaaacattaaggtcagattgattcagctacctggtgtgtaagataatgcccaatttatagtttcctttatattttttctggtacttctacaaatataaccctgagcatagaaataccctcattattttaatgggacatcctatttctaccatgcaatttgagcttgatctgagacatttctgtgaagtgtgaaagtacagttaatcattcttaaatgttc

SEQ ID NO: 707798 - DNA, 866 bp, Homo sapiens
  misc_feature (24)..(24): n is a, c, g, or t
  misc_feature (26)..(26): n is a, c, g, or t
  misc_feature (31)..(31): n is a, c, g, or t
aattcctgatagtctgtctctagngnatccntcataggtcgcagggggttgcagcctaggctgttcgtgccatgacagatcataggcctatctgagagggccgggcgaaggggaaaatacagatgagctcacaaaagttgttttgtaacaaaaaccactggctgtgggcgcttgctgcaggagtgggcgttagcttgttgttggagagagccttaccaggccgacgtccttgtgcaagctgcttatctagaatactgcagtcctgaggaatttccctgcagtaagtccggttacaggcaaacgtgcaggacgtgcaggagcgtcttgtgaggaggcctgctgcaggtattcctgcatgagagctcccccttcgtggcctcccgactccatttgtttagggattggtggaagtagttccattttggtacctgcaactttcacagctgtcgtgatgaaatcaggcttagctcttcatgattgagtacctgctgttcactgctacagtataaaaccatgccacaattcctgtacaatctttttttttcttttgagttaataattacctaatattttcacatatctagctttttactaacccatggccagcctttttttcaagtaccccaacgtttttgccacatgcctaacgataccgttttccaaaggctcaaacacatccgttgtgtctaactgattctcctgttccgacctagaccgatcacttcctgacccggctgcacagctcttatctcgagcttttctctgctctcatccttgagactcactttgtctgtctcctttcttggattccctgtgtaaacgaaaaataaaatcctaagctctctaaaaaaaaaaaggcggccgct

SEQ ID NO: 707799 - DNA, 865 bp, Homo sapiens
  misc_feature (694)..(694): n is a, c, g, or t
  misc_feature (738)..(738): n is a, c, g, or t
  misc_feature (740)..(741): n is a, c, g, or t
  misc_feature (745)..(745): n is a, c, g, or t
  misc_feature (748)..(748): n is a, c, g, or t
  misc_feature (756)..(756): n is a, c, g, or t
  misc_feature (758)..(758): n is a, c, g, or t
  misc_feature (761)..(761): n is a, c, g, or t
  misc_feature (766)..(767): n is a, c, g, or t
  misc_feature (772)..(772): n is a, c, g, or t
  misc_feature (776)..(777): n is a, c, g, or t
  misc_feature (780)..(780): n is a, c, g, or t
  misc_feature (785)..(785): n is a, c, g, or t
  misc_feature (787)..(788): n is a, c, g, or t
  misc_feature (803)..(803): n is a, c, g, or t
  misc_feature (809)..(809): n is a, c, g, or t
  misc_feature (815)..(815): n is a, c, g, or t
  misc_feature (822)..(822): n is a, c, g, or t
  misc_feature (825)..(825): n is a, c, g, or t
  misc_feature (834)..(834): n is a, c, g, or t
gaaaacgcaggcaaacctgaggtcctcagaatggcgggcacaggttggtggctggagaggttgtggtggatgcgctgccgtattttgatcaaggttatgaagcccctggtgtgcgggaagcggctgcagcgctggtggagtgaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaatcacaggtggatctaaattgagagaaatggggtcaaattgggtatccctggtcagtaagaattatgagattgacggactatgttcagctagaaaatgaatctatcacattaagccgcacctgggagggaacaagaaaaatcgggagacttntgaaagaacacttgcggtgaagaaagtggggttccaaagggttnanntttntgnatgtgggnanagntttcnncatgngttnnttngaaanannggggggggggacatnttctcncaaagngcggggnttncaaaaattncagagggatatgtaaaacggcttaatgaata

SEQ ID NO: 707800 - DNA, 105 bp, Homo sapiens
gcggccgcctactactactactgctcgaattcaagcttctaacgatgtacggggacatgagtttcccaattaaaaaaaaaatgacttcttgtccagtggaaaaaa

SEQ ID NO: 707801 - DNA, 492 bp, Homo sapiens
  misc_feature (11)..(11): n is a, c, g, or t
  misc_feature (392)..(392): n is a, c, g, or t
cctgaagctgnctagatcacatacaaaaggcctctctctttttccttaaatatgctggggctcctagagtcatttatgactggaggctatccatcatacttcaaacattcaggtttactcacgtcatccatcatacaatggaaagtcaaattccctgaattgctatgtgtctgggattcatccatccgacattgaagttaacttactgaagaatgtttaaagaattgaaaaagaggaacatttcgactctgctcttacaaaggactgggctttctatctatctctactccagctggagcaacccccaacttatttacataaattttccttccaggcctcaaattaattttatttaaccccatataatcagcgggattaaaaatttaacaagnacctctctgtttaaagaatcccccatttaattggttaattccaaatttgcttgcttgcctcctaatattgataagcttatacaatttcacttttttaaca

SEQ ID NO: 707802 - DNA, 114 bp, Homo sapiens
ataatatctgccgagtggacattattcccgcgtcatcctgctgcctttgttcttatagactcaatgtacagactacccacaacctttattctctgagtcatcctgcctgcgtgc

SEQ ID NO: 707803 - DNA, 794 bp, Homo sapiens
  misc_feature (623)..(623): n is a, c, g, or t
  misc_feature (667)..(667): n is a, c, g, or t
  misc_feature (669)..(670): n is a, c, g, or t
  misc_feature (674)..(674): n is a, c, g, or t
  misc_feature (677)..(677): n is a, c, g, or t
  misc_feature (685)..(685): n is a, c, g, or t
  misc_feature (687)..(687): n is a, c, g, or t
  misc_feature (690)..(690): n is a, c, g, or t
  misc_feature (695)..(696): n is a, c, g, or t
  misc_feature (701)..(701): n is a, c, g, or t
  misc_feature (705)..(706): n is a, c, g, or t
  misc_feature (709)..(709): n is a, c, g, or t
  misc_feature (714)..(714): n is a, c, g, or t
  misc_feature (716)..(717): n is a, c, g, or t
  misc_feature (732)..(732): n is a, c, g, or t
  misc_feature (738)..(738): n is a, c, g, or t
  misc_feature (744)..(744): n is a, c, g, or t
  misc_feature (751)..(751): n is a, c, g, or t
  misc_feature (754)..(754): n is a, c, g, or t
  misc_feature (763)..(763): n is a, c, g, or t
gaaaacgcaggcaaacctgaggtcctcagaatggcgggcacaggttggtggctggagaggttgtggtggatgcgctgccgtattttgatcaaggttatgaagcccctggtgtgcgggaagcggctgcagcgctggtggagtgaggaaactcgcagataccgacctactaagaactacctgagctacctgacagccccggattattctgcctttgaaatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaatcacaggtggatctaaattgagagaaatggggtcaaattgggtatccctggtcagtaagaattatgagattgacggactatgttcagctagaaaatgaatctatcacattaagccgcacctgggagggaacaagaaaaatcgggagacttntgaaagaacacttgcggtgaagaaagtggggttccaaagggttnanntttntgnatgtgggnanagntttcnncatgngttnnttngaaanannggggggggggacatnttctcncaaagngcggggnttncaaaaattncagagggatatgtaaaacggcttaatgaata

SEQ ID NO: 707804 - DNA, 388 bp, Homo sapiens
  misc_feature (3)..(3): n is a, c, g, or t
  misc_feature (34)..(34): n is a, c, g, or t
  misc_feature (65)..(65): n is a, c, g, or t
  misc_feature (134)..(134): n is a, c, g, or t
  misc_feature (166)..(166): n is a, c, g, or t
  misc_feature (180)..(180): n is a, c, g, or t
  misc_feature (194)..(194): n is a, c, g, or t
  misc_feature (303)..(303): n is a, c, g, or t
  misc_feature (306)..(306): n is a, c, g, or t
  misc_feature (316)..(316): n is a, c, g, or t
  misc_feature (381)..(381): n is a, c, g, or t
aanatgccatttccagttccaggtccaggttttnccccgtcaaataagttatgtaaaactttagncctttagaactttgtggattttaggattttgttcaaggggcctaggcacggtggcctcaaacctgtaanccccagtgctttgggaggccaaggcaggaggntcagttgagccccnggattcaagatcancctgggaagcaaaatgagactccgtttctacaaaaataaaaatgaaatcagccgggtagggtggcacatgcctgtcatcccagttacttgggaggctgaggtgagaggntcncttgagcccnggaggtcaaggctgcagtaaactatgattgtgccactgcaattcagcctaggcaactgagtgagnccctgtc

SEQ ID NO: 707805 - DNA, 363 bp, Homo sapiens
  misc_feature (338)..(338): n is a, c, g, or t
caggcatgcactaccatatcagctagcttttttttattttttgtagagatagggtctgttatgttacccaggttggtctcaaactcctggccttaagcgatcctcccatcttagcctgccaaagctgtgggattacaggagtgagccacagcactcagccagccagtaaatatttattgagcacttataatatgccagattctatactaggcactggggaatatactagtgagcaaaacaaaattgtcctgcactttcctagcttacagtctaatggaggaaaccgctcaaatacatgcacccactcagcaaacatctttttaatatctacttgtatnagcactcttctcaggacaggaaata

SEQ ID NO: 707806 - DNA, 526 bp, Homo sapiens
tgaggaccccgatagtgaataggtaggttcttccctctcaatgtattctatattgagccaatatggcaagggaaacagcaccctatttatagataaagctaccttcaaagagataaaataactgttagttctaaggcctgagaaagttctactaaccagccctgcaaaggatacatcacatgctaaaaaagacaatgaaggagcactagaatgtcacacaaacacttcagtttaagaagtaattgccttccacccaagctgccactccacggctaagtaaagagccaaggccttgcaagtgacactttcaacaaagctttcctgattttcttggtttcatttccaatttttcaaaattcttgttgttcatcagaaacatttaacatcctcactgtagaaaattaggaaaatatacagttttataaagagtaagaaagaagactgagttcctggaactttgggaaaaattatttggttaccctggcagatcaggggtaacctggaccacctacctatttcacaatcg

SEQ ID NO: 707807 - DNA, 175 bp, Homo sapiens
tgatctagaggaccccccgcgcaagcagtttctgtcatctgcctttttctggagtacgggtcatgtttcctgtttgtttgttttttgttttgtatgtttgtttgttttgttttgcttgtgtgttttttcatgtcctataattgtaggaaactggacattttaggtaatgtattgt

SEQ ID NO: 707808 - DNA, 1051 bp, Homo sapiens
  misc_feature (559)..(559): n is a, c, g, or t
agcggagagagcctcggctaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtgaagttgctgtgaacattgttaaaatgccaataaaggatttaggaattacagaaacctggttgataaagcagtgccagggtgtgagagagttgacttcaattttgaaataagttccactggctgggtgtggtggctcacacctgcaatcccagtactttaggaggccgagactggtagatcatttgaggtcaggagttcaagaccagccttgccaacatggtgaaaccccacctctaccaaattagccaggtgtggtgcacacctgtagtcccagctacttgggaagctgaggcaggagaatctcttgaaccagggaggaggaggttgcagtaagccgagatggcgcccctgcactccagcctgggtgacagagtgagaccttgcgtntaaaacaacaaaacaacacagggagacacggcaaaaaaaagttctcactggggggtaacaatgctatcatgctatcaaacaggttcacatgctacagagaagtccttgcggacaggatgtctccgtggtggcaaaacttcatggggctcttaaagaaatttgccccaaggtattacgtatctttcaagcagcagcaacccttgatgagttcagtagccatcgttacagttggggttagaaccctccaaccaggaaaacggattggttgagcatttttttaggccaggacagtgtcattttatccaacttatatcataatgcgctattggacccctttcttattagaccatcggctttaggtgttaacccataattttatgcccggtggaaacccaccaatttctgaagagtcggttgataggaaggtcctggaaaatgagccgccacggtttccgaggctaccgggcgtttaagagttcccgtatttatacc

SEQ ID NO: 707809 - DNA, 523 bp, Homo sapiens
  misc_feature (24)..(24): n is a, c, g, or t
  misc_feature (97)..(97): n is a, c, g, or t
  misc_feature (189)..(189): n is a, c, g, or t
  misc_feature (235)..(235): n is a, c, g, or t
  misc_feature (271)..(271): n is a, c, g, or t
  misc_feature (304)..(304): n is a, c, g, or t
  misc_feature (315)..(315): n is a, c, g, or t
  misc_feature (397)..(397): n is a, c, g, or t
  misc_feature (443)..(443): n is a, c, g, or t
  misc_feature (456)..(456): n is a, c, g, or t
  misc_feature (509)..(509): n is a, c, g, or t
ggattgagaaatagtttgaaaganaaaggtgggacacagggggccatcgccattgtggaggctgtgaaggccctgagctctgggagcccatgctatntattggcagtccaacaaagaaacatgtggtgagaatgtggaggtcaaaaggatatgttgcattaagcacatgatttacagctgtgatggttnagcgtttatatggaacatgttttgctacttgagataatgggagtangagcctaggaaggctagaagcaaggagccagcaagntagacacattccaagaggacattatgtcagatntgcaatccctncctcagtttctcccaacactcagctttttcctaacatgccccccttctcttttttgtaaaatgagaaaggtattattactanctatcattagcaaggtgattggcaggcttgtgcaaccctttaattnccggttggtgatncagcttcatttttcttagcccttatttcaaaccggagtcactctggggttgangtggcttcccacat

SEQ ID NO: 707810 - DNA, 1683 bp, Homo sapiens
  misc_feature (1683)..(1683): n is a, c, g, or t
gtatgtgtggtgccgctgcagccgactgagataggaaagacgctcatagatacccagcatgtatgctccgacactagtctagccactatacctatctagtatataggactgcagccccaataatcatgtgaaaattgctagtacctagtggagagtgagtacactacaaaaggaacagacattcacattggcgaaacaagtacgatatcgatgcgtcaatagagaccgcctacattaccacgagtacatcggtgacacgtgacgcaccatgtccaaacagtagcatagagctccaagaaagacgagacgcctccgcaagattcatactataacgccatatgcccatgaggactggtagggaccacaaattaggctcgtgtgcacatcttcggcgatatgcagtcccaaatcaacgtaagtaactttccaatagaatcacaaattcagcaactcaagcgtaacaaaaccacaatgatcgtagctcgaatgcacatagtaaatagacgtagagtacatactaatggatcaacgctttagttccatgcaatttaacctttaacaattactcccataaatatgccgaggaagagacactatcagaataggcataaaaacagccggtcacatatacctataagagccattgagataagtccaaacacaagcaaaccacacatccacaacacgtaatatatatagcaataactaacacaacacgtaggcacatcacgccgctattgcactggaattgtaatgctacccgggcaacattcacaaaacagcaacacaatagttcaatgaaaagggtacacttatctgcagtaacatcgaccacaatcatagtgggactaacagaaatccacaccaattggggacatcacacttattacactatcatctaattataactctacaactcttcgtatatgcactaacaactaataaaacttaaaaagatgaatatcaaataccaccaaatattcaatgaaaaaaaccttacaaaatatttattgatctattcccttttcgaaacatataaaaccatttcactcaacatgtacttccatcttaaccaaatacaacacctatacaacgtacaacaaaactacatatacactatacctaaacaatgtacagttgccttgtagtgcccataacttggtaatctacaagttacatcgggaatagtacaaatctaacacgtacatatacccctacgtacaatctggatcccgtgctgtgctttagaacgaacaactggcacgtcaaaagaaacgaaaataataattacaccacctgtcgaaaacatgaccaaaatcacaaagatgatttcgagaaaacgtaattctacctatgcaatatgcatagttgtgtagattatcctaacaactaatataactcaagaaaacctaaaaaaagaacaccagaaccacactgataagatactataaaatataactataatacacacaaactacaacatcaaaaaaacataatactacagtaactaacaaacataatacatacaataactacaacttacaaataatatacattctatacacaaacaaatctcctaatcaaaacacataaagacccaaaacaacacacaatataccaactaaccatattatcctcaatatcataaatcataaaactaacatttacatctaatataaacan

SEQ ID NO: 707811 - DNA, 658 bp, Homo sapiens
ggaggagaatcgcttgaacctgggaggcacaggttgcagtgagccgagatcacgccactgcactccagcctgggtgacagagcaagacctggtctaaaaaaaaaaaacacacacacaaaaaacaacaaccaaaaaacaaacaacgccaggcgtggtgggtcgtgcctgcaatattagcacttggggaggccgaggtgggtggataacctgaggtcaggagttcgagaccagtctgaccaatatggtgaaaccccatctctactaaaaatacaaaaattagccggatgtggtggcatccaactgtactcccagctactcgggaggctgagacaggagaattgcttgaacccaggaggtgggatggttgcagtgagccaagatcgggccactgcactctagcctggggtgacagaatgagactctgtctcaaaaattacaacaagacacgaaagaaaagaatcaaagacaactggggacattagactgctttatattcctccaatgtgtctgggacagcactcatgggccagatctagcctgaagcctctttgtttttttcaactttcgggtcaaaacgggggggtccaccattgggcacaagggtcaacaaacggggacgagacaaacacaaggcgagcaagggagaagagaggacaga

SEQ ID NO: 707812 - DNA, 674 bp, Homo sapiens
  misc_feature (410)..(410): n is a, c, g, or t
  misc_feature (437)..(437): n is a, c, g, or t
  misc_feature (555)..(555): n is a, c, g, or t
  misc_feature (589)..(589): n is a, c, g, or t
  misc_feature (621)..(621): n is a, c, g, or t
tttttcacttttaaaccagtctttaattttcaattcaggtgtgaggcacatatatacacacaaacatattaatttaaggaagcaagaatgtagaatattaacatgtatggcagacactacttcatgtattttgtttaaaacttaactttgaaataacttcattgtttacatgtaaaagaaaaatatcattcacttatacttccacttccctttaaagtattctcaaattatatttcctgaaactccaatagaaagcattctctcttaatcatggcaacgggtcgggtactcattggtgaccaaaatctggtgacaccatcttttatgttctttgccatattcttaaatgcctggcaaacagtagatatttaccagatgaatatgacattaaaaaaataaatttccaaganattgagattctttagcccaagtttgangggactacatccattttgaaagcactcctagaaagggggaatgttgattaaattgttgactgccatgccctggggcttggctgctcctaagttattagagctgtgttttaagcgtttnggaaatagaaaaaccaatgccccctaaggaaaanaaaggcacctaaggggaaaccatgggttgccnagtgcactgccaaaatgacccaatggcccctacttcccaaattttcccccttc

SEQ ID NO: 707813 - DNA, 340 bp, Homo sapiens
  misc_feature (197)..(197): n is a, c, g, or t
  misc_feature (216)..(216): n is a, c, g, or t
  misc_feature (253)..(253): n is a, c, g, or t
gtgggaactagagcttggttgtctggcatagagtgggactcctaaagtctgtaacatgaagtggcaaattggtgtcactgcaattacagacccctacgaaaggcacgcggaatggcaggaatgtggggtgtgctggctatgtctgacactgttggaaatacatcagcagcttaaaacttcaaaatctcaactcaatncatgttaaaagaagtgcgntgtctctgtaaccatttggtagtatctcctatctctnaaagaggaataattcaatatattcagagtccaggactattgggttggggggaaggagtgtggcatttgaaaggttaggatgggggaa

SEQ ID NO: 707814 - DNA, 342 bp, Homo sapiens
  misc_feature (35)..(35): n is a, c, g, or t
  misc_feature (39)..(39): n is a, c, g, or t
  misc_feature (50)..(50): n is a, c, g, or t
  misc_feature (156)..(156): n is a, c, g, or t
cacttttcagattagggatgttcaagttgtagtantttnggtgctggctntagcattatataaagaataacaagataaatgttgcagtaggctagaggttcttcactcggagcttatgaaaagacttagagttttctgaaccccctgaagtagtangcaaattttagtgtgtatataaacacacacagacatacatatttgtatcctctttttgaattgaacttactgctcctgtctaactgaaactttgtaccctctgaacaggatcttcctgttacatacccacccccactccattccgcctacgtttggtaaccaccgttctactctaactaccattct

SEQ ID NO: 707815 - DNA, 636 bp, Homo sapiens
aaaggaagggggtgtttttaacaaccaaaaaattttaaccgcctaacaatgcccataagttaaaaattaattttccctttggggtaacaaaaattgttgttttacatggaaaaaaaaacatttccaatttgttaatccttattcacattggggatcccgcaataaaacacaatttgtttttttcttttcacaaaaaaaaaaaaaaggggggaaattgggctttgtcaagaggccctccaagaaaaagtttttttttccaaatagattttttttgacagattttgaataaatagacctttttgctttgtaatttgcaaagatttggcaagaccacaggttaaaatgcccccagtttcacttaaaacccctggaaacttggcggggaaattaaaaaataaagggcaagactttgccttgaaaaatccctaataaattttggggggaaggggaaaagaaaccaaaaggcggtgccattcgtaggagaacccccttggaagagcttgggaaaatcaggttccatttcgggtaccgagggacctttaacaaccggggtagaagaaaatttggaaagagtaacttggaaatagggaagccccaccctgggctttcttgttaaagggggggctaacctccaaa

SEQ ID NO: 707816 - DNA, 101 bp, Homo sapiens
atccacgtgctctggactccttgctgcctgtttgtagactgatgctgcctgttggacctctgcctcagtcgctgtgtcgatgcaccaggcacagctccagg

SEQ ID NO: 707817 - DNA, 152 bp, Homo sapiens
tggactatataatttttattatttaaagtatgggggtctcagtatgttgcccatgctggtcttgaacacctggcctcctgcaatcctgcctcagcctcccaagtagctggattctaggcatgagtcatcacacctagctagaaaatttttga

SEQ ID NO: 707818 - DNA, 222 bp, Homo sapiens
  misc_feature (60)..(60): n is a, c, g, or t
  misc_feature (148)..(148): n is a, c, g, or t
tcaaatatcactgtcctacttagaggactcaacatactggtcccagccctatactccctntaaatatttaccacgacacaatggggctcactcaccaccacattaacaccataaacccctcattcacacgagaaaacacctcagggtnaaaacactatcccccattttcctcctatccctcaaccccgacatcattaccgggttttcctcttaaaaaaaaaa

SEQ ID NO: 707819 - DNA, 658 bp, Homo sapiens
cctgagggtatgggaaatgctggcgcgcgcggcgcggggcactggggcccattttgcatgagtgggctctctactggcttctggccgcgctccgcgccgcgcctcctctggattgccccgaacacaccgtggtactgttcgtgccgcagcacggaggcctgagtggtggagcgactgggccgattccaccggcatcctggagcctggtttcgaacatcctcatccctgctgttcacaccggatccgcatactgtgcagacgtctcacggacaatatgtcatacaacgctgcctgcagcagtcggctagtgactctacgaaaaatagtcaactactagacaaatacgactaggagtacctatataaccatagcgcatacatagagaccctataacaaaggcaagactaacagcgtagtaggacggcaccctagagatatagccagtaaacaccacagctaagactacacaacaaccacatgacgatacagagcctcgcgcaaaaactactactgctagagcaccacaacgtcttaccgagagacaacggaagtcaccaagacatgccaagccataagtacggatgccaatacaaaacaacgactcgctagactagaaaggaggtataccgcatgcctccgcaaatagaccatcaacgca

SEQ ID NO: 707820 - DNA, 193 bp, Homo sapiens
ggcggggggggtataatttttccccggggcaggttttccctttttggccttttaaaaatttttttttgtgcctttttgggggccccccccggttaccgttcgggtttttcggggggtccccccccccccccccccccccccgaaataaataaaaatattaaaaaaaattcattaaaaaaatatctaaataata

SEQ ID NO: 707821 - DNA, 418 bp, Homo sapiens
gctctctgggacagaacagagacggaccatttatcagctctacggagagaagggcgtctgcgcatggtcaccagtcgtggtgtcatccagctccctggggtagcaacgcctgtgccactcgagctccatgcgttcaagttggtctgcttgctagaaaagtctcatgggctatagttaatgaaatggtgcagagaacaagagaggccttgggaattaaaagtatgatagtttggccgggctgtaattcaagcacttttggaggccgaggcaggcggatcacgaggtcaggagttcgagaccagcctgcccaacatggtgaaactgcatttctactaaaaatacaacaaatagctgggtgtggtggtccacgcctgtaatcccagctactcaggagactgaggcaggagaattgcttgaa

SEQ ID NO: 707822 - DNA, 624 bp, Homo sapiens
agcggagtaggcggcggtggcagtgtggaggtggaggctgtggagcggcagcggcagcagcgggtcccgggactgaggcagcagcggttggcggcggctgtggcggaatgctgaggtgacggaaggcagcaggctggctggcggacctgtttcccatcacgggatggcgagagaccaagggctggctggcgagcaacgaatgagggcacgagagccactagaatgaatgatcacacagaccaagcatatgtgactgtgggtggacgtgagaaatcacacgtactggtgtgaccgaagagaaggtaaagaagctatgcaacgtgtaagtgatgggagaagagtgtagaagtgggcgggacggtccaggggggaggcgagattaggcgttgtgcgcgccgtgggcgaccgatataggaggaaggtacaaatcatgcgaagcagggacagggaggatacgatcgaggggagcagagagaagagtagtcgcaaggcaacgaaggaaccgtgacggaggctagatggaaatagattttagagaacagcagtccgtgatattccgtaaaaactggccgcgagagtaaaggtacgaggaaaagaagggagagaggagagcgaagagacgcg

SEQ ID NO: 707823 - DNA, 387 bp, Homo sapiens
ctgaaactgctctaccacaaatacaaaaattagctggtggtggtggtgggcacctgtaatcccagctactcaggaggctgaggcaggagaatcgcttgaacccgggagacggaggttgcagcaagccgagatcacgccattgcattccagcctgggcgacagagcaacactcagactcaaaaaaaaaaaacacaaaaaacaaaaccaaaacaaacacacacacccaaaaacaccattttatggggcagccacaatggctcacgcttgtaaccccagcacttgggaaggcccaggcgcaagattcacctgagatcaggattttgagaccagcctggcaaaattggcaaaccccgtgtctctactaaaaacacaaaagggtatcgataa

SEQ ID NO: 707824 - DNA, 154 bp, Homo sapiens
gatgatacagatctccgcttcatgcacttaagagtccaaacgcgacaattagcagacaggtcaattctgtcgtcacgtagtccagccattttgaggggtaatcctttcatcacagcggttacctttaaacctcagagaattttaaggggtttat

SEQ ID NO: 707825 - DNA, 140 bp, Homo sapiens
gattctagaggactccccccgtttccccctaaaaatccaaaaattatctgggtgtgtggcgggcgcctgtagtcccagctattcgggaggttctttgatttggttgtgatttcttcgtatactttcagcgcttctatcac

SEQ ID NO: 707826 - DNA, 675 bp, Homo sapiens
  misc_feature (208)..(208): n is a, c, g, or t
  misc_feature (252)..(252): n is a, c, g, or t
  misc_feature (295)..(295): n is a, c, g, or t
  misc_feature (329)..(329): n is a, c, g, or t
  misc_feature (363)..(363): n is a, c, g, or t
  misc_feature (501)..(501): n is a, c, g, or t
cgctcatgagctattcaaaagtgaatgtcacagtcatcacttgctgagtggtactcatccttaacagagtcctcatgagggaatcaggtctcgctgagtttagcatgtttaataatcttttctcacggtctcgatacatggatcgcattactagatataaggtgcttgcccaaaatgatttttctggagtttttaggagatattgtcntccttgggggacatacatggtgtatgttctcattgtgggattcnattttgttctaccaggacctctaatttctgccagttacttcantcatttgttctcttcaccatgagtctccagaggntacttccatggtccgtgcctccccatctcccagnaattctgcatttccaagattggcacctctggtcctctgcacggtgaagccccttcctttcaattccccagtagccagtgctctaatccaccaggtctcaggcatgatctatgtttctccacactcgctttctgagganagttttgcctgggttctatcatgaacaggccctccctgctgtcctggcctctatttgcatagtgtttcctgctccctctgccgtcgtgtggctcccagacctggctaagaaatcactgagggccacagtgttccctagcctggtgtttagggcaggattatggggtgagatttt

SEQ ID NO: 707827 - DNA, 159 bp, Homo sapiens
tttttggggggggggtttgttttctttttcccccaggtttggtttttggcctcccccccttggggtcccccgggggttgttaaagggccagcctttcggttcccttccccgccctttttaatccgcctttcccaaaggttttgggggccttgcccccca

SEQ ID NO: 707828 - DNA, 471 bp, Homo sapiens
cgtcaccccatcgagaagcgcggctggcctggcctgggtggctgggcgtctgcaccccgagagagctcccccgcgcgcgggcgcctggcccgggcaggtgggtgcggagcggctctgggggccccagtccccggcagctcttgtcccgcgcgtggtttttgtgaagacactgtgggcgggatgggcgcagggtttcggtagccttggaactctcgccaaagaaaatcgcgggcgccggtgcctcagccgtcctgcctgagagactcgcctccgagaggaggaagggacagaccaaagcagtaaatcggccatcctgcagaggagccgccttctgctgtctgtgggtacagccagaactcccatacgcgggcgctgaagtgccaaaccttcgtgcgtgttctctagtaattaggtgcattgttttgaaggaataaagaatggctactccataggcagaacagcctctagtaa

SEQ ID NO: 707829 - DNA, 252 bp, Homo sapiens
cggtattacctgctgcttttgcgccactggatggcgacaaggtggttggttgctacggccaaagctggtccatagtcccctgcgtaagcagggaataaccctcagagggctaagggagctgagatgggtgggcggatggaattggggcacatttgcagatgtgaggcctaaaggcttgaggcatctgcatcaggaggatggctggaagctggtcccctgggccttgaagccttgcaattgttgctactaggc

SEQ ID NO: 707830 - DNA, 318 bp, Homo sapiens
tgccccccccccccccccaacggtttttaaagaattccccttgcccccctttcttctgtcccacggggacaaaatttgccaaggtggtacttggggcccattcttcaccaacaagtcctatgagcaaagggcccacgcttagggatgcaagaacaacccgtttttaaatgttaccagtcccagccaatcttacggtgacattacagttaaatttcccaattgaaaacaagcaaacagacactcaaactggtcctgtaattgttgctagactttatgtgttgtacaactaaacattgctgtttgaccagtaaaaaaaaa

SEQ ID NO: 707831 - DNA, 1245 bp, Homo sapiens
  misc_feature (424)..(424): n is a, c, g, or t
cggacgcgtgggtcctactcctcattgtacccatgtctaatcgcaatgggctattcctaatgtcttaccgaagcgaaaaattctaggcatatatacaacatacgcagaggccccaacgttgtaggcccctacgggctacgtacaacctttcgctgacgccataaaactcttcatgcaaagaggcccctagaaatcccgccacagtcgtaccagtcatccatctacatcatccgccccggacaccttgagcgtcatcgaccgatcggctcgtttgtgacttcattgcaaccctcaccatcccacgccataaccacaagagccccctcgtagggctcacatcgcctctcacattcgtaaggcggtccctcaacgtgaatattcactctctgtatgccccaaacgttcgtgagaaacgcgtggaatngaccccagtttgtggtcaacctcttgcgcgaatatagctacccgttatcattatggggatttaccccagagcgggacatttggggacacggctccggaggtcaaccaaaaaagcaaggcctttccggcaaaattaggcgcatataagaacggcgcgcaagcggacgctgtgcgcaaccttttcccggcgcgggcacttgggtctcaaacccggttagtgggcacggacaaaccgcctgtttgtaggctactcaaaaggtctggtccgccaaagtggagcccagacgacggatctggaacgtgaagactttttgccgcgcatctgcgaaaattagcggccaatcagggcggggtcacgtgtacgcgcacgctacgggttataaacggaattagcggccccaagattgcagctagacttgttgcccccaattgcagagcgttttcgagaagtttcccccaatattacgcgcaggagcgtcttcctattgtacaccgccttaaaaggaacttcttccaccacccagtaagggatttactgggccggcacccattttccccaccacggtttgttgggtaccgggcaaaaaatggcgcaaccgcctttttgcgggggttgcccaccccgcgaaaaacacccctaacacggttggtggctgaaccctcacccgcgtcattcgtggtaaaagaggcatttacaccctttaaagcgatggggtttaaaccagagctgcggaagcagtcggccgtgtgtcccgtagtctcgcgggaattttggtgggagtaaaccctgtgaacttttatagggacaggacgcccacgccc

SEQ ID NO: 707832 - DNA, 513 bp, Homo sapiens
gccacctcacagcactgtcctgtccagggtctgttgggccctggtgatgagtggccggtgccttggccccagggagctcatgtatggctctcgtacctgtcttgccaagggtgtgtccgtgtgctgtgtacatgcatgtgcccgttcacgcggcatgtgctttatccatgctgctgtgagccagcccaggctaggccctgggggcctgcggtggagtaagacaggcacaggccagatgcagtggctcatgcctgtagtcccagcactttgggagggcaaggcgggcggatcacctgaggtcgggagttcgagatcagcctgaccaatgtggagaaaccctgtctctactaaaaatacaaaattagccaggcgtggtggcgcatgcctgtaatcccagctactcgggaggctgaggcaggagaatggcttgaacctgggaggcggaggttgcgttgagccgagatcgcgtcattgcactccagcctgggcaacaagagcaaaactccgtctcaa

SEQ ID NO: 707833 - DNA, 447 bp, Homo sapiens
  misc_feature (362)..(362): n is a, c, g, or t
  misc_feature (441)..(441): n is a, c, g, or t
tttccctgcttttctaagtagacttttctgctgcttgaacatacatgtaaccattgttcattggcttaagctctttattatgaacatcagctattttataataccttaatatagaaaacctctcaggagctgtttaagtataaagccaagattttccttaggctaatggtctgacttctgtgctttcaaattaaagtacttaaagcactgaaggattggccaggtgtggtggctcacgcctgtaatcccagcactttgggaggccaaggtgggtggatcatctgaggtcaggagtttgagaccagcctgggccaacatggtgaaacctccatctctacttaaaaatattaaaaattaggccngggtgtgggtgggcttcatggcctgttaattcccaggcttacttcagggtgggccggagggcacaaggattaggacttnaaagtt

SEQ ID NO: 707834 - DNA, 376 bp, Homo sapiens
caaggaagaaagtatctctcactgaaaaatctagaaaaaaaaaaaacaaaacccaggacaggtgcgagtggctcacaccttgtaatcccagccttgtgggaggccgaggcgggaagattacttgagctcaggagttcgagaccagcctgggaaacatagtgagacctcgtctctacaaaacatttaaaatattagctgggtgtggtggtgtgtgcctgtggtaccagctactcaggaggttgaggcaagaggatggttggagcctgagaggtcgagctcttttaatttggtcattgatccattctgagagtggaacccttatgacctaaatacctcccataaggccccacctccaaatactgttacatataacggg

SEQ ID NO: 707835 - DNA, 171 bp, Homo sapiens
ccagtggatcaccacatggtccccgtattgggggtgtggaggaaagctttctgacatgatctgagcccggctctttctcttaggggtgtaccaccgttggtggggttggagtaagcggcttcctcgcagatacgctggcggagccgcttgatgtggcggagcagggcaatc

SEQ ID NO: 707836 - DNA, 133 bp, Homo sapiens
gagggacagtttgtgggctatttcctgctgtagaagacgacgttgatgaaacgaaagcgggaccaggacgaggagatggactatgcaccagatgatgtgtatgactacaaaattgcttgggggccagctggag

SEQ ID NO: 707837 - DNA, 817 bp, Homo sapiens
ggattggcatcggagtgggctgccggagcctatgtgctggcaagtttgcactcatcttccccgacctggtggaggggctggtgctggtgaacatcgacccaatggccaaaggctggatagactgggctcgcaacaagctctccgggctaactagacactttaaccgaacacgggtgctctcccacactcttcagacaggaggagctggtgaacaacacagagttggttgcagagctaacggcagcagatttggggaacgtagtgaacccaaggggcaaactggaggctcttcttgggaacatgtacaacagacgcagaagacctggacattaaacgggctgggaacggtgcccaaatcggcaagacgctccgctgcccgtgatgctggctcgtttggggataatgcaaccgctgaggaacggggatggtggagtgcgcacgccaaagctgggaaccgacacaacatacgaacttccgtgaagaatggccaggaatctggagggctggcacagaggacacacagacaagggaagctgacatgaaagccttcaaaatacttactggcaaaggcatggtgctaaaatggcgcatcagcacaagaattgaacccggcatgggcaaggtgacaccccgcaacatggaagttcactcaacccaagatgccaaggatccggataggaatggccaagcggcacaacaaagccattgaagcccaacacggaagaagacagcgaaggggcatgggccaaagggcaaacaaaaacaatggaaggtgtccctgtaaaaagcaccaaggataccagtgaaagaaggcccc

SEQ ID NO: 707838 - DNA, 408 bp, Homo sapiens
actgagtttttttttttaagaatttttttattgaggtaaacgtcccataacataaaattaactattttaaagtgagaagttcagtgcccattagtattgttaacaatgttgcataaccgccacctttatttaaagttccaaaaaaaatgttttcctttaaaaggaaaccccatcccattaagcagatactttccattccttccttcctccagccccagcaatctgctttctgtctatatggttttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaattta

SEQ ID NO: 707839 - DNA, 155 bp, Homo sapiens
  misc_feature (151)..(151): n is a, c, g, or t
ggttgatctagcaggcatcccccaagcaatgcatggcatggcagtgttcccagttagcctgcatgcagcaggggcaagtggtgggggcagcacatcaacccccacccatcaaggcacatttccatcaccggggccgggtgtcacggcagcntcgc

SEQ ID NO: 707840 - DNA, 955 bp, Homo sapiens
  misc_feature (512)..(512): n is a, c, g, or t
acttgatgtgtgtccctgtgggatggacgtggatggggatcggtgggataccaggatatccgacatagtgggtcaaaatgcagatcttcatgacaagccttaccggtcagaacatcacccatgaggtggagcccgggggacatctatcagctaatgtgatggctatgatgcatgccataagggaatgccattatccccgaagcgagcagatggctctctcctcttgcaaggcaagcgagactgcgaagatggcccgtacttcttgtcttgacatacgaagatccattaagagagtcgaccactgacacctggttgcctgacgtctgcaacagtgctggatatggcagactcgtttcagccgcatagatgcactagaaacgtgctaggaacattactaggactgtgagagctggaagtcccacttgaaaatccggtcctaatatactcgttgggcacatagatcctcattgtatagcacgataaggtcatgctgatctccgtacactgaccgnatggcgtcaatcttatgtcagtgcttatgcatgctggtaacgagtgtgctcgcaagatcctttttctgagctatccatattgcgcacacaggacgtcgaacgccttgcagcttggctccctgtgttactgactacggtggctcggccagcatcgcccttggactagacctctgagactgcccagagccatcggtcagcgacggtaggaacccttgccgcgcacgccacacctgtgaggggccacgagccgagtgatacggacgggatgccctccgggccaggcgctcgtactggcgcgcacgcaggccggcgactgacgccccccatcccgctatcccggcccggcaccgttcccccgtgcggcgccccccccccagggtgcgggcagactactacaggccaccagggcctccatagggtccctacacatcccctccacccgg

SEQ ID NO: 707841 - DNA, 711 bp, Homo sapiens
cccgcgtcgatcaccccatgccttgattgttgtttctgccccgcatgtattttataggaatagtgacacatttagggaccacccacagaatgatccgtattaaaggggtggtagaaaactgctgtttatgataaaagtcatcggtccagaaaatccagcttggattggtgcccagtgttttattgggtgaaccaccctgggagattttaatagcttgaggccaggtggaggggccagaagatccctggggaaactgctggtctgggtgctgctggcctcccagactggccaatgggaagggctagtgagacccaccaccggggtagacccccagcagcagccaccctgcaagcccagcctggcccggactgctcagacccgcttgcagaggccgcacgccgctgtgggcacgggggtgtggcacggagctccccgcacctggagagcccccggagctcacaccccggtacctcacactggggccttttctgagccaggtctcgaaagcgcacggcccccctggctgagcagccccgccctttccccgctgcacctcgccctgtggacagccccgacacacccctttcctgaggctgtcgctcactcagattgtccctttgctatgccgaatgcagcccaaattcctttttaccatttgtgatgccttaccgatttgatcttaatcccgtatttaaagttttctaaccctga

SEQ ID NO: 707842 - DNA, 146 bp, Homo sapiens
ggaattcgaggctgcagtgagctatgattgcatcactgtactccagcatgggtaacagagtgagactgtgtctctatttaaaacaaaaaagattacattccccttggcgtatgctctcccagtataactagtgtatctattataaa

SEQ ID NO: 707843 - DNA, 110 bp, Homo sapiens
atccttatacagtgagcaagatcatgccactgcactcaagcttaggggacagtgcaagtctgtctcaaaaaaaaaaaacccattggattcccttggatttttgggccagg

SEQ ID NO: 707844 - DNA, 1610 bp, Homo sapiens
  misc_feature (610)..(610): n is a, c, g, or t
  misc_feature (1150)..(1150): n is a, c, g, or t
  misc_feature (1186)..(1186): n is a, c, g, or t
  misc_feature (1201)..(1201): n is a, c, g, or t
  misc_feature (1342)..(1342): n is a, c, g, or t
  misc_feature (1348)..(1348): n is a, c, g, or t
  misc_feature (1386)..(1386): n is a, c, g, or t
tcgccttattggttggggcgttgtttcgcgatgcccgtcgtgggtgttgttttgttatcaccgtcgctgtgtgtggaagcaagtcgttttttcccgtcattggttgatgacgtgtctctgtgtggcctctacttgcaggcccctcccggggggtgacaaccagaggctggtgatcccgcccggtttgtttctcgaagcgatgtttttttcctcccctctttcgggagtaggcccctctcttcttcgtgtggtacccctgctccccgcggggttggcgccccactttgtgggggattcccccccagccgtggtttctctccgcggggaccgacccacccaaccacgtgtgtgttataatgatatggggggtaaattcccccccggaggccacacgtttccccctgtccaaggcttctcttgggagatgggacactccgtgccccccttttgggtggttttttccccagaacgggagccccccccccccgcggaggccggaatttttgttggccgccacaataccacagagaattgttgtcttgagatgttgggcctcttgtgtctcgttgtggacccacaccccgcgcccaaaattggttctctctcttgngaattctctctcggagagattataacaccgccctctcccaagctattatgggaaaataacccccctgggggtgttgtcggccacaaagaaacacacactgtgtctccacgggaatgaggacgccacacctctcaagaagttgggttgtctcttttgtgggttccccgcgtttttctcgcgcccccacacagccaggcgcagcacaccccgttattttcattctcggtctctctcctgtgtgtgccctgtgggcaccaagacactgtgtctctcagagatatatgtgagcacaccctggcgctatacatctgcgccaagcctgtatagcacaccacgcgcaccacactttgggcgcgaccacaccaccggcgctattttctctgaggacacacccgcgggtgaccccttgtgtctttctctctcacacgagagtgtgagatctcccgtctctgttggcgctttcttgtgagagcctacacagagagattgtgccacagcgcccacctggttatttgtggagatctctccacaccgcaaagnccacacacacacacctcttacacaccgcgctatagnaaatgtggtgtgggnacacacatacacatcacacacgcccccctcgtgtggcttcacgcgccctcatacccgcgctatcacgtgggctgtgtgtgtctgcgcccacacgcgccctcacgcgcactctcaacgagttctgtggagtttatagagagnggaganaagagtcacttgtgatagagtgagaactcgagaagccnccacagaaagttatccacgtgatccacccacgcccaaggcacagaaccaccccccagtggcaccctctccctcggcctcggttctgcttagatggccacagagactctgtttgtctggctatacccggagccacaccttggtgcgagtgtggccacggtgagcccttggcacccccctagaaatttaattggccgagcttttaccaaaataaaaaaaaaactgg

SEQ ID NO: 707845 - DNA, 127 bp, Homo sapiens
  misc_feature (9)..(9): n is a, c, g, or t
gaatctganagttgtgcagagtagtaactgtgtgagagagagagtgcagggtaactgtaccgatttcctggagaacacatttgatacattttgaaggaacaattttcagtcttaaaatcacatgttt

SEQ ID NO: 707846 - DNA, 189 bp, Homo sapiens
  misc_feature (136)..(138): n is a, c, g, or t
  misc_feature (149)..(149): n is a, c, g, or t
gagtactctatgaaatagacaggaagaggcagcacaatccattttgtctctgtggtagccataaacgttatatatgcctcccaagtgccaggtgagtctggtggagtctgcccagttcacagggggatctgacaannntctcccaatcntatttttcttccctccatgaaaatttgtgaaagatattat

SEQ ID NO: 707847 - DNA, 907 bp, Homo sapiens
ggagtcacggctcgcgatggcctaagtcgccgcagaactgccacgtggggatgagattgctgggctggtagcggcggctgctgcgggaggtccgcccacgtgaagccagcctaactgagctctggacttgtggggacagctgtcagtggcctaggccgcaggacaccaatgaagcaactgccagtctgtgggaacctggagacaagcccaggaaaagcaacatggtacacctttgattgtccctggagacagcccctgtgcctcgagtgggccacagctgttcatatttacccccagttgtggtaatgccaaagagagggaaggtttccattgtggggggagcaaatccaaagggaagcttctcagacgtgcacaccaatggatctgggaaaaccaccagtgggacttagatacctgcagggcctcttgcccggtatgaacatgctagctttcattcctcctgcaacacctgaccgtatctgggtattggaggtgcaaccaatcaggaaatcgaaattgtctacaagtcttgaatctgaaacagggacgtgagaccacgccaagaaagtgaccaagcaccccaaccatcccaagaacatccaacacatcatccgggagcaatggaaacaagctaatatggtcatgggggccggcagacgagggtgccagcccgcaggacccggaagagcatgtgtgagggcaaaactctggcgggtcccggcagaagacactggagcctcacctccgggaggacgtgaggggcagcggacaagcccaccacggggctggggggcaattatatgcccaggtgtaatggcagaagagaagcacaccgggccagggggccaccggccgcgaagtgactggggacccgaggaaaacacaaaaggatacccagaggcgggac

SEQ ID NO: 707848 - DNA, 160 bp, Homo sapiens
tctcgaggatcctccaaagatctttgagcatacccaggaggcaaggtgttcacattcatagacttcacttccaattcctggaatgttcatttcttatggcttacaggagagactagacaggaaagccaggcaattgcttaggcaactaaacatgaggttg

SEQ ID NO: 707849 - DNA, 191 bp, Homo sapiens
ccgcccccatactccgccaaccgaccgctgtaggggatgccacagctgaccacggtagcagccagactggagcttgggattgaagttgcaaagcggcccctggccgggctcgccgtcgctgtccagggacggtcacggtgttgtggctgtaaagctgtaggacctttttaataaatagagaattattaata

SEQ ID NO: 707850 - DNA, 647 bp, Homo sapiens
ggctggctcggcttggcggctctgcctggatctcggcgccgcagtcctgcgcctctcccgcccctgtctcccgctccgttagccccgggcacggcggaggcagcggagccctgggccatcgtacctggagtagaacagaaaaattattatgtctgtgttcccttgggactcattggaaattgtacagtgacatcttctgggatttagtctggattgtgcaccccgcgcgcttccccactgggaacgtcgactattaatggagagctctagaagataccctgaccaccttgcccttccctggggctgcaggccaactccaccggcggaaaggcggaatggccagagaagccccgctgcttccaggcaccaccctgactccccgatgcggaggaccgtgtcaagcgcataccagaagtccctacacatggactctacacatatccgcgtctcggctcccaccgcactgggccgagggaagctccccagacagtcgcaggcctcaagcacacgctgcaccagggagcgacgaaaagcacgaagccacacgcagcacaggcacatgcccaatccccttcaccgcgtcccaaaaaccacgcgtcacgcatcgcacagcgcaccatcgcacccggcaaccgcccccgaccccc

SEQ ID NO: 707851 - DNA, 154 bp, Homo sapiens
tagatcttaaggtcaacacttaacagctacccactagtcacaagtcttacttattatcaacaatcaagagttctcagaatagttcgttaaagaacttatgtatattacaatatttagcaagtgttatcacagtcagattcagtgaaagatttac

SEQ ID NO: 707852 - DNA, 101 bp, Homo sapiens
atttggagcacttgctatgctcccaagtgctgtgcaaagacctggagggaaacatcacagctccatgtcgcaagttgcctgcagtttggtgggggagacag

SEQ ID NO: 707853 - DNA, 108 bp, Homo sapiens
tatagacatccgagtcatatttaaagcagcatacttctcatgctgtcttattttctcttagtttcgaaatggaccatagaacgctgagggattcccctggggaaaagt

SEQ ID NO: 707854 - DNA, 301 bp, Homo sapiens
cgatccccgggtagacgggctctggagcagtttgccactgtggtggaggccttgctgatcaactcaataaggggtttgtcaatgaaccgtttctgctgcagcggctggcatactgggccattgacctctatgccatggtggtggttctctcgagggcctcacgatccctgagtgtgggcctaccccactggccccgcattagaaaatgctctgtgacaccttgtgtatcgaggctgcatctcgtatcccacagggcatggccgccctgcagtctgacccctggcagccatagctctaccgc

SEQ ID NO: 707855 - DNA, 284 bp, Homo sapiens
gcttatggcatggcaagctggtctcaatctggctcaggctatcctcccgtctcggccttcccaaagcattaggattacaggcatgagccaccgcacccgcctggccttacacctgtcttctgctagacctggggcagcatcgcgggtggtggaggccccactttctgcatttaacagtttctaaagcggattctggcagcgggcagcaaaaaagctaggggaagggctggtccccttcccgctgctggctccacctctgatagacttggccttgccatatgcaa

SEQ ID NO: 707856 - DNA, 218 bp, Homo sapiens
tgcagctgagcccagctttatgcaaacaacactctttttgttttttttttgtttggagagggagtctctccctctcgcccaggctgggaggatcgcttgagtccagggagtcctggggctggtagtggcgctatgccgatcgggtgtccgcactaagttgggcttcaattgggtgacctcccgggagcgggggaccaccaggataaagaggtgtgggg

SEQ ID NO: 707857 - DNA, 211 bp, Homo sapiens
gttgaaatgtcatattagtagtaaagtggggtttatttatatagtggttaagaaatgtcagtttacactgctgtatacttcttcttctgtgtccctaaggcctggtacagtgccaagcaaatatttattggataccaagtatgtgcttggctctgtaccaggcacatacttggtatccaataaatatttgttggatgaatgtatgcatatg

SEQ ID NO: 707858 - DNA, 959 bp, Homo sapiens
tggtgtgtgttgggtgtggagatgtgtggtgtgagtgtgtggatattggcactgacgtgccgagggcagtggtggtttgtctcgcgatggattgatcatgagcgacaggtgtgttgcgcccttatataatgtgtgcgccggcgtagaagtggtggtttctccgcgcgggatttttgtggctcgctcgttgaggtggcgggggcttctctccccgtgggcgggaaagttgttcgccggggttctcccctccgtgggggagctgttttcccaacaaaggtcgtgtgttagttgggtcccgcgcgtcctctctggtaggggatcggggtgtgctttccataggagttgggggggaaacgtgttctagggcaacaaaccaagggtggccccccgctcgggtgtaatccccggggttgtgtacaacccggtgggggaccccccggacgagttaaacccgccgggtggtaaactagccccgctccaactcgacaggaagcgtgctcccgagaccccccgggtaggaacactcgggttggtttagcacaaagggcgccgtgataacgaccacccgggcatagagaaaaaagtgccggccacaactggagagggcggcctcttggccacaagtcaagtgacactctttgcggagtccccccaaaagcctgggcctttttggctcttgaatcacgttggggtccccgaagttactaattgttcacgccatgtcgcgatgttcccttgcgagaggacgtgttggaacaaattggcgagattcttctattcggaggatcttcccaggcggtaatgttgacacaagcaaaaaggctttcttataaggcgggggaggtgccaaaattcaccccccgttatgtctttgggaaaaaaggttcggccccccccagggaaaatgggggttttcccctgggggtgtccaaaaaaattttcccccgcgcgaacaaaaa

SEQ ID NO: 707859 - DNA, 196 bp, Homo sapiens
atgcggatccttgcgagatgcatacgggacgtcatcactgtgtttcagcgacttcgacagctgagagacaaaaagaagccgtgcctctactactggatcacagattatgttcatttacagaaccaaattataaaggcggaaagacgagttctcacagcagttgggtttctagcgtccatagtgaagcatcctcata

SEQ ID NO: 707860 - DNA, 174 bp, Homo sapiens
  misc_feature (108)..(108): n is a, c, g, or t
ctctgctgctcctcttcacccaactacagaggaggatctgagcacagagtcggtcgcgtcacaagctcgtctcggaggcctatcaggatctgactgtctcgagatganacgggaaaccacagctgaaacaatcgaggggctggtggaggagctgctgaagagggagggagcagc

SEQ ID NO: 707861 - DNA, 343 bp, Homo sapiens
gttgccgaggctggagtgggtgccatcttggctcactgcagccttgaccttctgagcccaagtgatcccagctgctggagtagctgtgaccatgggcatgtgccaccatgcccggctaatttttgtactgttttttgtagagatggggtttctccatgttgcccaggatggtcttgaactcctgagctcaagccacccatctgcctccgcctcccaccgtgctgggattatagatgtgagccactgcacccagccaatagctaacatttttttgagtacctatttaggcactctatctagaccctttctcaatcctcgcaataacccaactttgttgtcgacg

SEQ ID NO: 707862 - DNA, 438 bp, Homo sapiens
tgtataaaccatcgaggcgggaacggtggctcatgcctgtaatcccagcaccgttggatttgccgaggcaggtggagtcacccgaggtcaggcgtatgagaccagcctgggcgacagaggttgcagtgagccaagatcatgctactgcactccagcctgggcaatagagcaaaacgctgtctcagagaacaacaatgacaatgaaaacaacaacaaaacttaggcgggcgtggctgcatgcacttgtaaacccagatactagggagcctgaggcaggatcatcaattgaacccaggaggtggaggttgcagcgtgccgagatcgcgccactggactccagactgagtgacagagtacgaggccggaacatcgcttaaacccgggagaccaaggttgcagtgagccgtgtataacccacagccatccagcctacgtgag

SEQ ID NO: 707863 - DNA, 183 bp, Homo sapiens
  misc_feature (3)..(3): n is a, c, g, or t
  misc_feature (32)..(32): n is a, c, g, or t
tantctggctctacctggacaaggtgcgcgcnctggaggcgggcaaggtcaatatagaggtcgagatccgcgactggtaccagaaagcaggggcttgggccctcccgcgactacagccactactacacgaccatccaggacctgcgggacaacgattctgggtgccaaccattgagaactcca

SEQ ID NO: 707864 - DNA, 182 bp, Homo sapiens
tatgagataataaatcagtggtgttttaagctgctaaatttgtggctatttgttatgtaggaataggaaatgaatgcagtattttaaaagaggtaaataggaaatcttcattcttgattccctgtagtatgctgcatatttcttggtaaaggcatgaataaagtctttagtagccagtcaaa

SEQ ID NO: 707865 - DNA, 323 bp, Homo sapiens
  misc_feature (271)..(271): n is a, c, g, or t
tcactctgaaacatcaaacatcgtgcgcctccatacagtatttctgaagaagggtttcactacctcgtgtttgaccttttaccggcggggagctgtttgaagacttgtggccagagagtactacagtgaagcagatccagccactgtatacgtcatattcgggcgcagatgtttagcatgtccaccagcttgacatctcccaccgggaccttctagcttgctggctgatttcgggctacgacaacttcctgtgctattatctattttcatngtcgcgtcccctgtttttgaatttttttccccctatacctgcgaacctatga

SEQ ID NO: 707866 - DNA, 968 bp, Homo sapiens
  misc_feature (4)..(4): n is a, c, g, or t
ggcnaaatagctagtcgaggcctggtgtgaatcggcaccgaggatggtgaagcccgtctctactaaaaatacaaaaaaattggccgtgcttggtggcacctgtgatcccagctgcttgggaggctgaggcaggagaatcgcctgaacctgggagactaaggcaggagaatcgcctgaacctgggaggcagaggttgcggtgggcccagacggcaccattgcactctagcctgggcaacaacacgaaactccgtcccaaaaaaaaaaaaaaaaagaaaaaaaaaaaaaaacaagaatagccagaaagaaaacaaacgaaagcaacaccggccaagaatgggcttgaccttccgtcgccaaggaggaaaccgcgctcggcccggcgaagccaacgttgggggagacccacacggggcattaggacactaggctgggaaacccacggcgaggcgtcccgtaccccaaacggaggccgtagaagagaagcgaaaaaacaaagaagagacaccacacaggaaaagagccaccaaccacgagagacggacgaataagaggcacgcacaggagaagagacacacaccccgcgtcgtgggaagaccaaacgacgggaaaagacatccgtgagcgaggacaaccatcggggggggagcaaaacaaaggagcgagcaaaccaatttggcggtggagcacccccaagaagccgcgcccgtgtgaatgaggaagcacaaaccgcgctccacacatcaggggggggcagcacgacaaccatgtggggtggcacagccaccacacaagaaaacaaacgacgcagcgagaatcgctgggtaggacgagcagcaaaaaagttggcgaagacaacttggcggggccacaaccgcagcgtggtctggagaaggcacaggaagattatccaacgggaaagacatagtactgacccgggaaagaagaagacaattcgtaaacgggggc

SEQ ID NO: 707867 - DNA, 305 bp, Homo sapiens
  misc_feature (64)..(64): n is a, c, g, or t
gctcgactgtctaatggagcactgaccaggcagcaataaagaaaagatctagaccgggcacgtnggctcatgcctgtaatcccagcactttgggaggctgaggtgggcggatcatgaggtcaagagattgagaccatgctggccaacatggtgaaacctgtctctactacaaatacaaaaattagctggacatggtggcacgtgcctatagtccctgctactcgggaggctgaggcaggagaatcacttgaatccgggaggcagaggttgcagtgagcggagatcatgccactgcacgtcgacgc

SEQ ID NO: 707868 - DNA, 200 bp, Homo sapiens
aaaactacatatacgaatcgagcgcggtaccttggtctacatgtctggtctcaagaagacaggcagagtagtggatatattacctcccacatgcgctaccatgcctgactaattttgtatttttagtagagactggggtttttccttgttggtcaggccggtctcgaactcccgacctcaggtgatccgctggcctacag

SEQ ID NO: 707869 - DNA, 155 bp, Homo sapiens
ctgtcagtgcctccccaagctgttaacagtctgctgttggttagcctgttcctgcttcttttctagaggggactcagcccagcagaatctaatgagagccctagaatgccctgatggctgctggaacccaaattaatggctggatggacctcaca

SEQ ID NO: 707870 - DNA, 330 bp, Homo sapiens
ttttaaaaggcccccccggggggggcccccccgggggttttttgggttttgtaaccccggggggggaaatttttcccccccgggggggggggcggggggggggaattcccccctttttaaaaaaacccccccccttgggggtttggggtttggttttttcccgggggcccggggttccccccccccccatttttttttttccccccgtttttccccccccgggggggggttttttttaagggggggttttttccccccgggggggtttttttttaccctgttcctttttttttggggggggggggaaaaaccccttttttttttttttta

SEQ ID NO: 707871 - DNA, 908 bp, Homo sapiens
ggtgcttttctaccaaagggcgcgtcctgttccttttaaccgccaaagagtggtgtgggtgtgttttaaggccgccccatagtgtggttgtcccatacctgggtagtacgccagcgatgggtggccgcgcgcacccccaacgtgtggcaggtttttgccgcccacgttgatgtagctggtcaatccgttgggttcgtttgtaccccccccctgccccgtcgtcgcgctggttgtgggagaacaaagttcccgggggtgccaaagtagggcgccgcccgcccgtctcgcgccggtgttgggtatcttctgtcatacgcccggcaccgcccaccccgggcgcgagttttcgtgggcggaaccccccgctccatcgggggtggtccgccagttgggggtgcgttatatccgcggttctgtcatctgcgggaataaatcgctcccccgccctgtctctcgctcgactaatggcgctccttgctgtctcaaccgatgactgtgcttgtctgcagattaaagttctccccctcacagtatggttgtatggcctccccccccactgcttttaaacccgcacacaaccaggagcccccctccctcgtcggagtacccctctggcaaaccttatattcactctggtgggtattcattaattgatcttctcattcaatatccgctgttttaaccccacacgcacccgtcttatatcaaccggtatgttcttcacatcattctggccgtaacaccagcagaggaggacacactttctcatccactaacagcagagcgagagagcgaagcatcatcttggcacccaccacaaggaaacgccatgaaagaatgttcgcccgctcacacacgctcgaacgtatgtttgatgatgttataaaaaaccttcttccaacataaca

SEQ ID NO: 707872 - DNA, 969 bp, Homo sapiens
  misc_feature (484)..(484): n is a, c, g, or t
gggggcgggcgtggtggcgcacacctgtaatcccagctactcaggaagctgaggcaggagaatcgcttaaacccaggggatggagattgcagagagccgagactgtgctactgactccaggcggatgacacgagtgatgaaagtgcaaataccaagataggagtactgagagacatttggggggcgtctatcgagccccggagaaaagggtgatgcaacaaccatccggttgggggcgccgcgccccgatgggtgtaggaaccattgggccaaaggggggtcccaaaggagaacacccggggccagagccaaggggtcgggggttcctccccaattaaaaaacgggccggggggacccccggggggtgtgtggaccaacctccaaagagggagggtcccgggggggccattcagggggctccctccacacgcgggggctccagggggaggcccaagaatcaaaattacgccggcgggcggtggnatacaccatacacacaagcaaaatacacataggattagtagcaagaaaacaatagacagcacagcatataccacgagtcacaacataacgacacactgacaagcaagtacagctcacaacgatgaacacaaatatacaacaaacagtataacacacacagtacacaacgcgagcccagagaacaaaaagggaatgacacgcaagcggacaatggccgaacgaccacacgcgggaacacgaacgagcaagaacgacaatacaagagaccatggccaagcagataggcacaagaaaaagagcaacacggagccgcaaacagaaaaacggacagactcaaagacaaaacacaatacagccagaggaccacaaccaagagatgcgcccacaaagccacgaacaacggacgcaacaggagaaaccagaaacaggagaccaacaacgaccaaaagacgaagaaacaaaaagcgcaaaggagaaaacacaac

SEQ ID NO: 707873 - DNA, 133 bp, Homo sapiens
acaccgagacagtgctagtaacatgtgtgcaggtgaacatgctagtaatgtttgtcatgaagcacctgtgctcatgttagattggcggcgccccactactgctagatgagctatcctgggacttaatagccag

SEQ ID NO: 707874 - DNA, 421 bp, Homo sapiens
  misc_feature (324)..(324): n is a, c, g, or t
  misc_feature (367)..(367): n is a, c, g, or t
  misc_feature (401)..(401): n is a, c, g, or t
  misc_feature (415)..(415): n is a, c, g, or t
ttttttttttttgagacagtcttgctctgtcaccagccttggagtgtagtggcacgatctcgcctcactgcaacttccgcctcccaggttcaagcaattctgcttcagcgtctccaacagctggaattacaggaacgcgccatcacgacccgctaatttttgtatttttagtagagacggggttttccgtatgttgcccaggttggtctcgaactcctggcctgaagtgatctgcccacctcagcccccaaagtgctgggattacaggtgtgaatcactgcacccagccaaatgttttgttatttctttgacattattcttttncccaactacttgctttaagttgagtgctcaaataattggactnttaaatttttcacatatggtattaggttcccgtngtgtttaagagggncggtta

SEQ ID NO: 707875 - DNA, 1569 bp, Homo sapiens
gacctgagatcctgttccctgaaactgtgattatagaatgatgccgtggtaacttgatgccccaggttcatgcttgtctagtgagctagctcatttcatgactacaactttcttactgctacagctcagaattagtacgcacctagtaaacccttccttacccttcttacctatcctccttccctccactttcactttcctaccctctcgcaaccacttgcttgaacacagttcttatcactcgtctcctcaccttactatctatgcactcgcgtctaaccgtgttgcttattgactacacctttccacttttacactttaaccacgtggtttctcttgcattgcgtacccgctatgtaccaaaatgctacctgtcccatttcaacgttttattccttccgacatttctcacttgtgcacctatgactctttaactttccgcctttcctgtctccgataatgctcattttcgtattattcatcaacaccgtccacgcgttaccctcattcgaacttatctaatactaccttacattgaacatataggctttttctggtataaacctcagagagatacctttgtttaactcagctattgtggtggggccaacgcggtaaaactatgaaataccgcagcggacctttgttggaacaggctattagtataatacaattctctgtcagtgcgttccgaataaattgctaaaggccctgaagggggtcccactgagtgggggagttcacctaaacgttggttggacatatcattgccaggtcattacaggttggatccaaaccaaaaattatctccgatggtaaaagcctgtttgttgccgtgaccactactaccggcggtcacacattccgcacatgttctccattgctccgaaggttaggaccccattgtgccagttgtagataacacctattgttcccttttaagcagggggggtatcaccacattttcttaagcgaaaggccacctttttatctatggagatgacaacctccagtcgacaaacatggcgagcttgcggtgaactctgccttagacgtgttggttggtgcccgctcgcctgttgccggagacatcagagttagtcccacttaggagagacccactcgggcaagtcacagacgacatgatctcgcttccccattggtcagcgtcagaaatagtcattccgaacgccacccacatcaagcggtgtagcccccgtgttaatggccgccatgggcaaggtgtgacctccacagggaaggggttcccccgtagtggcaagttgcctatgcggctttccgccggagttttgtggccgccgaatgccatggggctgtgtgcgcggtgctccacttccttgtgtgccttgtcgtgcacggtcgcgctttctgcctttcagtggaacaccctttcgcgagaggctcacagcaatcgttgtttagacgagggtcgtcccccagaggtgccctatggggcagcaagagaattggcttccctggaggggcgcccctgtgcggagagcgttctccagaagagtttagggtgtgccgtcgggggtctgggcggca

SEQ ID NO: 707876 - DNA, 405 bp, Homo sapiens
cacgagggcgaaaatggcgcaattcctgatttggaaaatcagatttatggagcccgcttaccagacgccgcgggtgagaccggtggcgaggtatccccagagcgtcggcggaaaccacttctggctcggcagatcgacccgccggggggtgaggcgcccggcaagggcatcctcgatggcgcggacgaaaaggggcagggcggtcgcggcctggacgtactggtaggtggcgatggtatcgccgggatcgaaagtgacctgcgcctgatagagcacggcgccggtgtccaccccttcgtcgacgagatggatggtcacgcccgcatttccggcgtctcccgtggcgagtgcccagtagccgggatcctggccgcggtacttcggggtgataccccgcgtggtagt

SEQ ID NO: 707877 - DNA, 572 bp, Homo sapiens
cttggccagctataggggagccagacttccaagcccttgccatccaccgtggggatgcccaggaggagagggcttttcgggtatcagcagtttaaagattttcaacggcgaattctggtggcgtaccaacctatttggccgaggcatggacatcgagcgggtgaaccttgcttttaattatgacatgcctgaggattctgacacctacctgcatcgggtggccagagcaggccggtttggccccaagggcttggctatcacctttgggtccgatgagaatgatgcccagatcctccatgatgggcagggtcgctttgagggccatattagtgagctgcctgatgagatagacatctcctcctacattgaacagacccgggagaagactcgccccttttggaatgggaccgtctgtccctcaggagaggaccccagggggggggggaaggagacactactgcccccccccctggcagccccccccccatgggttccattttttggatccccccccctcctggacccccctttttgatttggcagaatttttttttaacaaaactaaaaatgga

SEQ ID NO: 707878 - DNA, 160 bp, Homo sapiens
gtgagctgtgattacgctactgcactccagcctgggtgacagagaaagaccctgtctcagaaaaaaaaagaaaaattgagaaagcaatcccttttacgatagctaccccccaaaaaacaaaaaacaaagattatccaggtgtggcggtgggcccctgtga

SEQ ID NO: 707879 - DNA, 358 bp, Homo sapiens
  misc_feature (206)..(206): n is a, c, g, or t
  misc_feature (326)..(326): n is a, c, g, or t
  misc_feature (337)..(337): n is a, c, g, or t
aattatattaattaatataaaaggttacattcatggacctcccaacatcaccacattgaggatcaaatttcaggagggacaaaccacatccaactcatggcagatggtaatggggattgtggttatgttttaacaagtgtattttagagctagatattgaagtatttaaaatgaaatgctgtatctgagatttgcttccatcctcntgtgtgtgtgtgtgtgtgtgtgtgtgtctgtgtgaagtgggtggaggtgaaatgaaataggactggctccattttgataatgggttgagggtgggtgatggacgtttggtgattcattgnattactcctgnctactccttgttgtagtttgg

SEQ ID NO: 707880 - DNA, 154 bp, Homo sapiens
  misc_feature (10)..(10): n is a, c, g, or t
  misc_feature (18)..(18): n is a, c, g, or t
  misc_feature (90)..(90): n is a, c, g, or t
cgcggccgcncgacacgntgcgagaagacgacagaagggcaagggctcctcgaactcctatgccaaagaagaaggacgagctggagcgtntggccaagtccaaccgctgacccagctgctgcccaataaacctgtctgcccggggcagccccag

SEQ ID NO: 707881 - DNA, 229 bp, Homo sapiens
acataaaaaagccatttcttaccttgctatatcatgatagtaatttaatggcagcataatagtacctacaaattgtgccatcctttatattacttctagttgtaagttttctattttgtagctgttaaacctacaaagacacttattatgagcataagcatcctctctataatattcttcagatacatcactctgtagtagaatagatcacaagcgtgcatttatgttt

SEQ ID NO: 707882 - DNA, 110 bp, Homo sapiens
gcggccgcctactactactactactgctcgaattcaagcttctaacgatgtacggggacatggcagagaaaaaaatcataataaaatggctttattttctggaaaaaaaa

SEQ ID NO: 707883 - DNA, 497 bp, Homo sapiens
ttttgtggatgggtcccccacaaattcaaaacaaccgtttgtgacattcccccttggggcctcaaaaaggcagtcccctttattgggaaaaggacaaccctcccgggggttttcaaggggattttggggcagtttcctgccctgtttccccggaaggccctccccccctgggaccccggggaggggatgggcgaaatggggtttccccagggtgaaagccacaagaacgcccttgttttttaggatcacccggccccggatgccccccccaaaaaggaggaggtttttggttaggagggccaaagaggggcctaagggagagccccccctccccccagggttttcagttcccctaaccgttttaatcaaatgcccccttcctttccccccaaaattgggtttggggccccttttttgttttttgtttttttttttggggggggggttaaaaccgggcccgggcccaaggaggggccccaaaaaaacttgtttgttta

SEQ ID NO: 707884 - DNA, 314 bp, Homo sapiens
  misc_feature (307)..(307): n is a, c, g, or t
aatccatgggaactttccctagaaacgctgcccactcctcaaaaggcttcctcaatttcaaaatttgaaaaacttaattctctcccctcttagtttcaaagttgttacagtgttatcctatgtgaagtatgtggaaagttgggggctggggattttcctcccaggcagattaagaaacagctctccgggtcgggcgctgtgctcaggcctgtaatcccagcactttgggaggctgaggcaggagaatcgctcgaacccgggaggcggaggttgcagtgagctgagatcatgccattgcactccgggncctgggc

SEQ ID NO: 707885 - DNA, 80 bp, Homo sapiens
catgagcctgttgcaggtttggtactttagaaatgtaacttttgctcttataattttattttattaaattaaattactgc

SEQ ID NO: 707886 - DNA, 415 bp, Homo sapiens
  misc_feature (13)..(13): n is a, c, g, or t
  misc_feature (42)..(42): n is a, c, g, or t
  misc_feature (48)..(48): n is a, c, g, or t
  misc_feature (98)..(98): n is a, c, g, or t
  misc_feature (197)..(198): n is a, c, g, or t
  misc_feature (263)..(263): n is a, c, g, or t
  misc_feature (296)..(296): n is a, c, g, or t
  misc_feature (333)..(333): n is a, c, g, or t
  misc_feature (403)..(403): n is a, c, g, or t
ccaggcagtgccnttcccggagcgtgccctcgccgctgagcntccccntgaacagcagctgcagcagccatggccccgccatgggtgcccgccatggnttcacgctggcgcccagctggggtgcttcgtgggctccgctttgtcacggcgagggtctccgctggtacgccggccatgcagaagcctcgtggcacccnncccactgggtgcatgggccctgtctggggcacgctctactcagccatggggtacggctcctaccntggtctggaaagaagctgggaggcttcacaganaaggctgtggttccccctgggcctctacactgggcanctggccctgaactgggcatggcccccatcttctttggtgccgacaaatgggctgggcttggtggatctcntgctggtcagtg

SEQ ID NO: 707887 - DNA, 857 bp, Homo sapiens
  misc_feature (443)..(443): n is a, c, g, or t
cattcttggatctcgcagaagaaaaaattcatgtggagtccatggagtaaagtgaaacaagtttgatagagaattaaagaaaaaaatgaatggctactccatagacagagcagcctggttagttgaaaagattaataaaattgataaacctctagccaagctaaccaaaggaaaaaaagagaacacacaaattactaatattataaataaaatagaaccatcatacttatcttgtgggcattgaaaatataataaaggaatagtatgaacaattctatgctacaaatgtgataactaaaatgaaatggactagtgacttgaaagacaccgactatcagaactcacactaggatgaataatttgaacaggcctatatccattaaaaatagagttaataatttccaaaaaagaaagtaccaggctcagatggtttcagtggcatntttctactaattcactggggttttacaaaacatttaaggaaccaatgggtatcaatttctgcaacatcttccagaatatctaagcagagcaaacacttcctaattcattctatgaggccagcattcccctaatatcaaaaccagagatattccaagaagagaacactcatgggccaatatctctcatgaacctagatgcaaaaacctcaaaacagtagcaaattaaccatgtctgccaggaaacatactcttgtgaccttatgagcattgtattgccacgcttttgaaagaattagtctaagcatttaaacattggataactgtaatccattcatattcataaggctcagaaaacaatatgattactcagtcccaatactccttggatcataaaacctttggccacttccaatc

SEQ ID NO: 707888 - DNA, 200 bp, Homo sapiens
gggtagtgggttgctgggctgggctttctgaggtagaggcagcgcaagaagagggcctttccgcctggtcgggatttggatgtcgcgaggacacaagttcgcgtcggccccctttccgagaaggtggacgcgtggataatatatacgcgagacacagtcgcgtgacacagagagatatggggcgccacgcacagccccgg

SEQ ID NO: 707889 - DNA, 329 bp, Homo sapiens
  misc_feature (39)..(39): n is a, c, g, or t
  misc_feature (41)..(41): n is a, c, g, or t
  misc_feature (55)..(55): n is a, c, g, or t
  misc_feature (89)..(89): n is a, c, g, or t
  misc_feature (115)..(115): n is a, c, g, or t
  misc_feature (132)..(132): n is a, c, g, or t
gcctcagggcctttgcacttgttggcctctgtctggaanangcttttcctcaganctgcctgcctcaacttccccaaagtgctgggaanacaggtatgagccactgcgctttaantcttttttttttttttntttttgagatggattttcactcttgtcacctagaatggagtgcaatggctcaatctcggctcactgctatctccacctcccaggttcaagcagttctcctgcctcagctactcaggaggctgaggcaggagaatcacctgaacttaggaggtagagactgaagtgagctgagatcgcagtgtgggtgacagagtact

SEQ ID NO: 707890 - DNA, 485 bp, Homo sapiens
ggggccacggccaaagcagggcctctccccctctgggtttctttttttgcccccaagacaacaggttccaacaaggttttggtttggtggttgattcagccaaaattccccaggggcaacctcgcaaaaggttttttcctcttttaggtggctctgggaaagggaaaaggggaggaaggccaaggggagtttgttttaaaaccccccggtttttacaagaagccggaaaaataaatggccttatttttggtagccaagattaaatggggccttgggagccctcccctttttttcctttccttccacaggaacccgaaaagccaaaccggttcccttttaaggaaaaggttaaaattttttaaataataaagatgatgatgatgatggaaactaagggtttttccaaaggtctttttttcccaaacctttttgggccgggcccggatggattttttttttttaaaaaaagccccaggaccttttga

SEQ ID NO: 707891 - DNA, 410 bp, Homo sapiens
ggtttaatacaaagtagaatagcatatattaatacataaaattattaaaaaggctttatcagtataataatagcatacctaacagtacccctgctccatcccatcctaattctccacgagcaatgacttataaactactatttagcaatgtctatctgtttttttcctcacataacttaagtcatttcattatatatataattatatagtgatattactaggatataaacagataaggatattagctcttacaccatacacaatcttcacttttcctcccatattgtcccagagtagttaccatatttaggggctaagcagtcacatcattatgactgtatacatactgctccttgttgagaaaaacagtgtattatgctcttcctatcctgtacttctttctgccctag

SEQ ID NO: 707892 - DNA, 305 bp, Homo sapiens
tggcccctcttactcccaaaatgctgaggcgggcagatcacttgaggtcaggagttcaagaacagcttggccacatggcaaaaccctgtctctactaaaaatacaaagagcttaccctggcattgtggcgtgcgccgtgtatcccagctacctgggagactgaggcatgaaaatctcttgaacccgggagctggaggttgcagttgagccaagactatgccactgcactccagccttggggagagagcaagactctgtctccaaaatacaaaaaaacaaacaaaaacaagtttccccataacagg

SEQ ID NO: 707893 - DNA, 411 bp, Homo sapiens
agaaagtggtatattaaacggtgcaaaattctgcccatatgaaattactgcaagaagaagaaaaaaagtatcaacagtgctcttcaagtacccccttggtagagggagacgagcttgccagagcttccccaccggactagctccagcagacaccctgacaaacgcttgtcggctccagcctgctaccccaactcccccactctcgaaccctattcgacagcacggctacaaaagctcgaaaccatccgccattatcccagttcctcctcaactgaaaaccaggactgagcaggcttacctaaggagcatctggcagactttgcaggatgtgactcgagtgaaggtatgcatcttgaagtcgtggaaattggagtctgcatagtctggtcttatgttagacctaaaaaaaaa

SEQ ID NO: 707894 - DNA, 1471 bp, Homo sapiens
gacgtggctcgctgctgtagactgcgctggctctttccgctcgttaccactggctgctgcgacctcctcgggctcttctctcctctcttccaaggacaccccccagggcggggttgtcggctccaccctcaccgcgggcagcccacctcgcccggcgctcctgggggctccgctcttcgggtgaccttagttgtttgtcgcccacaccccctttggggggacccttctttaactctgggtgggattccccgtgggaagtctccaccgcgtttaaaagaagggcgcccagttcctcccccccacatatttggaggtgttttctgccccaaggtggtcgccccggccacaccccccaggtccccatgggagccacccgttgacccaacccttggggccccccccctggaaagtccaccccggtgttccaagaaaccaagtttccacggtgaagcctcttggtttctccgaaggggtgccccgtaggaggtccccacaccaagcctgcccacgagtgtgtgctgccccacccctcgccaccccgtcgcgctggaatcgctcaccgctcggctgttcccctcgtttgggaaaggaaggccctttccagcgcaccctggccccacttttgcccacggcccttcccccccccgactttggggaagagctctggggacaccctctggcccttttagcccagcgcccgctctgtgtgcgcagaacactgtacctttggggcgcccctctttgaggtgtgccccccagcgcccagatttgtaacccccggggctggtcacgagggcccctcacgcccctctgtcatccccacgatggccgcgccacggccccctctcgcgccttctctctcgagaacccaccgcgcgcccacagttctctccccccgctctcatcgtgcgctatattattttgtctcgggcgcccttggtgccccccacgcccgccccgcgaggccccccacacactcccccacgcagatgagacacacccacggctataccaacagcgtgggcacagcgccctctatactctctgtgagaaccgcgccgagactccgagggcacagccccctctgaatggcccccctgagaccacgggccacacgcgcgccacgctggcacgcgccctgtcacaatcgcgccgcggagacacaccgcgctaccggcttgaggacctgcactccacaggctgtcacgccacggaagccgggcaccgcggaagaaaacacgggcaccacaggcacacagatgcccgcccacgacactctgaaaggacccacatgtgcacggacatttgccacatgcacgctgaggcacccacgcactggcctgaaggggcctgtcttgtgagctgagaccgcagaggggctgcccacgcacagagccgcacgcctctttcctcccctcagagtcccaccccagacccccccggtgccataataaagccgattttaaacgga

SEQ ID NO: 707895 - DNA, 208 bp, Homo sapiens
  misc_feature (4)..(4): n is a, c, g, or t
  misc_feature (13)..(13): n is a, c, g, or t
tccngaattcccnggtcgacatcatcatcatggatttgctggtgcagtacaactaggcttaatagggacatgcctgtaattccagctacttgagaggcacgagaatcgtttgaacctgggagctggaggttgcagtgagccgagatcatgcctgggcgacacacacagactgtcttaaaaaaaaaacgttagaagcttgaattcgagc

SEQ ID NO: 707896 - DNA, 250 bp, Homo sapiens
ccccctagcacgataatttagagtatgaaatcacctataaaaataacagtaccaagaaattacagaacgtaaaagtgaaagatagtttagcaattggtactaattttggcagtatgagttgtagacttacaccaagtggaaatacttgtaatacaaaccgttctggtgattatcttgaatggagcttgactgggttattaaatccatcagcttcaggtactctgagattttgtgtgtcccaatagtaaat

SEQ ID NO: 707897 - DNA, 1015 bp, Homo sapiens
gaccaaacggaggccagtctagccgtcacttctgatcctggtgcatctctgggcagttgagcaccttcgtcgccatgggctttcctcccccagctccagcctctctcatctagggaactctgcgtcagaagtcactcgcagtccccgttacgcccagaacgaagaccgtacaagcacggctaccacgcacactctccggacgaccttgcaaaccaccagctttgccaggcaaccatgcaagctacctactctccatagccagatgcactccaccagccaagacgcatctcgctggggcactcctgcctgctgctcaggcactcactcacacacatgcacattgggcatgcacgcaccatgcaatccagcacaacataggccacggcgcagcatcgcacaccctctcctgcaaaacctggcctccccatccgcaacccactgacaacccgtaccacgcaccacacccccgcccaccacacacggcacacctgcccaaacgcccaccctgcagcactgcgcaccaccacccaagcccgaagcccacagcgcctcacacacatcctgccgccgccccttgccccaccccctcgcactcccctggccacgcctggccgccagccccccccccccccaccctcccctccaccccctgaccctccgcccacggcctcaccgctcccggctcaccctccttccctccccgcccacccctccgtgggcccccaagcaccgcagccaacccacgggcacgcggcacacatcgccctcccctgggcctcctctgcaccccgtctactaatcccccaacggccgccaacaccccccccacgagggaaccctcacccccacggcacacccccacgcaaggccaaaccgcgacaacgcacggcgaaccgggccgcacacaacggccccacacccaccctggggacgaccccacagcgacacacaccctgcccagagccaaccgccaccgaagctaccccccacacacacagcgccacccgacacaacc

SEQ ID NO: 707898 - DNA, 906 bp, Homo sapiens
ggtcttttaccttccaaacatatgcctgtctcagtcgaataagagctcggttgcctctctgaatggcaagctcaaagatgcagagaaacctgtattattttggaacgatctgtgtatagtgaacgggtatattgttggcatctgaatttgtatgaatctgaatgcatgaattgagacagagtggacaatgtatcaagattggcatgatggatgaatagccaatttgggcaaagccttgaatctggatggaatcgattttatcttgcaagccactccagagacatgcttacatagaatatatttgacggggaagaaatgaggagcaagggattgcctgcttgaactatttagagaagcttcattataagaggatgaaagctgggttcctggaatatggaagactgaaaaccaagttcgatgtatcttgcaagaggtgggctatcttaacactggatgttaatgaagactttgaaagaccaaatattgaaaagtctgggttgagaaggtcaacgagttttgggtacttggtgatccggtgctggagactacaggtcaggccaaaatggtgtccagaatacttcaggtggtgggttatctgtcggaacgttccatattaatattcacggtgtcctttaataaaaaccccaaaggttttaaatctgtcctggggttacgcgacaacacagggatctctggaccgggtccttcttgccagaagtttggggccccgttcatacactttgggtccttttgtgcacaccaggcatttccaggcaaggcacttaattccataagaggaagggtgagggaaggggtcccattcagcaacggctaaaccctatagagaacacgctggaaacccccttggtccacacagtggtgccgggccaccacggggggcgcaaa

SEQ ID NO: 707899 - DNA, 156 bp, Homo sapiens
  misc_feature (4)..(4): n is a, c, g, or t
  misc_feature (13)..(13): n is a, c, g, or t
tccngaattcccnggtcgacatcatcatcatggatttgctggtgcagtacaactaggcttaatagggacatgaaatatcaaagttcacaaactatatattatatactgtacatataatatcaaagtacccaaggtatatattctatactgtacaaa

SEQ ID NO: 707900 - DNA, 416 bp, Homo sapiens
  misc_feature (1)..(1): n is a, c, g, or t
  misc_feature (314)..(314): n is a, c, g, or t
  misc_feature (319)..(319): n is a, c, g, or t
  misc_feature (380)..(380): n is a, c, g, or t
  misc_feature (402)..(402): n is a, c, g, or t
nttgataaccaatattgtctctaaacattgctatatgtccccgcagaggcaaaattgtccctggttcagagccactgatctagggtttcttatcattttttaattttcacagtatttatttttgtggtttgtgatgatcttttattgacagcgggcaaatagaaatttctatattatagaaaataatacctggtttcctttcatgagaaatttaagttaattttaagttaatatgagctatctttatactaaataggcagtctcatcccctgccccctttcccaatattatccatgtgggccctgtgtgtgccnggggntccgtgggtctcctcctttcctagggaccttcttggaggcctctggacttgtttcttcttngggccttcgctggggcctcccntggggataaccccc

SEQ ID NO: 707901 - DNA, 140 bp, Homo sapiens
aattttcccttttttgtttttggaaaaaaaaatggggccaaaaaaaaggccaaataaccaacccgggttttaaaaggggttccaaccctttgtttttaaaccggccctccccaaattaaaaaaaaactttccccccccca

SEQ ID NO: 707902 - DNA, 301 bp, Homo sapiens
aggcacccgccaccatgcccagctcattttatgtagcaaagatggggtttcaccatgtaggccaggctggtctcaaactcctgacctcaggtgatcctgcctcggactcccaaagagctgggcttagcggcatgagccaccgctcctggcctccttttggtgaatctttaatttttaagtttgggctttaccaacacgttctgcattgacgcctccttttcgtcctgacttcctacgacacgcagacactggctgacttcacacgaggcacagattgcagggggactcctctagacgtcac

SEQ ID NO: 707903 - DNA, 341 bp, Homo sapiens
  misc_feature (338)..(338): n is a, c, g, or t
tgtattggtggtgctgccagaatttcactccttcagggctcaatattccctgtgtggagatggcgaagtgcttatcccacttgtcccttcatggacactcggggtgctgccaccttctggctcctgtgaataatgctgctgtgaacattgttgctttgtagcaaattctgaaattgggaaatacaagttctccaactttgttctttttcaagatcatttggctattttgggtcccttgaattcccatgtgaatttattttagcatccgcttgtcaattcttgcacagaagtcatccggaatttttatagggattgcactgaatctgtatatgtttggngag

SEQ ID NO: 707904 - DNA, 824 bp, Homo sapiens
agggctaccagtataccaactcgcgcaatccaagctagcacctgtacgcacgtcgcccattggctctatcagggtctatgctctatactctgaggcccctttcggctacatgtcctactgacaactttggatgctccctctccctgtgtggctactatcccacagcagcgtcctagatcttcagtgcattcgatgctagaagcttctcatgcgacctgtgttaaccctacttggaccaattcatgcatgattggtctgcgtggacaacctacctcggatatctacatggttgcgctggcgacaagacatggtgatcatccggcagtcctccatcggcgggtgcatgaattgctcgtgatgtacctgaacggaacaagtgagaacggtttgtcaggcattttcagtgagcactctggagccgtatcacccgccaccagagtaactaacaacgtgctagaaagctgatctctgaggactgaggatcgggaagccacgggcgtcctactgagcattgatggtgaggatggcattgtccgtatggaccttgatgagcagctcaagatcctcaacctccgcttcctggggaagctcctggaagcctgaagcaggacagggccggtggacttcgtcggatgaagagtgatcctccttccttgcctggcccttggcgtgtgacacaagatctctcctgcagggctaggcggattgttctggatttcctattttgtgtcctcttagttgtccatctatgtccctagcatagtgctcagttggaatgctgagtagagtctgggggaggtaccaaacgtccaggacctcctccg

SEQ ID NO: 707905 - DNA, 883 bp, Homo sapiens
  misc_feature (5)..(5): n is a, c, g, or t
  misc_feature (90)..(90): n is a, c, g, or t
  misc_feature (192)..(192): n is a, c, g, or t
  misc_feature (245)..(245): n is a, c, g, or t
  misc_feature (309)..(309): n is a, c, g, or t
  misc_feature (314)..(314): n is a, c, g, or t
  misc_feature (316)..(316): n is a, c, g, or t
  misc_feature (327)..(327): n is a, c, g, or t
  misc_feature (353)..(353): n is a, c, g, or t
  misc_feature (359)..(359): n is a, c, g, or t
  misc_feature (361)..(361): n is a, c, g, or t
  misc_feature (363)..(363): n is a, c, g, or t
  misc_feature (365)..(365): n is a, c, g, or t
  misc_feature (386)..(386): n is a, c, g, or t
  misc_feature (402)..(402): n is a, c, g, or t
  misc_feature (431)..(431): n is a, c, g, or t
  misc_feature (433)..(433): n is a, c, g, or t
  misc_feature (454)..(454): n is a, c, g, or t
  misc_feature (458)..(458): n is a, c, g, or t
  misc_feature (487)..(487): n is a, c, g, or t
  misc_feature (491)..(491): n is a, c, g, or t
  misc_feature (509)..(509): n is a, c, g, or t
  misc_feature (518)..(518): n is a, c, g, or t
  misc_feature (529)..(529): n is a, c, g, or t
  misc_feature (533)..(533): n is a, c, g, or t
  misc_feature (535)..(535): n is a, c, g, or t
acagntcaacccacaatacaacccgcagacgccaggacgccggccatgtacaacacagaccagttctctccctatgctgccccctccccnacaaggttcctaccagcccagccccagcccccagagctaccaccaggtggcgccaagcccagcaggctaccagaatacccactccccagccagctaccaccntacaccgtcgcccatggcctatcaggctagccccagcccgagccccgttggcnacagtcctatgacacctggagctccctcccctgttgactacaacccacacaccccaaactcaancatcnancaaaactccanctactggttaaccactaacattcaanttaaantncngnacacctacctatatacacagntggtggaacaaacagntatcatccacaatatcacagggggtcatntnctctgtgtacctgaaggacantaanaaggttatcaacatttccagtaaacaccnggancctatcacccccaccaanaacaacaanataaaaataancctnancaaggatcgggaagccacgggcgtcctactgagcattgatggtgaggatggcattgtccgtatggaccttgatgagcagctcaagatcctcaacctccgcttcctggggaagctcctggaagcctgaagcaggacagggccggtggacttcgtcggatgaagagtgatcctccttccttgcctggcccttggcgtgtgacacaagatctctcctgcagggctaggcggattgttctggatttcctattttgtgtcctcttagttgtccatctatgtccctagcatagtgctcagttggaatgctgagtagagtctgggggaggtaccaaacgtccaggacctcctccg

SEQ ID NO: 707906 - DNA, 497 bp, Homo sapiens
  misc_feature (106)..(107): n is a, c, g, or t
  misc_feature (117)..(117): n is a, c, g, or t
  misc_feature (140)..(140): n is a, c, g, or t
  misc_feature (142)..(142): n is a, c, g, or t
gagggcagaaaccttgtttgttttattcaccatcatgtacaagtgcttggcacatagtgggccttcattaatgtttgttgaataaaagagggaagaaggcaagcannaaaccccccncctttttaatgggcccccttttnanccaatttcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattactg

SEQ ID NO: 707907 - DNA, 113 bp, Homo sapiens
tctgcacacttcttcatttggaacctgattgtggacttcacctcatccactttggacaccatgtttgcgttagtgtgtaagcaagggaagggaactttcctgccttatttaaa

SEQ ID NO: 707908 - DNA, 625 bp, Homo sapiens
  misc_feature (19)..(19): n is a, c, g, or t
  misc_feature (77)..(77): n is a, c, g, or t
ctcctctgtggtctgaganaacttcctgtgaggaaagtgacacagtagcctgcatttttcctttcctcacaggaagnctcctctagattactgaggattgcatgcctgcgttgacgagatcgggaatcgaggatcgcgacaattggctaggctagatgcgtggtgagatcagggcttcactgcagcgctcaacctcccagggcgataattaattaccccccacccatccccactgagtagctgggactacaggcatgtcccaccatgctggctgataaattaatgatatttatatcagacagggtctcactgtagtttgcccaggctggtctcaaactcctgggctcaagcagtcctaccgtacctaacagctcccacaagtgtataggcatgaaccaccatgcctggcatgcagcctgacattttcacagtgatgagggccatgtctgagcccacagcctcctttggatcacccagcacggcatctttacaggccttgaagtcaacctcctcatctacagatgaaacagggacagttcgcctctaacactaaccgatctagaaaacatgtaccgatgccagacactgcttgacgcacatgctttaactcataatcacccttacg

SEQ ID NO: 707909 - DNA, 109 bp, Homo sapiens
acgcacctatgtcgtcacgtggtgcatcttctcgtctcttcaactccagagggatttccgacaagtgtccgctgcctctacattactccttggcctcgccatatgcaac

SEQ ID NO: 707910 - DNA, 554 bp, Homo sapiens
ctgctgcataatattcataatatgcattttagaataaatgtatccgtactcattatttagaggatgaaaaattacaatcattccactgaactggaagttaagacagccacccagccactttgggctcctcacacctctgaatcaataggcaaggaagggagttacagtgttggctggggtaattgatcctgcccaagaggaactggaactgctacacaatggaggtaaggaggagtatgtctggcttaaggagatcccttaggacatctctgtaccctgccctgtgattacagtcgataaaaatgacaacaatccatacaggactatgaatggcccacacccctgaagaatgaaggtctgggtcaccccaccaggtaaaccacgatcagcttgcgagatgagtgcaaagggaatacagaatgggtagtggaaagaggcaaccatgaataccagcaaccaccatgtgaccagctacagaaacgaggactgtaattgttgtatttcttgttttgttacgaatgttttggtgtgaatatctatatatagatatataa

SEQ ID NO: 707911 - DNA, 382 bp, Homo sapiens
  misc_feature (206)..(206): n is a, c, g, or t
  misc_feature (216)..(216): n is a, c, g, or t
  misc_feature (218)..(218): n is a, c, g, or t
  misc_feature (244)..(244): n is a, c, g, or t
  misc_feature (252)..(252): n is a, c, g, or t
  misc_feature (256)..(256): n is a, c, g, or t
ttgcaagataaaaagtcctgtggattggttgcacagttaagttatgtgaatgctgtatgccaactcaactgtacactctaaaatggttaagatggtaaatcttatctttattttaccacagttttttttaaagcatggtaaacaccatttcccaggatgtaaatcggtactaaaaaaaaatgcttccaaatcaaaaaaaattgggnaaacacaggnanaattagagttgaaagagtgttctttnatggcagnaatntaagaagcattacacaaattaatttacactgggaattttcagtgtggagggtctggctcatagcatttcacaaacattatacttcagagtcccaaagcctttaaataaaatgttaaaggtagaaaa

SEQ ID NO: 707912 - DNA, 383 bp, Homo sapiens
cacgactccttctgtcatgatcgaaagcttccgtgaggcgtcacagaagcagtgctatgcgtagcaccatgcttcctgtacagcccccagaagcatgtaaatatcttttctttatgaagttgacccagcctcacatatttctttatagcaacactagattgggctaacacatccctttctccctccctccctccctccctccttccttccttccttccttccgttcctcagcaaccagctcggttggggcctaccatggggcaaggctttggagcttaaaaagactagagctgcggtgacagtcctcaggaatttacctgtccatgatgcaaatagagaagctggacatcaccatgcagtgtggcagtggcagacgctgcagt

SEQ ID NO: 707913 - DNA, 468 bp, Homo sapiens
tcaatgaagtgtaagctccttgagagcaaggacccatcatctaaaatcctgtgttagcagagtcctgaacacagagaaacaaagatgttgtcaaacgaccatggattgcaagtcaggccaactgtgttcagattccaggtctacctatttgatatctggaaagtgacttaatcttccagaactttagttttatgatccgtaataaaacatgtcaaataaatataatgtatcgtgtgaattaagattttgtaaatactttttttttaaagccataaacggatcatctctctcttgccaaacttcaagcacggaatactgtcttgtgaggggcagctggcatatgaacatatttccagattctttagtggttttccttataatcctaccagcagcctccagataattttcctatctccttcactcacaaccaaagcctgaatcaatatctcttctgccatctccatatgg

SEQ ID NO: 707914 - DNA, 701 bp, Homo sapiens
cgcgcttgacccagcaccaggctcgcgggggtccgcgagggtctcgcgtagccgcgcgcccagagacccccgccgcggcccgattctctgagcgccagacatgaaccgcaagaaactgcagaagctgacggacaccttaaccaaaaattgcaagcattgtaagtaagaatgtagtgctggacaggccgaggctcctggaccgagcctgggtcccaccccgtgctaaggtccgctgttgtgcctgcttcccgcctgctgggactctgtgggctacctaccgcccctccaccccggccccttaagcagaagtcagagagggaatcccggggtgccagctccttgcgtttgatcttaggaacccaggcctccgcctctggtgctacctacactctcacacatgcatatacttgcttcttccaaccctctttcttttacctgatagaaacatgtgatgttagcctcactgaggtgtaccataaatgctatagccacgtggtctcatgaaaatgtacacaccaaggtagacggtgcctcaccaggctaatactcgcagttccccggaggtcaggttatggagctaccaagagaccatatgaaaacggtgtcatttccccatcttcgctactgggcctactttgctcgacacttggtggccagtcgccctaccgggtcagggtccagtgatcctcaggccggttggt

SEQ ID NO: 707915 - DNA, 258 bp, Homo sapiens
  misc_feature (20)..(20): n is a, c, g, or t
cgagccggtccgctgcggcntagtgaacgtcacactcttggtgagaggcagtctggtggggtggcagtgtgcttggagttcttgagggattccctgggcttctccatgccttgtgttcgtccagaggctggagccgaggtccacagagtctctgtgttgaatcgtgagctggccatttccgaagccctgcctggccaggttttcgggatgtggagagagtgaggccggtgctgatgcgttcacttaatgccgctagcg

SEQ ID NO: 707916 - DNA, 99 bp, Homo sapiens
ggacgcgtgggtcgcggacgcgtgggtcgacccacgcggtcggaggagtacgcgcgctacgacagcgacgtgggggagtaccgggcggtgacggagctg

SEQ ID NO: 707917 - DNA, 319 bp, Homo sapiens
  misc_feature (108)..(108): n is a, c, g, or t
tctagaggatctctacaccaactctgtgggtatgttcttaaaatccatggagggagaggatgaaattactgccaatatcgcagagggtggacaccctttcttggatantgttcctaatatccgcgggagagcatgatattaatcccaatatcgctgtatacacccctttttgatattgttcctaatatcccttgggggaggggagtctctattactggcaatatcacagggtgtgtacacccgcccctgtgatattgttcctaaaaactagtgagggagcacatgatattacttctgctatcgcaactggtacggcggg

SEQ ID NO: 707918 - DNA, 285 bp, Homo sapiens
gcggaacagtcaaagacgaactaactgacttggatcaatcacatgtgactgaggaaactatcctaaatatatatccaccaaatacgggagcaccagattcaaaaagcaagttcttagggacctagaaagagacttagactcccacacaataatagtgggagactttaacaccccactgtcaatattagacagatcaccaagacagaaaataaacaaggatattcaggacttgaattcagctctggaccatgcagacctaatagacaccttcagaactctcaattc

SEQ ID NO: 707919 - DNA, 164 bp, Homo sapiens
cacagaaggagactggatcagtatggagacaagcatatgtctgtcaagatagtattcagtatgttgtctgaaagaaaaacagcggataatgctgttagaacgaacattgcaattgaaagaagaagaaaataaacggttaaatcaaagactgatgtctcagcagc

SEQ ID NO: 707920 - DNA, 499 bp, Homo sapiens
gggtgtggctgtggctgtggctgtctggcttcccttctattgatacctctggcagcctttgagggatgagagggcgtgggggtttccactgcaaacatgagggagtaggttgagtgcttcgttgttgaggtgagcttccctgatggggttgaaccctgtatatcagaaagaagcccaaccacccttttgctatttcatagtgaagcattgcattgaatctcctggagcagacataaatgaatgttgtggctctggagtggtaaaagagattgcaaacaaacagtcttcatatctcctgggggtgctttttactgagctaacatagctaagctggaaatgtgttttctagtattccattctctgtgtgttgctggccacaaagagacttgtgtgtctaagtcttggaagatgtaagagaaggagctgccattttgtgtgctctgaggtgggtaaagggcaccagatgctgtggcagctcacacaggtctgtcatctgcta

SEQ ID NO: 707921 - DNA, 216 bp, Homo sapiens
gggccagccataaaaaaaccatttagaggtttttgtttatcagggccggagttgggaacccccctgggggatgtgaaggggttttggggctttgaaagaccttatcctctaggctttggttatttttcccttgaaggtccaggcccaggttaaagggttggccggtttaaagcttttccccccccttttaaaaaaaagatttaaaaggggttttga

SEQ ID NO: 707922 - DNA, 422 bp, Homo sapiens
gccatttactttaactgacactatttaaaatcttaatctaatatggtttgaaaaaatatggtgtttgcatgttctcactcataagtgggagttgaacaatgagaacacatggacacagggtggggaacatcacacaccagagcctgtcagggggtcagggactaggggagggagagcattaggagaaatacctaatgtagatgatgggttgatgggtgcagcaaaccatcatggcacgtgtatatgtatgtaacaaacctgcatgttctgcacatgtatcccagaacttaaagtataatgatatgtgtgtgtatgtgtatatatatatgtgtatatatatgtgtgtgtatatatatatatgtgtgtgtgtgtgtatatatatatatatatatatatatatatatatatatatacattcctag

SEQ ID NO: 707923 - DNA, 1588 bp, Homo sapiens
tgtggcaaaaaaaaaaaagttttttatcctcgaaacaaaagggggggtccagctccaaaacacacctctttctccctctcctctctctctccgcggcttcagaaccgcgggccaccgaggtgtagaagcgaaacgagtgtgtgtagaacgccccgctggcgaggtgtgtgtaaagagagttaccagagagacaccccgcgaggttgagtgggaagaggctgtgccgagagagagagttggggggtggtgtctccctctcaccgagagagtggagagagatgaagagtgtgaaagagaacatataaatctcgaggggagcactataagaggcgcgcgcgagagcgcgagagacgagagagatggacgagagaaggtgagtctcccgagtgagcgtgtgggctctcgagaagggtgtggcgcgtgtgtcgcctctctctgctgtgagagcgcctatatgagtgtctctcctctctatctgctgtgcgacaaagatgtggaaagacagagtcatccagcgtctcttacctcacatctcagagtggcgcccaacagagagtgtgtggaaggtctcttgtgtcacgagtctctccgcgataacaagaggggcgcctctataaacgagcgggggggacccgcgtggccctctctctccagaagcccgcgcgtgagacgctgtgtgttctctcacgacggttgtggcccgcgtgtgcgtgtttttcctctctgaggagagatgttgtagtggggttttctctcgtagtgagtctgtgatgagagttgaccctttctcactctctgtgtgagcgacctgtgtgtgccgccaccacaccccctctctcctccagggggggggggcgtgtcgtccctcgtgtggcgacgagcagtgtgtcgtcacagggacgtcgtcacacaacgaagtgggataacacacgaggtagtagtggagaagcaagaggaggaagaagaaggaacaacaccactccttggcaggcgccagccggatctgcgtggcggcagaacagctgtggcggagaaggcgggggtcgcccacccccccccgacgccggtggtaggtgcatcacctcacaaagacgagtccttgcaccgccgcaggaaggagcaccgccgttgctgacaaaaacgagttgtgtaaaaagaacaccctctgcgggtgggggacggcggacgggccaatattaacaaacacccgcccaatgggtgtgcccccccacggatcgtggtagttaccctccccggaaggaaataaaaagcacccgcccaacagcagatgacccgccggtagtcataaccccacaacaaggcggggaccaacacctacgcgacgacagccggacgcggtcgggacaacaccagacgccggccaccccacagggaggggagttgctaacaaaagacatacaagaaacacaggcgcgccctggtacgatcacctagcgagtacaccctgagccagatggtgagaagacgccccccgacctacgcacgaggcaagcgggagataatcacaaagcgggcggcaccaacaagacggaggcgaccatgccacccttgtagggcagcccccccg

SEQ ID NO: 707924 - DNA, 368 bp, Homo sapiens
  misc_feature (49)..(49): n is a, c, g, or t
  misc_feature (94)..(94): n is a, c, g, or t
  misc_feature (96)..(96): n is a, c, g, or t
  misc_feature (102)..(102): n is a, c, g, or t
  misc_feature (181)..(181): n is a, c, g, or t
  misc_feature (193)..(193): n is a, c, g, or t
  misc_feature (212)..(212): n is a, c, g, or t
  misc_feature (241)..(241): n is a, c, g, or t
  misc_feature (336)..(336): n is a, c, g, or t
  misc_feature (339)..(339): n is a, c, g, or t
ggtggggtagttgaataaaattgggcagctaaatttttcagttccatgngcctcccaaataaaaaacagaaaataagtagtttttgtgaattgncntgcagncaaagtagaaactgtgctgcatgatgttattttgtaaacaaatgacattttttggccaggcacatgccatccaattttntgtcaatccccntgttgtataaagcaccaanactgaaggggaaaaatgattgttgtaacncctgaattgctttgcataggttctacatgttgaggagtaattgaggtgtaaagatatcactgcactttctcttagtattttggcaaacatcaganatntattatgagaaaaagatgaaacaaaaaga

SEQ ID NO: 707925 - DNA, 320 bp, Homo sapiens
  misc_feature (49)..(49): n is a, c, g, or t
  misc_feature (94)..(94): n is a, c, g, or t
  misc_feature (96)..(96): n is a, c, g, or t
  misc_feature (102)..(102): n is a, c, g, or t
  misc_feature (181)..(181): n is a, c, g, or t
  misc_feature (193)..(193): n is a, c, g, or t
  misc_feature (212)..(212): n is a, c, g, or t
  misc_feature (241)..(241): n is a, c, g, or t
ggtggggtagttgaataaaattgggcagctaaatttttcagttccatgngcctcccaaataaaaaacagaaaataagtagtttttgtgaattgncntgcagncaaagtagaaactgtgctgcatgatgttattttgtaaacaaatgacattttttggccaggcacatgccatccaattttntgtcaatccccntgttgtataaagcaccaanactgaaggggaaaaatgattgttgtaacncctgaattgctttgcatggtctcatttgaaaaaattgatgtaaaaatcccgacttttttatatttgggaccctccaata

SEQ ID NO: 707926 - DNA, 419 bp, Homo sapiens
gcgagaagaaattgcaggctttcccacaatggtcctagtatagggaatacagttactctgcttgttgattttgtatcagcaagtcatcaaaaaagtaatgtacatgttgtagaatatattataatatgagaaaatattctgtaagaggtgtagagcgtaaaaaaagcaagttacaggccaggcgccatggcttgtgccctgtaatcccagcactttgggcaggttgaggcaggcagattattctgacctcaggagttctgagaccagcctggccaacatggtgaaactcagtctctactaaaaaaatacaaaattagctgggtgtggtagtgcatgcctgtaatcccagctactcgggaggctgaggctggaggatcgcttgagttcaggagttctgggctgtagtgcgctatgccgat

SEQ ID NO: 707927 - DNA, 109 bp, Homo sapiens
tgggcacttgttaccagagtccttccctgagccgatggctcctggctgctgtggcccatgcacagtccctggtagaagcacagcccaacgtggacaagctcgtggagga

SEQ ID NO: 707928 - DNA, 573 bp, Homo sapiens
tgaacgaggtatctggcaacgccgctattgggaacacctgattcgggacgaagcggattttcgtgcgcacaggtagattatgttcatatcaatccgatgaaacatggcttggttaaacgcgtggcagactggccgcattcaacgtttcatcatttggtggagcaaggcgtttatccgaaggactgggcgggcggtgatgaaacagcattggattactccgattgacattcggcgcaatgcccttcggttattgcgccctactgcactctcccacccgccggaggcaagcccacctcagggcacgcttctctctatatcaccttaatcacaccagtcttgcgtaactttgtcacggaagaaatgttctgaatatgatttattagccacgtggtgaaaatggtttcgaaggccatgaagaagcgcgtggacaccgcagacacaataaccttttagggaaaagagcaggaatgaagaattagcaaataacagggatggctaaactgtaaatcccgcgcacagcggcgcggaaggagcgagtcatgaagtctcgaatcgctatgcttggtgcggccg

SEQ ID NO: 707929 - DNA, 90 bp, Homo sapiens
taggggtcccgggggccttttttttttgcttttggttttttttttgggggcctttttcttccggggtttaatgggtgttttttttcgggg

SEQ ID NO: 707930 - DNA, 394 bp, Homo sapiens
cttcaaatcaaaacgtgactattgtgggatgtgcatatctgtcgtgcccgtacattgcagcaattgttgacaactgtatccgtagacaatgatcggtctgtaaggttgaatcaaaacaaaacccacaaacagctgtatttatatatctcaatattacataaaaagctgttagtgctgttaaaacttttaccattaaaggactgaataagagcacattgtagcagactgtgaccaaacttattctaggggcatgcgtgctatcaattgatgtcactttgtcactcataacggcaatacctggtacttgtaaattctacaaatcgcctcccactattgccatattcatagtaaaaaacaaacgagactacccaggtactcgagctaccgagctcta

SEQ ID NO: 707931 - DNA, 908 bp, Homo sapiens
gctctccaggcgtcctcgtggaagtgacatcgtctttaaaccctgcgtggctatccctgacgcaccgccgtgatgcccagcggaagacagggcgacctggaagtccaactacttccttaagatcatccaaactattgcgtatgattatccgataatgtttcattgtgtggagcagaccatgtggcgctccaagtcacgtatgcatgccagatccggcatgtccctctcgcagggcaaggctgttggtgctgatggggcaaagaacaccatgatgcgcaaggtcatccgagggcacctgggaaaacaaaccagctctgtgagtacatgtgctgcctccatatcctggtgggctctgctcggtgcctttgtgcttctcctccgaggacctctctgagatcgcggacatggttgcgtggccgagctaggggtgccatcctgcctcgtgccgtgctggctggcctgtctgccccgttgtgtaggcgctgtggtcctgtgcctagaagacgacctggtcttgcgtgcccgcgatcatcgaatcctcgcttccccgggcttaaccgtttcagcagtatcatctccagtggcttcaccgtggtgaaatcctgtaggtggatgtcgcacggcctgaatcaagaatggagacaaagtgggagccagcgaagccacggctgctgaacatgctcaaaatctcccccttctccttttgggccggtcactccagcaggtgttcgaccaatggcagcatctacaccctgaagtgcttgatatcacacgaggaaacgtctgcttctcgcttcctggagggtgtccgcatgttgcccgttgttctgtcctgccagattgggtacccagagtgttgcatcagttaccccattccattcgtccacggggtactacgagttctggct

SEQ ID NO: 707932 - DNA, 285 bp, Homo sapiens
cggccgatcgttgtttattgtaagatagtcaacaaatatcttgctgcacttcagtatttcagatcatggaggaaccgtgtgctctttgcccacaaaggccgcatgtaagccaacatctaaatcaggtggcctgaatcttccttctttacctcttgtatggaagatggagctgagatcttattaatacgaagctgcagccccagcatataatgtcaatcggctcttttgagatgacagcttgtcatgtactgttgaatgtcaatgcctatttggcaatcatctaaa

SEQ ID NO: 707933 - DNA, 271 bp, Homo sapiens
agaatgatgggggggcatcagctgttggaaacctgggcagccctctcagtggcttcctatcctccttcttgctggagccatgaattgcaggagctcagtgcttcttgtgcagtgcctggaacccaggtatcttacttggggtcttacttgtacccttacaatctctgaggaacccagacctcctgcctgccagggtgaaggggtttggggggcaggagaaccagttgctctgaggagctggtttcctaggcagccacccttttctgttcaa

SEQ ID NO: 707934 - DNA, 215 bp, Homo sapiens
gatgtttgttagaccagaaagtagtcgtagtcgattctgttagctacagattccccagacaggctgcattaggtagctggaggtagtgctggcttacagtgatgtgccaccttcgcgtgcactttaactatatgccaccttgcgtgcagagggctcacgcacgtgttgggccctctcatgcgaggcacgggtgcgcgtatgttcaccgcgacacc

SEQ ID NO: 707935 - DNA, 238 bp, Homo sapiens
gcatgtagagttgctcagtgtagtgtagagactgctctatgttaacactccgccacagaaaaacgtccagaattgttcccattagtatttggtccgaaccgtccaaacggcaccaaatatggtttattaattggagtccgtatctctgggttgccggtttctattaaacaggcttgccaatggtttccaaacttaggtagaataataacttgaatttctggtggccgatggtccgact

SEQ ID NO: 707936 - DNA, 213 bp, Homo sapiens
tcatctagcaggacttaacgcacttggacagtgcagttatcctagctgtgtatcgctcagattagttcagtgttagtagcagagaccacaataagtgattaaacatgacagaagtggattaaagtggtgtgctcacacagtcctcagggctggagcttccatttctaattctatcccttggtttggtctaatttacattccagttgcgtgtga

SEQ ID NO: 707937 - DNA, 136 bp, Homo sapiens
gtccggcgcggcgccgcacagtgccccccgtggtcgctggggatcaccttccggtcgggcggccagagggaggcggaggcgtccatcaacctcaaggccattaacacgtgctccctgaatggcgcccaaggggtac

SEQ ID NO: 707938 - DNA, 816 bp, Homo sapiens
tgcatggagtggccagccactgggcttcagagccaaacaaacctgggctcaaagcccagccctgcccccctgttgtgtgatgtccaggacagtggtgctagtagttgatgtgctcatctgccccacctctgcctggctgtactcgcagctagtacatgtatagtatataagtgcccgactgtatcattgtatgttccagagtggtcagggtcagggtggtcatggctgagctttttttttttttttttgtggagtcctcgtgtgtgcccaggctggagttcgcggggccccattcacgacttcatgtgaagcctcaaattttccttccggccttaaggtgatctaccgtgcctcagcctccgtgagttagcggggactcacagaccgtggaccaccaagccgggctaattttacacacttttttgtaacacagtggggggggctcggggggctctgttgcccaggcgggtctcgagctcgtgggcctcaggttgattccacctgcctgtggggcgggagataccggttggtgacaccattcaaacccaagcttcccttgagctttatatacaaaactcgtccttaggagtaaggtccgggaagatatgtcaagtagggggcataattttgggtttctcaacaaattcctcatcactcccggaatgaataacccaatgtgggcgtaccttcctacccgggacaccagatctccggattaaacagtctgctggggcgaaggtggagagggaacaggggtccacaaacacggcaatgatatgacactcgtgtgtagacaacgccaggggggcacactga

SEQ ID NO: 707939 - DNA, 540 bp, Homo sapiens
ccctcctcttggccagggcactccaaagttaacctgaaaaaccggttcaggctgtgaagagaaggtggagtggacatgcctcatttatgtcctcctcccttttggaattcagcaaagctgaccagcatgaacattaacacagaccttaagtctgattagtggcatttacaatctatactctctgaagcgtgctacctggagtcttcctttgcatgataaaactttggtctccacaaccccttatcataacctagacactcctttctagtgataataactctttcaaccaattgccaataaaaaaattttgaatctacctataacctggaacctccccgctccaccttcgagttgtcctaccattctggacagaagcaatgtggatcttgcatgtatttgattgatgtctcatgtctccctaaaatgtatacaattaggctgtgcccagatcaccctgggcacatgttctcaggccctcctgaggtctctgtctcgggccattggtcactcagattcggctcagaataaatctcttcaaat

SEQ ID NO: 707940 - DNA, 358 bp, Homo sapiens
ttaggtcagcacctctttctaccttactcctttcagggatgttatatcatgcatttgtaacagttaagattcttttgtcactgtttgcattgcatcctggtatcccccaacctcctaattgattgtttaaaattttgcatacatcaggttcactttttgtgcacttctgtggggttttgataagtgcataatgtcatgtatccaccactatagtattatggcaggaacagtttcaccaccctaaaatatcccttgttttaccctacttcaatccccttccacttctttccggaaactttggggtaaccacttatttctggtttttctggttcttggataacttttggcttttttctag

SEQ ID NO: 707941 - DNA, 315 bp, Homo sapiens
  misc_feature (203)..(203): n is a, c, g, or t
atgaggttgcagctgctgtggtcgccttggtgtacaccacaatggctgagcactttctgacgttgctggtagttggcctgccaatcagagaaagattaatggttcccacggaagacttcactcaagtgtggaacacacaccatgaaatgggctcaacgtgctgtaggcttcacccaactattacggatttttgaggactcacncctacttcaaagaagaacatgtgccttttccccccaattctggttgcaattgaacaacgttacccaaacacagagcctgctcaaacaacaagctgggggtacccgagctcga

SEQ ID NO: 707942 - DNA, 333 bp, Homo sapiens
acaagtctgaagaccagtccacctttatatctcatgagattttattctgtgacaagtcaagaatgatgtctctattttagaagctaagggtattctctaaatctgattctgtgtaagcagtatcaaaccaacttagaaatttcacaattatgaaagcagtttacacccatgtggtcccaggagcctctgggaccaggcagaatcatggaagggtcaaaggtacacagttaaagggctgaaggtgagtctataattcactaattcaaaagtttagttaattgacctcaaagtatttatagagtttccttagtgacccttgcctcgtaaaagctg

SEQ ID NO: 707943 - DNA, 353 bp, Homo sapiens
taatatgtcatctttgctttgtttattggcgtatgttaaaaatcaagttctagtccagttgcgtggctcgtgtccgtaatcccagcacttggagaggctgagcaagccgattgcttgagttcaggagttggagaccagcctgagcaacaaagtgagatcccatctctacaaaaaatacaaaaataactagccaggcatggtggttcacacttgtagttacagctacctgggagactgaggagggataatcgcttgagcacaggaggtcaaggctgcagtgtgccatgatcatgccactgcgctccagcctgggtgacagagcaagaccttatcttaaaagataaaattatatt

SEQ ID NO: 707944 - DNA, 908 bp, Homo sapiens
tccccctgtagggtgccacaaataccctccgcccccccccagattttttgttttcccaccaaaaagaggtacagtccacaccgtttagaaacgttgtgggtgggccccccgcacaaaacccacgccccggtggtggtcctaccaacataccccacaccacgcgtttattcttttaaacggaccccccatgagttctttattttcaagccgcccacctttttctcccagaacatctgtgttgaacacactttaagctcctctaataaattgttttcccgaaaaaacgtgggacacacacaaacaccgttgccattatacaacggctctcccatgcgacagcccctggtccacacgccccctgggcaaattaccataataaggtggtttttttgagaaccccccccctttcaagtggagagagcctttctctctttaacattctggggctccacgacatatatatacaggtggccaatagctactcataatgcgccccccttatcggggagatccacccccacgctgtgtgcgctaataacaaaagtggtgttctctatcctcatgggtgcccacaagagatgagccgccaacaattatcttttgtggtgcgcccaaagagcattaattccacaaaaatacttttttcccgcgattaccacaatgactacggaaccacccccttattactgccaccatataagaccaccttagaacgttttcacccccgtttataaaaaccgcgagggaattttctttctccaaaccaccagttctctcttgtaagcagtttatatgctaatgcgataccccaccacgttcaacaataattgctggccacgtttcttagacaacacatttatcttcattcaatgcacccccaaaaataaatttctttctcccacataaca

SEQ ID NO: 707945 - DNA, 884 bp, Homo sapiens
  misc_feature (1)..(1): n is a, c, g, or t
  misc_feature (270)..(270): n is a, c, g, or t
  misc_feature (692)..(692): n is a, c, g, or t
ntccatgggagactactgagagggaggcaaaaagagatgtgggtcccgcccgcccgtcgtggtgggggtgaaaatagactgtgtcggagagagagtgcggcgcccccgctagatcatttcttgtgagagacctgtcgtgggggggtagcagccgcccctccgttgcctggtggataaagtagagggttcgctctcgcgcgcacagcacgcacacagaagggtgttgttgagaagagagtcttctctcgacgacgacacggatcgaccacnccctccggtgggctacgcaactcttgtcgctagtttgtctggggagatatgatggagggagcgaggaccacacacgttcgtgcggaggggggggtgagttcacacgacagagcacaacggtgggaggcacgcagagagagagggcttgtcgtgggggggacgcgggcatcaaggggctaacaacacagatgtggtcgccaccgaaaagagcgctctcagagagaggggctcgcaaatagggcatatgtatgatcctcccgtataagtctcctcgcgccccccccaccgccgctgtcatatcacatgtgtgggacagcaacgcgttctctcagaatcgcttgttgtgttcttctcagtgtggccgatcatttgagagtttgttagttaggtataatagagacgcgggtatagatgagaacacncacaagcatgttggggataccttcctcacagacaggaagaggagaaaatattttgttgtgaaccccctcggatttttttttttggcgtgtggccacgtgtttaattttttttttttaaaccccttttttttggggaccactggcccccaaattttccccagagtttggggcccccttaaaaagttaatagga

SEQ ID NO: 707946 - DNA, 895 bp, Homo sapiens
  misc_feature (231)..(231): n is a, c, g, or t
gttttagcccaaaacttcgcggccaaaaatccctctctaaaaacctttctaaatagaaaataacctctcctataaccctccttaaccttaaccccacccgtttcaccccggcctatcaaaattatacaagccgtccgttgtttaataaaacgatgctccttatagccttactacttctcttggccccccccccctcttgaaccgcccgggcatttaaaggttttttaagcnccgccctatttgcaggcctcatttttccttatttatacttgtcccaagaagtactattcataatgctgggaagccccgctcccataaattgccgcgcccccttgcacaattgaatgatgtgtgtctgtatatggagaaaaacttcagggaggtccaccttgatggacccacaaaacaccctttgttgggaggggcccccacgaccagcaaaaacctcctctggggggtcccccctaagtggactagttgtgtgcgccatagctgcatgccagcccacgaggggccccccctagtccccccggacttgtctttagcccacctcccctccccttagaggagcttttagccttctgaaacacccacactgtgccacaagccacaccatgggccgagaaaacacacaccacgtgcgcggagtagaaagggatgccatttggggagttatatgtcccaccgggcctcttggacatactacataggttgtccccgaactagtcgaccttgtccacaaatacagcttgagccatgaccccctttatctttttttttcaaatcctccagcacccccctctgaacaattttttcgacattctcttgtgaactgccattgcatttacccggtggtgtcaaaaccgttatatgaaaacttacccttccccaaaac

SEQ ID NO: 707947 - DNA, 381 bp, Homo sapiens
ggcgatgggccgtagacatgcgcacctcacacagtgacatgaagctcgagaggagacaccctcacttacgtgattatgctctccgacaacgagcagacctcgaagccgagagtgaataggctgaacacggtggcctttaaggagaatagcaacgagggcctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaaggccacaggttctgttgggagcaccgggagcaacccttccccgcttgttcggggcactcagaacattcctgctgggaagccatca

SEQ ID NO: 707948 - DNA, 252 bp, Homo sapiens
ggggcccccccccccccccgggtaattttttggattttttggaaagacgggggttccccctgtgggcccggaggggtttgatttcccccccctgggatttgccccccccggcccccccaagggtggggattacaggggtccccccccgggccgggggggggggctttttagggaaaacccaaaaaagggtttttttggggggggatcccccgggaaagaggcgggaaaggggaaaaaaaattgttcttttta

SEQ ID NO: 707949 - DNA, 133 bp, Homo sapiens
ttaccttgcagtcgtctcagctctgagctctagagccgatcagatatacagacgttcttacttggaaaacactttgggaccagaaatgttattgaaagatgtctaaactaagagtcaatagggggacgggcat

SEQ ID NO: 707950 - DNA, 870 bp, Homo sapiens
tggaaaccaagtttcataaagtttttactgggaacaaaaaatgtttttacaaaatatctttccaaagaaaatttccccatagaagtcacaattaatccagtgtagctttctctccttaagagaattcacggttagtgcactttcaggaggggcgaggttctctggatatagccaactagccgcggcaaaacctacaagaagaaagttaacttttttgtcaaaagggtgcctttaacatgtggtgaacgccgagttacagtgctacatgggtggaaaatctaattgggacatttttcttaacaacattttccttgttacacaagtgggtgctccaaatatgttgggcttgtgtccacaaattaactcaccaagggcgttggcaacaaataaacgtggccgtggtacattatagagctttgtgaaaaccaaacaaaaacaccaaagtggcgatttattgaacccgcgtatattccccttgtgggcacaagaggtcactatcttccgaaactagtggttcgtgtccccaacgggggctttcccattaaagagggggccaaaacttttagaagaaataattacgcagaaggtggtgttgtgggaccgaggtttattttccagggcagaaacattttcacccacaaacaccaacagcctgggagatattttttacaacggggtcattttcacacaaacccacggttcaaaaccccctgtgagaagttgtactgcttctccaaaatattatcccccacccgggggggtaaaggggggggttaacacaggaaaatcttttggctcggccaacaatcgtggtacaacctcccaagggaaattaccccttttaatttcttccaacacgcttacgccgtt

SEQ ID NO: 707951 - DNA, 181 bp, Homo sapiens
aagcttggtgaaaaagaagaaacattctcctgacttatagattagaacaggtcgaggataagatggaatagccactcctggacaaaagagatctataatgaacagtcttccaccctattgagtgaagacttccttctggatgctttgtctgaagacttctctggtccacaaaatgcttcat

SEQ ID NO: 707952 - DNA, 114 bp, Homo sapiens
ggaaagatcaaagaaaggctgacactggaaaatgggtttttgcactgttttttttttggtttttttgttcttttttgtttttttcctttaaaataaaaacaaagaaaagctctg

SEQ ID NO: 707953 - DNA, 1081 bp, Homo sapiens
  misc_feature (520)..(520): n is a, c, g, or t
  misc_feature (633)..(633): n is a, c, g, or t
  misc_feature (813)..(813): n is a, c, g, or t
  misc_feature (911)..(911): n is a, c, g, or t
tagtatgagagtagaagtggagaagtcaattaatgtgatgcgatgagacagtgagtagctgtagatggtggaagcgcggcggtatgtcgcgcggagggatgaatagatcatggaagatgagtggtgagatctgatgtcgagagtggctaaatcgtagatctcgcttcgatacatcaagatgaggcgtacgtcatcgtatgaatgcgctgcaggtccaggtagcaaagaatgatcatcgaacgacgctgctcgcaccgtgcaagcaaccagtgaaaccgataatcatagagccatccccataacctaatatagatatagtacagtctaggctataaatacaggcacgagggttaaaggtagacagagtagggaggctagaacactagtagaagtaccatagtaggcttaccgcactagccctatactagtagggcgggggagggctagcactagtacctacaacatacatagtataggactagtagacaagaccgccacaccctaggtagcacatatacangctagagctaggataggacagtagaaggaaagcctagtacctaacaggccataatatagctacaggctacaggacaaaggcctacaggtacgtaggggccagctactagacanggatagtaggagtaggccaggaccaagacagcaagctaacgcaatatagcagccacccggccgccaaggcaggctatagggctagggccaggacacgtaggggtagcctagggacgctagctatagccatagcacagtagatacagagagaggctaggggtagtagtacctagtaccggngaccccccctagcctatacctagctacaccctaactactagacctacctatacacgtagcccaggcctagtagggtaagtaggggaagggctagaacnaggacaacctactacatacacccccactatatatagtaacctatacctagctaggggctagcctacgtagcaagaggacacagtagtaacggggccatagcagcctaggcgtaagggtaggcagtaaggggccctaggtagaggggtaaaggacttacagaaacccagag

SEQ ID NO: 707954 - DNA, 238 bp, Homo sapiens
atgtgcggccagtgcggcgcacatcacgcccaacatgcgccgctcacgcggcgcccgagtctgccaccattgcgtaccgcgttgcagagatgccttcatcgcaatggctccagcgtgaacggtgtccgcatgcgaccgtcctcgacttggctgctgcccggatccaggtgccatccagcatccgcaagccgcgccgagagctgctgcaggctggcgtcatcggtgtgcagcaaggtcg

SEQ ID NO: 707955 - DNA, 189 bp, Homo sapiens
ttctgactacgccgctgggcctccatctcagctgggccacagtctccagccagcctgacctgtcaggtcttcttgtggtgaccgcgagccaccatcaaggcccagtgagtggctagtcctcaaggtagctccaagtcccacttcaagaaaataaaggcctgagctttcttgctccctctgagccactga

SEQ ID NO: 707956 - DNA, 127 bp, Homo sapiens
tcaggttgtaagttggaatgcgccccaggctttggggcccctgactcaggcttgaaacctcactgaatcatgtggctgccctgagcctgcgtcctctggagaatgggccgaagcccacccccctgac

SEQ ID NO: 707957 - DNA, 827 bp, Homo sapiens
ggcctcaggccgtgctccaccactgactcaccgaaatgaccttgggctaggcactgccctctctgtgccttggttccccatctgtagaagtggggagggtggacactggcaaactagatgacttctttcacctccaaaattcccttgagtttctatgaaagatattgcggggtaggggggtggcttaggagattgacgggttgagacgacactgagaaattgtccaaagagtcctcagaacctgccttggatgaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctgtgaggcagcaaagattatcttagttcatgttatgtagttgctgctatatttaagagtgtgcaaaaaaatagagcagagggtttctgctgtctccagactgtctaccgaagagaacggcgaccagatgcctcctgggtttgaacgtggggattgcactgtggatctgcatccattactgcagtcgtccagcagagcgggcagtcatggcctcaggcgtggctccatcccaagtggcccgatgaccatctgggtcaagcccttccgaaacgtcccttccagggggcttacccagccaaagccatattcggctaggaatttgggattcaccaggctttatttaatccctgtggaaattcccggttggggtttcacactcacgtttgagcctgagagatagcgcgttctacagggtttcccaaagggaa

SEQ ID NO: 707958 - DNA, 451 bp, Homo sapiens
  misc_feature (32)..(32): n is a, c, g, or t
gagaaattatccaaagataatttctaacagcntgaaactcttggggaaaaacagaagaggcaccccagactctgccgggggggaaaacccattttcctcatgaaaccccaggaattgaaagtggatagatccctctcaaaatctaaggctctgttctgttttgcattgcattatctgacgttttcagctttggagagtatcaggaattacttcatattatgagagagttttggtgtgtaataagtaggtaggaaatatatttttgaggatggctgatattaatagcagttatgggggaatactcagctctttgcacttttagatcagagacacgtgctcttggccacctggaaggtatggaaacatccccctttttctcttgaacaaaattttcatgtaatattaaaaataataaaagattttatttgccttttaaataaactataggaaa

SEQ ID NO: 707959 - DNA, 1081 bp, Homo sapiens
taaattaagtattggggtaaaaccacctttggaagcagcaactatcaagtcgtgaagaaggcaatgtgtgagtggtgtctccattataattgctcttatctcgttgggggtgaaacaccttatagattcatagaggatttaagcactccgtggtaaggtgaagtttaacacataaccagatatctccattaagcagccttttaagtggggagaccatggccggattttaatataattaaaaaaaagagggggggtaaatatttaaaaaaaaaaaaaaaaaaaaaaaaaaaaaaaaaaaaaaaaaaacaaaggggggggacgccacaaaaaaacacccccagaggggccccacacacagcgacaccccacactctgagaaaaagggggccccaaaggggggccacacaaaacccaacaacaccaggccacggacaaaacacacacacaaacaggcacaacagcgcacctacggacacacacggagagacacagacaccacaacacgcgggcgggcgccccacccccgggcaccacaaccccaagaagaaacaacacaccacacaaggcacaacaaaacacctcacagaggcacaaacggcggaacaccaccacgcgcaacacccccagctacacaacaaaaccgcagccacacagagaccaacacacacccacaacacaccaacacacacggagacccacccacgacaaacacaccacaaaacaccacacaccaccaccccccccccaccccacaccaaacaaaaccacccagacggacccacaagaggtagcaacccccagcccgacgccaaaaccgaacacgaaacaccacgcaaccgacggacaacagaacaaaccacacaacaaccgcgccgcgggagacaacccccacgccccacgcccaagcgcccccaccaacgccccgaccagcccaccagcacgagaccaccacacagcacacaaccacgcccaacacagcacaaacgaagcgccacaccacaacacaccaacacaaggagccaacaacgaggaagggcgccgacacggccgctaacacaacggcgcacgccacgccaccaca

SEQ ID NO: 707960 - DNA, 242 bp, Homo sapiens
gtaccgattatagtggaggtctggtatgggggcgtgtctattcactatagacaggatcagcagaagtgtcccatgttccagtagcaactggagaaccattgtctgtggctatgattagggcggtgtacgtgctgttcttcacgtgctctaaatcctccctgtccagctcagcccgaatggaaatggcaccagtgtccggattaatctccagccagttggcagtgtctctccaactcatatca

SEQ ID NO: 707961 - DNA, 549 bp, Homo sapiens
  misc_feature (18)..(18): n is a, c, g, or t
  misc_feature (49)..(49): n is a, c, g, or t
  misc_feature (95)..(95): n is a, c, g, or t
  misc_feature (508)..(508): n is a, c, g, or t
  misc_feature (532)..(532): n is a, c, g, or t
atcaaatttccaacatgnagatttggaaaaggaccagacatccaaactnctactagcctatgcagtagtccccttactcttccaagaaataaggnacattcctgcattaaaatgtataatataatgctgagtgataagctcttaaaataaaagtaaaaataaataggtgaaattaatgttaatgatatattttatttaaccaatattccaaaatattatcatttcaataggtatttaatgtattaataattaatgagatattttaccttcttttttgtactaagatctcaaaattcagcctttataccgtactgcaattcagactagttgcatttcaagtagcccatagccaaatgtggcttgtgggctagtggctacggcttcatacaactgtagagtatctctgtatcaatgtagcaaatattgttttcaattgactaaaacaacacatgtccattaaccaatcaggcatgggactgggttaaaataattttgtgcaattcagggncttgaggaacattaggttccaatngcaacttttcacaatgg

SEQ ID NO: 707962 - DNA, 883 bp, Homo sapiens
ctcttaagaacttactgtctccaaaccgtgggtgctcgataagtcagacagaacagtgaatcctcaatttaaggcctgatctaacccctagaaacagatatagatagcaatggagagtgacaacaagattgacatggaatgatgaaaatcatctgcgcaagctgcgttggaaggtgttctctttgagtcattctctatagagtctagtggttcactggagggtagcagttgaacgatatggttgagagagatgcagccgtctacgggatgtactataagcaagtggcttacattgattacgaatatgattgtaagcgctttgagtgcttggaagagttgatgattcaatttcacgtggaacagttctacaggagccaaattggattgcccgtactggtttgtcacttgcaaaatgaaaaatgagcaccagctgaagatacgaaagctttactctgtaacatgactagtcacctacataaatgtcattgcatgcacgcgaactggctggtgctccgtgtgttatcaggacagagacggcatcatcttttccattcactagtgtcggagcagtagatagacagagtttgatctttaggatcaagaatcgataaacgaaggagaactggtggacaactaagggttgttagtggcgcagcgcgctacaggatatctatgggaattgttgaaagtatgagttcgaagttggacagggagacttgaacgtgataactctagatcgatcattataagaggtataatctagaagcccagaagaggcggcagaacataggcctactaatcacgacaatcagaaaactatagggacctatgcaggacttgggagtacaggaaaatgccgtattctctttgggtgggggtcccg

SEQ ID NO: 707963 - DNA, 317 bp, Homo sapiens
tcagaagacacagataagctcaacaaagagctaagacactacacacatctccacagcacagaggcacatctcaaaagggtctgtccagtagttccagcgcagggggaagggtgatggcctaagccaccagctccagctttcttttctttctttttggtaggagctggagtttggctctggtggccaggctcctgagcagctgggattacaggcatgcaccaccatgcctggctaacttggtattttcaggagggttcctccatgtgggtcaggctgatcctgaactcccgacctcaggtgatccgcctgcctcagcc

SEQ ID NO: 707964 - DNA, 323 bp, Homo sapiens
gctgccgcctactactactaaattcgcaaccgctcgactcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaacagctgtgagtgcgtgggctgagcctgtggttgtgtcgacg

SEQ ID NO: 707965 - DNA, 878 bp, Homo sapiens
ataatacggtgatgctggcattagaaagagatgcttgtacgagagaataatggcttagcaaaccgtaggggtgagatgataaatgagcaagactgggaaacagataccgtgtccacagatgaatgaatcagcaccaatgtgccttagatctatgccagtgggatatattggaggctaaggtggagctcaccccagtggcaatccaggcaggaagatggctggctcagaggctctatgcaggttccactgtcaagctgtgactatgaaaatgttccaaccagctgtatttactccttggaatatggtgcttgtggcctttctgaggagaaagctgtggagaagttggggaagaaactattgaggtttaccatagttactttggccattgaatggacgattccgtcaagagataacaacaaatgttatgcaaaaataatctgtaatactaaatgacaatgaacgtgtcgtgggctttcacgtactgggtccaaagtgctggcagaagttacacaaggctttgcaagctgcgctcaaatgtggacttgaccaaaaagcagctggaagcacaattggaattcctcctgtctgtgccgagggtattcacaaacatgtctggtgacccagcgctctgtgggcaagcatgctccagggctggctgctagaggtaacgcccagttgttggatgcttgtcgccaatgaggtgcaaccactgggtcgttgccgtgcccaatccacgggaaatattcacaagaggatgggcctgggaccctgaggtgtcccgtggttgcacacgccagcccctggtcttgttaacacctccgtataataagactcacaacttctcgtatttaaaccaccggcgccataggtttcaacac

SEQ ID NO: 707966 - DNA, 179 bp, Homo sapiens
agtgcctggcccaagagggcccgaggaaacgtcttcatgtaccatgctcctgaaaactacgcgccatggacagcctgccatctgctggccggatgttcaaggtagcctctggggcttcccgttctatcccagcctatgagcgcggcagtttctctctgcgcaggattaatcagcctgct

SEQ ID NO: 707967 - DNA, 142 bp, Homo sapiens
atgcaggatgacatgtggggaggggcagtgtctactctgcgggttctttccaccgcatgcgaggctgggctgcaccttgggcaggacgttagccaacactccggcgggtaggaatcaaggtttgaggggaaacgaccctaga

SEQ ID NO: 707968 - DNA, 132 bp, Homo sapiens
  misc_feature (2)..(2): n is a, c, g, or t
  misc_feature (28)..(28): n is a, c, g, or t
  misc_feature (59)..(59): n is a, c, g, or t
  misc_feature (64)..(64): n is a, c, g, or t
  misc_feature (98)..(98): n is a, c, g, or t
  misc_feature (113)..(113): n is a, c, g, or t
anctgccctggcccaggacggcaggtgnccctggagatgggaaagtgtctgtgtcgagncgctnagctctctctctgtttctccttttttcctctacncctacctatctcccnttttatactaataatctta

SEQ ID NO: 707969 - DNA, 305 bp, Homo sapiens
agcgtaagaaatcatagtctcatacagatcacactatgaacccaggacaaatgcttactttggcattatctaggtcacccctatttttcgtcataggtgactctgatcatagacctatttgttgccaaaccagtccacatcctaccagattaaaaagaagtccctccattgacttcgttagggtgtcaggtagtaccccatgtcccatcccacaccagaagagatcagttcttggcaagaaagctcccaatgtgtcttgatggtgcttgtatggtaggatgcctttaaagccaggctacggttcc

SEQ ID NO: 707970 - DNA, 187 bp, Homo sapiens
gaggatcctatagatcctaacagctcaaagtcaagtaaccagaaaactgctagatcttttacatctttatcaatccttagagattagaaaaatcctatgaatctactatacacaagaatataagataggcagccacagtgggtcacgcctgtaatcccagcactttgggaggccgaggcaggcagat

SEQ ID NO: 707971 - DNA, 117 bp, Homo sapiens
taatatgctgtctcaggataaacgcggacagaatgcttaacacatagcaaggtcaacttagaattatggagttttcaactctagagtttgggtaggcggccgggtgacgtaccgcgt

SEQ ID NO: 707972 - DNA, 193 bp, Homo sapiens
tggcacgagttgagacccttttttttccaattggggtgagtttcctaataaactcggttcattttagctttttggttttacctttaccctaatttttttatttttatggtattggactttatttttgtaaggtggtgagaaatttgttttgcaacaaaatggggtatatttaaataaacccccgatcaaagga

SEQ ID NO: 707973 - DNA, 237 bp, Homo sapiens
gatgcatgctcgagcggctgcagtgtgatggatatcttgccagaattctggcttcagctggatggagcagcatggaggagcgccatctgctgctcaccttgtgcagggcactggcttgccccaggaggacgtggtgcccattggataaagcttggcaggagcttgggagcaagcagcatcttggcttgtgcccgaatccagcccagcgacactccttggcaagcaaatccaggcagg

SEQ ID NO: 707974 - DNA, 209 bp, Homo sapiens
agtagatagtccactgattaccatctggtaggcatcttcaggttactatctgtgagatacttcctgcttacatccccagggtaagagttgtatagagactccttggatgccctgagggagcgggtctagagcttggcttccgtcctctgttttcacaagggtccagcgataggcaatgttctctgacaatccttcttggcactgtttat

SEQ ID NO: 707975 - DNA, 157 bp, Homo sapiens
  misc_feature (12)..(12): n is a, c, g, or t
  misc_feature (63)..(63): n is a, c, g, or t
  misc_feature (107)..(107): n is a, c, g, or t
tggaggggaganaatgcactgataaattaaaagcctggtgatttgcagaaagggactggtagngctgataaggatgcctttggtttggacatgaaccaaatctttgnttacatttcttttatccaaaatatttaggcatctgacatttcaaccagaa

SEQ ID NO: 707976 - DNA, 154 bp, Homo sapiens
atgcgcgcgcgaatttcgatataattcgatcgtccgttattaatattattataaaaagtaaaattatacgcgcgaacgcgacgtcggccgcgacggtcgaacgaccgtaacggacgcgttccggtcgataattgatcgaaaccgatatcgatat

SEQ ID NO: 707977 - DNA, 302 bp, Homo sapiens
ggctctcgtgaactcagtttcttctttacttccctaatactcctcccagctaattctttgtgtttcctcactccttagcagacacgatttcaagcagctctgttgatcgaatagccctgaggctgtcaatcatttcctagttgttttgctgcccgtcattcacactcaaaggagtggcaagaggagtctgaactgcgtgcagatggagaaggagcaggaagggactgattcactgcacccacctgaggctcagcggaagcaggaaccccattctcagcaggctctccagatggcaaagggcc

SEQ ID NO: 707978 - DNA, 889 bp, Homo sapiens
ataaccaaacttcctgatccgatcatatgtatcttctatctacgccctctcctgtgcctgtgactctcacccaaattgcctcgtgttgcccttgaagctcttctgagctaaggagacttcagtccctatcagcgcctcctttacttcccagagaacttcacagagactctgtgcttccatgcagaggcttcctgaaataggtgacgactgactgagtagctcattcttgtgacttacgagtgccaacctttgaaaaacgtatgaaaatgctcatttttatatgacgtatacccataaagaatgctcatattaaatgtacttcaattacacatgtagagcatatctgttatatgtttatgtaactatcaaatggttattgttactaaagctatatttctgatacaaaaatattttaggataattgctacagagggattatttttatgatgctggaaatatgaaatgtattttacaatttcactctggcatatgattatctatcaccatgattttttaaagtcacaatcgcagaatttgggacatttgcatcaatttacaggtaccagtgcgtacatattttaatagaaagatacaccttgtgatttcatcattttattctggtgtggacatattgagtttgccaattatttgtctcatgatacataagcagtgtgtgacgtaaataaggattagttaggatcttgaatgtaaagtgccagggttaatgcctgtttaattgcgaacaaacaaagtttgtatcttttctgtaatttggttttatggagttggataaaacttgagaggtggctctggaaaagttacagggcttgaaaaaaaaaaatcgggcgcggcataaggggggagagaattacaggaagcaagagatatt

SEQ ID NO: 707979 - DNA, 547 bp, Homo sapiens
tcatttcagttcccgagtagttataagagaagtggaaggagaagggatagttttgttcgttgcaggtacaaccatatccagagatctttatcttctgaactattggcatgactaccttgagtggttgttgtaccaatgtttccggggctgatgggagagaacggggatgggacacacactcacaaaaatgagtagatggcacagaaatggtacaggttctatatttaaccatgcagtatattggggccccatactgttgtagaaaatgtgacttgctaggaattatcagaaggtttgttcttatattactcaactttcttctagggtactccccagaatatggtagtggcaaaataaattgagtttaattaaaaaatctcaatagcttggaataacaacgttttagagcataggcacctattccttaaactcagttgtctaatctgctctagaggatgaatcactggctttcagagggaaaaaaacaatagagggtctggggcatacccagggttctagtgacttccaagggtgtattagtccattc

SEQ ID NO: 707980 - DNA, 160 bp, Homo sapiens
taaaaaaaaccctttagatgaaaaattactaatgaaccggggtgtccgtgtctgggcgtgcaacataaaaatacggtaccccctaaggagctggaatctgggtcccggtaaaatttcaaatgggtgggtggtaattaattaaaaaaaaacaaaaccccac

SEQ ID NO: 707981 - DNA, 325 bp, Homo sapiens
tgcagcctctgcctcccaggttcaagcgattctccggcctcagcctcccagggccattagcctcatggtcacatggctgagtaaaatcaaacacacggtgtccagttagtccaaactgagttaatcccatgtatttgtccacatcttgataaggcctctgtgatgaggctaaccatcagctatttgcgtgtgaggaaacttctggatgcgggtgattgggctatggacgatgacatgaaagcacagatgaatggcttttattggaaagccttggatggtttggtaatggttctcacagatgatggtgacgtgatttacgattctg

SEQ ID NO: 707982 - DNA, 609 bp, Homo sapiens
  misc_feature (609)..(609): n is a, c, g, or t
ccttaaaatttgtttcgactcctcctgcaaataaaataaatgaagtggcagatggcaacaaaaaacaaaaacaaaaaacaaaaacaaaaacctgtgtgtgcggcgcgcgcgcccccggcgcccctcgagagagaaaacgttttctttaacacacacacactcgcggtctgcggggcgcgcgcgcgggcgcccccagcgatagggctacaaacgccggcacaccatctgggacgggcatcctacacgcgtgcggtgccccctttaacgaggggagacaccccggggccccacaagagagaaaagagcgcgcgcgagcgaggagaatctctccacccacccacaacattcaaacaaacacacgcccccgaggggcgggcctcacatcacccagagaggggcgttctctgtggtgaaaaaacacaaatctcctcccgagaagatggggagcagttctctatgagagcgccctcacctcatataggtggggggagaacctctatatcctatcaccgcgcggggagagctcctccacagagccgcaggagagccctcgcgaactaatctctccaagatatttttgacccccccccgcgctccccgcgggggatn

SEQ ID NO: 707983 - DNA, 360 bp, Homo sapiens
gaaggatatgaacagacacttgtcaaaagaagacatttatgcagccaacagacacatgaaaaaaggctcatcatcactggccatcagagaaatgcaaatcaaaaccacaatgagataccatctcacaccagttagaatggtgatcattaaaaagtcaggaaacaacaggtactggagaggatgtggagaaacaggaacacttttacactttggtggggactctaagctagttcaaccatggtggaagtcactgtggcaatttttcagggatctagaactagaaataccatttgacccaggatgtgggagtgacccaggatgtgggagtcagacatcctgggtcagtccaacatcctgtgt

SEQ ID NO: 707984 - DNA, 1694 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagtacatatagtctttctggtttctggagataacccatcaataaaagctgcttcctctggt

SEQ ID NO: 707985 - DNA, 213 bp, Homo sapiens
ggctggagtttagcgaaaatacctcatcagatggagcaacgggaggacttttgctcaccatgaccccgagccaagaggctaactttgatgcccaggctggaggccagtaagacaatttaattgcaacctcggcctaccggatcaaggcgattctcctgtttcagcctccaggggggctggaatcacagccaagcccccccacaccgggctaat

SEQ ID NO: 707986 - DNA, 1765 bp, Homo sapiens
  misc_feature (1186)..(1186): n is a, c, g, or t
  misc_feature (1205)..(1205): n is a, c, g, or t
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatggtgagtgcctgaggcccatgggagaaggacccaggagctgcttctggagagatggtggtgtccagcaggggtgtcctggcagaagggactgtcatccttttcccatcctgctctctagagctgcccatcattcttttcagtctgtcctgccttcacactttttgtttcctctgtctgcattttcccaacgctcccctctctttctggcaaactttctacccattcttcaaggctcctcataagcatcctgtgtctttttttttccttcaaaaagtggtcttactgtgtccaggctggttccgaactcctgggctcnagtgatcgtccctcattgncctcccaaagtgctgggattccaggtgtgaagcatcctgtcttctaagaagctttttttggtagtctctcttgccttcctccctaggaacctgggcttccctcctgggcttgctctcactgccctggacacagcagatgtcactcagtcaccctgaactccaccagcttcctggcgaagcctgatatttttgtagggatgaccctgtttcaacaccaggaatgataacagacattaccattactgatgcacagtgcatcagtcaagcaactaaggcagaggctgcaaactggcagcccatggcttttccaacagtgtgtctgctttctttgtagacttattttattttattttattattttttattatttttattttttgagacggggtctcgctctgtcgcctaggctggagtgcagtggcgcgatctctgctcgctgaaacctccgcctcccaggttcaggcgattctcccgcctcggcctcccgagtagcttggactgcaggtgcccgccaccatgcccgactaatttatgtatttttagtggaggcagggcttcac

SEQ ID NO: 707987 - DNA, 1433 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatggtgagtgcctgaggcccatgggagaaggacccaggagctgcttctggagagatggtggtgtccagcaggggtgtcctggcagaagggactgtcatccttttcccatcctgctctctagagctgcccatcattcttttcagtctgtcctgccttcacactttttgtttcctctgtctgcattttcccaacgctcccctctctttctggcaaactttctacccattcttcaaggctcctcataagcatcctgtgtctttttttttccttcaaaaagtggtcttactgtgtccaggagtttgagaccagcctgggcaacacagcgagaccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaatataaacaaaatgccctgttgtgttggggcaaggcccctgtgaaaccccagtaattccgggggagggtag

SEQ ID NO: 707988 - DNA, 305 bp, Homo sapiens
agggcagagtagagaagacgggggacggtcctcatggagcggggcagtgtagatgacaggagggtcgtcaggaaatggcggcggagagcgacaagcaacaagggaaaataagaataccgtgggcagtcaaaagaaaagaggtgaatgcttcaaagggcaccttcaaaaaaagcgagaagacaaccctcagaaggtgagaaaataactacgagtcatatatctgatagtggtatctaggacatataaagaactcttggccggatgcgttggatcatgcctgtaatcccagcacggggctcgtgccg

SEQ ID NO: 707989 - DNA, 174 bp, Homo sapiens
cactagctcggtcatgcatatgcatggacctatgcagctcataaatacaaccatgaacaaggtcattatacaacagtcttttcgtttcttagcccaatgcctctcatgtatttaaccacaacacaaaacgccttttataaaaaaatctaataccagggaaaaaataacccgaaa

SEQ ID NO: 707990 - DNA, 1506 bp, Homo sapiens
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatggtgagtgcctgaggcccatgggagaaggacccaggagctgcttctggagagatggtggtgtccagcaggggtgtcctggcagaagggactgtcatccttttcccatcctgctctctagagctgcccatcattcttttcagtctctcttgccttcctccctaggaacctgggcttccctcctgggcttgctctcactgccctggacacagcagatgtcactcagtcaccctgaactccaccagcttcctggcgaagcctgatatttttgtagggatgaccctgtttcaacaccaggaatgataacagacattaccattactgatgcacagtgcatcagtcaagcaactaaggcagaggctgcaaactggcagcccatggcttttccaacagtgtgtctgctttctttgtagacttattttattttattttattattttttattatttttattttttgagacggggtctcgctctgtcgcctaggctggagtgcagtggcgcgatctctgctcgctgaaacctccgcctcccaggttcaggcgattctcccgcctcggcctcccgagtagcttggactgcaggtgcccgccaccatgcccgactaatttatgtatttttagtggaggcagggcttcac

SEQ ID NO: 707991 - DNA, 1729 bp, Homo sapiens
  misc_feature (833)..(833): n is a, c, g, or t
  misc_feature (1150)..(1150): n is a, c, g, or t
  misc_feature (1169)..(1169): n is a, c, g, or t
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgagtagctgggactacagctgtgttctactatgcctggctaattatgtagaaatagggtctccccatcttgcccagcctggtcttggactcctgggctcgagcgatcctcctggctcagcctccaaaagtgctgggattacaggtgtgagccattgcgtccgactatgcttgattgtccaaggatctgatttctaggattgtggggccagtctctctccattgcctccgtcctgctgtctcttgcttctacagggatctggacaactctcctctgtccccaccttcaccaaggaccaaaagcagaacgcatactcgggcactcaagaagttaaggtgccaagtgcaggggctctggctgggatggaagagggcaatcngggagggtggctgactccagttgacccagagtcctgtctgcactgcagtgagatggtggtgtccagcaggggtgtcctggcagaagggactgtcatccttttcccatcctgctctctagagctgcccatcattcttttcagtctgtcctgccttcacactttttgtttcctctgtctgcattttcccaacgctcccctctctttctggcaaactttctacccattcttcaaggctcctcataagcatcctgtgtctttttttttccttcaaaaagtggtcttactgtgtccaggctggttccgaactcctgggctcnagtgatcgtccctcattgncctcccaaagtgctgggattccaggtgtgaagcatcctgtcttctaagaagctttttttggtagtctctcttgccttcctccctaggaacctgggcttccctcctgggcttgctctcactgccctggacacagcagatgtcactcagtcaccctgaactccaccagcttcctggcgaagcctgatatttttgtagggatgaccctgtttcaacaccaggaatgataacagacattaccattactgatgcacagtgcatcagtcaagcaactaaggcagaggctgcaaactggcagcccatggcttttccaacagtgtgtctgctttctttgtagacttattttattttattttattattttttattatttttattttttgagacggggtctcgctctgtcgcctaggctggagtgcagtggcgcgatctctgctcgctgaaacctccgcctcccaggttcaggcgattctcccgcctcggcctcccgagtagcttggactgcaggtgcccgccaccatgcccgactaatttatgtatttttagtggaggcagggcttcac

SEQ ID NO: 707992 - DNA, 1424 bp, Homo sapiens
  misc_feature (833)..(833): n is a, c, g, or t
agcgggtggggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgagtagctgggactacagctgtgttctactatgcctggctaattatgtagaaatagggtctccccatcttgcccagcctggtcttggactcctgggctcgagcgatcctcctggctcagcctccaaaagtgctgggattacaggtgtgagccattgcgtccgactatgcttgattgtccaaggatctgatttctaggattgtggggccagtctctctccattgcctccgtcctgctgtctcttgcttctacagggatctggacaactctcctctgtccccaccttcaccaaggaccaaaagcagaacgcatactcgggcactcaagaagttaaggtgccaagtgcaggggctctggctgggatggaagagggcaatcngggagggtggctgactccagttgacccagagtcctgtctgcactgcagtgagatggtggtgtccagcaggggtgtcctggcagaagggactgtcatccttttcccatcctgctctctagagctgcccatcattcttttcagtctgtcctgccttcacactttttgtttcctctgtctgcattttcccaacgctcccctctctttctggcaaactttctacccattcttcaaggctcattcctgtaatcccagcactttgggaggccaaggtgagaggatcacttgaggccaggagttcgagaccagcctgggcaggatggtgagaccttgtctctactaaggatgaaaaaattaaccaggcatggtggcacatacctgtggtcccagcgacttgggaggctgatgcaagaggatcttctgagtccaggagttgggggctgcagtcagctgtgatcattgccactgcactgcagcctgggtgagagagcaagaccttgtctcttaaacaaaaacaaaaacattggccaatgggaatctggcttggtggcccaggcctgatcttgaacctcctgacctcaagcaaacctccga

SEQ ID NO: 707993 - DNA, 1033 bp, Homo sapiens
ggtctttcctacttgcacctcgctgtctttgctccacacaccttggttgcagagtgacgtgagccccatgggcagtcatccctgttgtcaccaagaggagtgatgacgtgtgccccccacgccagggtgccccagagacctgtattggattctctcgtggcgcttgcatgaggccaacatgattcaatggccaagaccgtgcctggaccatcccactctgccatctcctgtacaagcgtgacacaccaaatggacatggtcacttgcctgcagagactcggtcccatgagtgaccacaggactggcagcgcgtggtccagaccaccatgacctgggtgatacacgacaaagcagtggcaagacgccacaacctatgtcaagaccacccagtcagacgaaggggcacagggaacttcaaataccagagtgggcacttgtgagcatactacttgggcacattcatcgcattgcattccacaacttgcagtgacactgtggctgaacaatgaaaccacagagccgagaacactccatgagagccaggcgttccatttggacctcggtacgccataagagtctgagcaaggcgacaccattgccacaccccttatccaatctgcgggctttcaccgtaagcgaaggtagaagcgcagtgaatcagccaagcgcagacggcgacattgggggcccaagccattggcaccacgaatttgtgagacacactttggatagcacccatatattttgggaccacatgagcaattcgacgattggagaagacggaaaacccaacacacgtaccagatatacccacggagcaccaagcgccatttggaacgactatgcggtagcgattatacaagaacgaaaggcatttaggaaacgaactttatctggcgcaggtacaatttcatctaacacaggcgacggtatggactacaccaagaagaagacattaccatagggtagaccaaacaacaaaatcgagtatacgagagtatgcggaccgcacaagtagaaatcgcccacacct

SEQ ID NO: 707994 - DNA, 588 bp, Homo sapiens
gccccacttgggtttgaatatattgtggtttcccctggggcacacagccccacatgtttgttgttctgagagagagccttctctcaaaggagccttattatctccccgcccttttgtggtctctctcttttgtcctgttttctggtgagatatatgagagcccacagagcacgctttccgtgtggtgtccatccaagccagtggaccagcaaggctgctggagctggccaggtccacccagtctgccccagaaagctccagaaggctaaatggatatttatccctttatacctgcccacccccacttttatataccagtggtggaagaacggttctcagaactgtttgtgttccatatggcccatattaagtttagtagtaaaagactggttacatgataaccatagccatcgttaaaaccctccagaaggaaaggagaatagttttgtggacccccttggttttcttttttgcgtgtggcagcttttaagttattagctttttaaaatccgtactttttaatggaaaccacttgacccaaaatttgtcacaagaattttgagaccccctttaaaaagttaaatgaga

SEQ ID NO: 707995 - DNA, 424 bp, Homo sapiens
  misc_feature (62)..(62): n is a, c, g, or t
  misc_feature (72)..(72): n is a, c, g, or t
agacattttagtgatgagatttaagagaatgtgcagcctgggcaacacaaatgaaaccctgncacacgcaanataaaaatattagccaagcttggcagtgtgcacccgtagttcctgctgctcaggaggctgaggtgggagaatcgcttgagccctggagtttgaggctgcagtgagctatgatggcaccagtgcatttcagcctgggcaacagagcaagaccctgtctctcaaaaaacaaaaaaatgaagattctgatgactgcctagggaagagaaattctaagataaaactaagaatttacggtaaattaactgaagagatgatggtgtcattttgaactggaaaacatataaaaaaggtttgaaaaggaatgctctgggttcagatttggacaggctgaatttaaaaagaaagtcgacgc

SEQ ID NO: 707996 - DNA, 375 bp, Homo sapiens
  misc_feature (69)..(69): n is a, c, g, or t
ctggggctcctaggaaagccaaacttttcctttgtcaggggatgaagataggaaccacctacttagcantaggattcccatctcctctctctacctccttctcctccccttcccctgggctcaggtttaaactcttagagggaagcctacttttgggggaggagaggttgcagggagaacttcctagaaacagggagcccagggataagaaagaaaaggaggcagaatgcccgggcgtgtcgctcacgcctgtaatcccagcactttgagaggccaaggtgggcggatcatctgaggttgggagttcgagaccagcctgaccaacctggagaaaccccatctctactaaaaatataaacattagctgtctcaaca

SEQ ID NO: 707997 - DNA, 108 bp, Homo sapiens
  misc_feature (92)..(92): n is a, c, g, or t
atttccttactgcctcttgctggggaacaaatgtgacatggaggccaagaggaaggtgcagaaggagcaggccagtattaaggctagagcangaggcagtaaggaaat

SEQ ID NO: 707998 - DNA, 585 bp, Homo sapiens
gacccccgatcccgcacctcaaggcacctccaaagatgatgatgggttgtggggagtcagagctgaagtcggcggacggggaagaagccgcgtgcggtcccgggagcaccccggagccccaagtcccgcaactccgagccccagtagcccgagcccggcctggacttgagcctgagcccggcggaccgacagcacctcagcgcgcggcacggcagacccgggcggccggaaggggcgggcggagcggcggggcgcggtcggacagcgagcaggcaggtccagttccagcctgaacgccgcactcccccggagcaggtcccagagacagcagactgaggttgcgcaggagctggagatgcccagagctcgaagagcagactggcctgtgggcctgagacgctgcgggcccgaaagcacgggagccacattgatagcatgccgaaggacggagagaggaaccagtgacgcaaaacgtcgcaaccacgaatccagctgacggacaggcaggaggcagcgtgttcccgagcgggcatgacacagtgccccgcgctccaaaggcgagccattccggggaaccatgggtgc

SEQ ID NO: 707999 - DNA, 411 bp, Homo sapiens
  misc_feature (58)..(58): n is a, c, g, or t
  misc_feature (235)..(235): n is a, c, g, or t
  misc_feature (365)..(365): n is a, c, g, or t
  misc_feature (367)..(368): n is a, c, g, or t
aaagtggtcaccaagctgatgccattgggtccccctggaaggcggaggagggaggaanaaagtggcgctgaccacagggctcaggcggaaccggatctggatggacaggagttccccggcaactgtggggtcagggagatggctctgtcccctgctctccgagggccagccctggaccccgcccacatctgcactggctcacactccacatgggagggacacacccaaatgcctnctgtgctgctgcccaaacagactcacggagaaaccaccgacctggacccacccggccggcactgcaccgctgggatggacagcaactgtccccacaaaaacgcacgtgattccctgtgctgagcccgaanannctccgctcccaagctccccatccttcattctgggcctcaggaa

SEQ ID NO: 708000 - DNA, 123 bp, Homo sapiens
agcgagctctctgcggttctctagaggatccggcaccattgtgctggctggcaggccctgtggctgctggctgagggttctgctgtctgtgccaccccattaaagtgcagttccctccgggcc

SEQ ID NO: 708001 - DNA, 104 bp, Homo sapiens
cactggcataaaaattaggtgccctaaagggagctgtggatggaggcttgtctatccctcacagcaccagcacgaattcccttagcaccagcacgaattccctt

SEQ ID NO: 708002 - DNA, 153 bp, Homo sapiens
acgtcgacaggtcggcaacatggtaagacccccatactactactacaaaatacaaaaataagctagggcataggtgccgcatgcctgtaatctcagctatatgggaggctagcggtaggcgactatatctacgaacctatggacggcggacgg

SEQ ID NO: 708003 - DNA, 442 bp, Homo sapiens
  misc_feature (52)..(52): n is a, c, g, or t
  misc_feature (74)..(74): n is a, c, g, or t
  misc_feature (98)..(98): n is a, c, g, or t
  misc_feature (108)..(108): n is a, c, g, or t
  misc_feature (125)..(125): n is a, c, g, or t
gtagccaaaatttttttttcccccccccccataaatagtgttctcagccttnggttttatgttaaagatccctnccctcgagaggtttgcctaacccnaagacctttntcagggtagttacctanggaatctaatatttttaggaagtgctgtaattcattctgataacatagctggagataacttggtgtcccaagtttaattatgtatgtttatcaaactactgaattgaaatttttttttttctcgagacaggagtctcgctctgtcgcccaggctggagtgcagtggcataatcttggctcactgtaacctctgcctcccaggttcaagcgattctcctgcctcagcctcctgagtagctgggattacaggagcctgccaccatgcccagctaattttttttgtttttttttttttttagtagagacagggttttact

SEQ ID NO: 708004 - DNA, 867 bp, Homo sapiens
  misc_feature (611)..(611): n is a, c, g, or t
ggcattggtctttgctctcctcccacagaattgtcggtcatgtgatggcaggcctttgcgggatttcttggctattgtatatgcaggccttttcttcccagccccaaattcttgggtaggctctgtctgcttaaagagcctgtcttcacaaagctgcactcgggtgcctctgtgcgctgtcttagatcctactgccggacccttcaggactccgagccaggaaagaactctccgaacctctggcgtcgagactcctacttgtgtttgtctcagttcttttccttactctcgctccgtccttctacttccgactagtgccgtctcttggtctcggtggttccgctcctgtttcctattcctccgtgtcccaccggatctcgtgaggtggtggactttcttcctatagtcgttgccctctagtgtcccgtttcgtcttttggtccaccttctcctttagtctcgtgtgttcgtcgtggcccttgcttattcctcttcgtggtcgcttgtcgtgccgtccgtcctgcgaagatctgctgatcatcttctcccgtacttccctggtattggatttttgactggtccgtctaaaggggctcacgggctggattcgngacatgcaggtccatggcgcctgggactgatgtgacgcaagtacttgaggtcagccgtgttcacctactcagccgcagaaaggtaaagctgaggcgtgaggccctgaccttggagccggctccagcgcgcctcccggagccagtgctgacccgttgccctggccagcgatgatgcatgtgctgtgggccctgccggcgcctgagggtgctctgcctgaacagtgttcctaaggcgagcccactcccaggactaccg

SEQ ID NO: 708005 - DNA, 910 bp, Homo sapiens
  misc_feature (324)..(324): n is a, c, g, or t
gacggcgcaggtctgcaccatggcggcccggcttgtccgccgatgcggggctgtgcgtgccgctcccctcagcgtgcccgtcgtgggtgtcctggtcgctaggtgtgtccggcgcctcacacagacaccgtgtgatgacgtggtgtgtgtcggcgctggaggcctggtgggcgctgccatggcctgtgccttgggatattagatagttcactttcagtgacaatgaaaatcctgtagctcagaagcaaggtccaaaatgaaacgtactggaggaaaattgtcacgaaaacttacatgcaaccagggtcaggctaccatttcccnctggcttctgaaatggcttctcagtacgttttgagtgcctgcgaaccaatattctgcgacatgaagatacggagacctttgtcggtcgaattgcagggtgtggcgacgcctgtcgtcacgagggtcccctgagtaaatgttgtagactaatggactaacttcaagagttgaccacttggtgcctatattcgtgcggcgacaatgattcccagtcatgacatgggctctccactaactggcttctgaggagagctggctgatcgtagacccgtggtgcccgtgttcctcatacagcgtaggcggagaggccggtttccgcttattcctcctggtgccttggtccagtccctcttgttggaggcggccacttccttgggccctctggtggtctcgagtagtctactcctgttaggctgcactcgagccaaggctgccctcttccgagggagcgctatagactatggtctggacgtcaccgcttggcacgtgtgccgtcacccgagctgccggggatgttacggggcaatcgcccttgttgggggacgtcccggacattgttcgaggcctgggcacaccttattgacca

SEQ ID NO: 708006 - DNA, 158 bp, Homo sapiens
tacatgatacactcgagtgagtacccgataggccaagctgggaggatcgttgaggccaggagttcaagaccagcctggcaacatggtgaaactccgtctctaccaaaaatacaaaacccggctgggtgcagtggctcacaccttttggcccttatgag

SEQ ID NO: 708007 - DNA, 103 bp, Homo sapiens
agtgctccactaaacgatattatggaggtcagcacggtgctcacgtagtacgacggaactagtatcagtggaggcatagcaccgacattggtagaatacacgt

SEQ ID NO: 708008 - DNA, 1048 bp, Homo sapiens
gagcggggcatcaccgtgccagcctgggtggagtgagctggcgcatgtggctcggtgctccgtgctcctgcgggcgtgacgagtgcggctggcggctggcaggaagcggctgtgctggcggctgtgatggcgtggagccgatggagcgacggttccatggactgctgcttaggaacctggggacatcaggagtgccctgcgccctgagcgctcagcatccagaggctgtcatggctgaggtaccgggacccctcctgcaagacactgaccaagaaacatacacccttgaagatctagaacacgctcaagtctggcctgcaaggaagacatccccagcgaaacagagtgaggcgatcacctcctggcagtgcctggtttagcttcctggcgagcccacaaacaagctggagcaacgacgaacctctcctacattgagcacatctttgagatctcccgccgtcctgaccctactcacatatggtggttgactaccagcacccgatgtgctgacaccgtctctgaggcggatgagctggaaccaccaagctaacccgtaatccccaagtgcaaggaagtaccacagacacttatccggcagcacctctgaggcaagagactcactccacactaggctcccaccagcgaacgaaaggcctggagcaacggcgggcggcacgacggacgcgacgcgggcgggcaccctcgaaagcaacacaaccaccgtcgccccgatacacccacaaatccagcgcgagggacagaagggggcgggaacagggggcaaccaccagaccaactcctaaacagcacacgaaaaaaacgccggggcgtcgccatacccccacgcccaaccaggggtgccagagtggaggctggtcgcggtagagacgccccaacgtccgcgacctcggcccaggcccaacaaaacgcccgacgccccactccaccgaccccgccccgaccacacaacggagcaacgggacggaccacagcccacacccccgccgcaccgggccggccgacgccaccaccgcacaccagacccccg

SEQ ID NO: 708009 - DNA, 129 bp, Homo sapiens
ggaccctgagaggataggaaaaagtgtttatgctgtgtaataaattaaattgagtccggccttcaagtagtgatgataacatgtactagctataatctgagagccaggttgcttcggttgcctctcaag

SEQ ID NO: 708010 - DNA, 221 bp, Homo sapiens
  misc_feature (18)..(18): n is a, c, g, or t
gtggacatgtgggtgganaagggagggtggccagccctagtaaaggaggaatagtgcttgctggccccaaggaaaaggaggaggtgtttggggtgagggagttagggaaaaaaaagcaggcagataagttggagcaggggttggtcaaggccccctctgcctttagtccccaaggcctctctctgcctgaaatgttacccattaaacaggattttccagta

SEQ ID NO: 708011 - DNA, 793 bp, Homo sapiens
aggctcacgcgtgtggccgcggcgcgtgcgtctgtgcctctgcgcgggtctcctggtccttctgccatcatgcctgcactgttcatcgtcagcacacctagacgtgccccgcgcctccgctgccggacgggttcctctcctggagctcacccagcagctggcagcaggccaccggcaagcccccccagtacatcgcggatgcgacgctggtcccggaccagctcatggccttcggcggctccagcgagccggtgcgcgcatcttgtcagtgctgcacagcatcgggcaagatctggcggcgcgcagaaccgcatcctacagcaagctgtctgtgcggcctgctggccgagcgtcctgcgcatcgagtccggacacgggtctacatcacactattacgatcactgaacgcggccaatgtgggctggaatcaatctccaccttcgtcctaaagagccgacacgggacccatcgtctgctcgtgcgctggctccagcccgcgtgaatcgccgcgcgcacgcttgtgcttctagggcccgctcgcaccccgaagcttctggtgtgcgggagatacataagacgggttgtacgacgacgtatcacaatcatgatttgccaagcacaagaagaaaataattgcgacggcggactaaaagatgaccgttgacacacttgtgttgaaatgctgctgggatgttatgtgctccaacacaagtattcgatgaacaagaggcggaaattctggctgccctgaagggcgtgataattgcggagaccggtacaccaaaaagaaaaa

SEQ ID NO: 708012 - DNA, 111 bp, Homo sapiens
acgaacgtactatgtagattaggggttgatggcgatctgtttgccccatttttaaaagaaggaaaaaaaaaaaaccccccattagctcgggggaccctcttagaattcgac

SEQ ID NO: 708013 - DNA, 468 bp, Homo sapiens
tgtcttccttctgggcattctgccattcttagccccctggctgggatggcagcacccttcttaccaggcagttgctaccactgcttcgcctgggtgtggctcccttcgtgccgaggtgtggtaactgctttggctggtgtaactgtcttctgggcaggtgttgctgctgcctttttgccatggagtgacagctgcttttcgtggctggtgtggcaactgctaaccttattagtgggggaaacgaccaccttctttgctgaggctgcagcagccttcttgcctttgcttctgaggtatgacgacctcttctccactgctatcatcttcttcatcttctgacatttcctcatcttcactatcttcttctacctccttcggaggaggagccattttcttggggtcaccttgatttttacctgccttcgcgagcttcaacatgatggcggcggagtgtgaagcggacaagtg

SEQ ID NO: 708014 - DNA, 613 bp, Homo sapiens
ggtgacgtcggccgagagtctttcctgctatggccggattccagactcacctgggaaaggctgtatatcaacagaccacatggatcaaggccttaagtaggtggctgaggatacacgcatgccctgaaccatctggagcccaagatgctagagattctgtcagctcaagtggacaccctctggccaccatagcagagaagtctgcaggcaggagtttccaaggcaggacaggacaagagacagagcaagtgccttgtacatatgcagacagaggtgtagactgtgcctctgtcatagttgtgacaagcaatccagatgaccttgcaaggatcttaatgcatgtcatgaactcgaatgcgccgatcaagcctggcattgctgttcacagacagagtgaggaagcgttgtccacacccttatcctagtttgctgaccaactgtgcaatcagaggatgatggttagcatacaaacacacatctgcactacgactcctttaattgtaggcaatcagacctttacaagagtgcatattctagggaggtattgttgcggattagtgaatgatacccttcactctgaactatctctggaacctaacagaggaacagcctt

SEQ ID NO: 708015 - DNA, 675 bp, Homo sapiens
  misc_feature (102)..(102): n is a, c, g, or t
  misc_feature (352)..(352): n is a, c, g, or t
  misc_feature (391)..(391): n is a, c, g, or t
  misc_feature (428)..(428): n is a, c, g, or t
  misc_feature (468)..(468): n is a, c, g, or t
  misc_feature (580)..(580): n is a, c, g, or t
  misc_feature (634)..(634): n is a, c, g, or t
  misc_feature (642)..(642): n is a, c, g, or t
  misc_feature (650)..(650): n is a, c, g, or t
  misc_feature (652)..(653): n is a, c, g, or t
gccactagcggttaaaccccgacggaaagagcattcgaaatcgatagagcacaatattggaccagtcgaacgtgaagaagcgggtggaaagaagagaaccanaagtcactttcccctaaggtagaggagcatccagatcactcgcgaacgaaccattcgcgagctgcaatatcgatctgtatgtctctatagagaggacaagcgcctcacatgatatcttatacagagaggatggcatgctgagtgtcgagtttatcgcatgccagggatcaagtctccgagggaggcgtcgtagtgtggcgtgacacagatgaagctgtcgcccagcatcgtggacggtctaggaacgaantactctcggtcgatactgtcaaagcatgattactcaggncactgggcgatggcggcgaagaaagattcctggcagnaagagccatcgcgcgcgctcctcgcaatgaacgagcccgnagtgaacacggtggtgggaacctcaattgagttggacgtttgaaaggtgatcgtgtccccggacataggagttcccctagatcatcagatgagaccggtacgattgaagccnaggattcttccagagtagtagcatatgcttgatgcgtccgctcaagaggacgtngatcccanggggaccntnnttcgcaagagcttccagaggga

SEQ ID NO: 708016 - DNA, 266 bp, Homo sapiens
aatacaaaagaataagtgttggcaagggtgtggagaatttgaaccctcatacattgctagtagaaaggtaaaatgttccagtgactgcaacattttgacagttcctcaaaattaaacatagagttatcatatgaccgagcaattccattcctgggtatattcccaagagaaatggaaacaggtgctcgaacaaaaccttgtacacaaatgttcatagcagcattatttatttattttttaactttgcagcattatttataatagtc

SEQ ID NO: 708017 - DNA, 522 bp, Homo sapiens
  misc_feature (8)..(9): n is a, c, g, or t
  misc_feature (12)..(12): n is a, c, g, or t
  misc_feature (22)..(22): n is a, c, g, or t
  misc_feature (37)..(37): n is a, c, g, or t
  misc_feature (43)..(43): n is a, c, g, or t
  misc_feature (477)..(477): n is a, c, g, or t
  misc_feature (499)..(499): n is a, c, g, or t
  misc_feature (511)..(511): n is a, c, g, or t
gacacatnnctngtgttttaanatgcctgagccagcnaagtcngctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaggccatgggcatcatgaattccttcgtcaacgacatcttcgagcgcatcgcgggcgaggcttcccgcctggcgcattacaacaagcgctcgaccatcacctccagggagatccagacggccgtgcgcctgctgctgcccggggagctggccaagcacgccgtgtccgagggcaccaaggccgtcaccaagtacaccagcgctaagtaaactttgccaaggagggacttttctctggaatttccctgataatggaccaagaaaagcttcttatcaaaaagaangcaacaattgccttcgggttanctcattaatctnactgcagaaaa

SEQ ID NO: 708018 - DNA, 424 bp, Homo sapiens
gactgcattggtctatcacttaagtacgcgtaggggatttatagggttctgtggcctgagttagagttgacataaatgtcgatctggacctacaggatatccacaggctcgataggttcatcacttctaccaataaatctacgcaatagaatgctacagattaggttgtactctaatagctgctcttaggtagctggtatggttgcaggggtaataaaaatggctctcggtaaacagtaattggtaattagttcattgttcacaaggtatatgagtaagtccctggtatagtatgagagcttatacttcatcctctgtaccctgcaggacaatcgctactgcgcgaggtctccatctgtgtcagtcgaccccgatatgggcaaagggtgtcatcaactgtggcaaatcgtacgaaagagtgcgt

SEQ ID NO: 708019 - DNA, 148 bp, Homo sapiens
cgcgagggcttctcagcctcatgaacattgtttctattactgctgttagagaactgaatgagcctacagatgatcggatgttacatgtggtgtctgcctcggggtcgtccgagtaacgtcgggggattccggcattcctatggattgt

SEQ ID NO: 708020 - DNA, 734 bp, Homo sapiens
  misc_feature (8)..(9): n is a, c, g, or t
  misc_feature (12)..(12): n is a, c, g, or t
  misc_feature (22)..(22): n is a, c, g, or t
  misc_feature (37)..(37): n is a, c, g, or t
  misc_feature (43)..(43): n is a, c, g, or t
  misc_feature (405)..(407): n is a, c, g, or t
  misc_feature (413)..(413): n is a, c, g, or t
  misc_feature (433)..(433): n is a, c, g, or t
  misc_feature (440)..(440): n is a, c, g, or t
  misc_feature (444)..(445): n is a, c, g, or t
gacacatnnctngtgttttaanatgcctgagccagcnaagtcngctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaggccatgggcatcatgaattccttcgtcaacgacatcttcgagcgcatcgcgggcgaggcttcccgcctggcgcattacaacaagcgctcgaccatcacctccagggagatccagacggccgtgcgcctgctgctgcccggggagctggccaagcacgccgtgtccgagggcaccaaggccgtcaccaagtacaccagcttccagtaaannnttccanggggagacaacagtttttanacatatntttnncaacagccgtcactgctggacactgtttcatcttgcaaaaaaaccaatgaaaatgagtgatccttgaatatgataaaaggaggttcttttgaacaatcaaagtaggacaaatgatacaccttgctgggaaaaattagctcttctttttatgcataaaactattaaaataattctttcatagaaatttatgacccgggatacatataggactattttaattttaatcaacatcatatcttgctttctagggggtgcgccgctcaccaaattatccctttaggaggtcggc

SEQ ID NO: 708021 - DNA, 328 bp, Homo sapiens
agctccgtacccctcatatgtgccacattcacagccactgggaaagctacggggatgggccgggcgcggtggctcacacctgtaatcccagcactttgagagccaagacgagcggatcacgaggtcaggagattgagaccatcctggtcaacacggtgaaaccccatctctactaaaaatacaaaaaattagccgggcgtggtagcacacgcctatagtcccagccacttgggaggctgaggcaggagaattgcctgaacccaggaggcagaggtggcagtgagccaagatcacaccaccgcactccagcctgggcacacattatgga

SEQ ID NO: 708022 - DNA, 450 bp, Homo sapiens
  misc_feature (8)..(9): n is a, c, g, or t
  misc_feature (12)..(12): n is a, c, g, or t
  misc_feature (22)..(22): n is a, c, g, or t
  misc_feature (37)..(37): n is a, c, g, or t
  misc_feature (43)..(43): n is a, c, g, or t
gacacatnnctngtgttttaanatgcctgagccagcnaagtcngctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaggccatgggcatcatgaattccttcgtcaacgacatcttcgagcgcatcgcgggcgaggcttcccgcctggcgcattacaacaagcgctcgaccatcacctccagggagatccagacggccgtgcgcctgctgctgcccggggagctggccaagcacgccgtgtccgagggcaccaaggccgtcaccaagtacaccagcgtctaatgtatatcgtttcaatggtgggtctttttctgttatttctctgatatgtt

SEQ ID NO: 708023 - DNA, 431 bp, Homo sapiens
  misc_feature (43)..(43): n is a, c, g, or t
  misc_feature (100)..(100): n is a, c, g, or t
  misc_feature (429)..(429): n is a, c, g, or t
ctcgaatttggggctcaggcgatcctccgacctcagcctcccnagtagctgggactacccgtgcatgacaccctatctggcccttgttttttgttgttgntgttgttctttcttttttcacgtggtttcgcacttgtcacccaggctggagtgcggaggtgtgttgtcggctcactgcaacctgtctctcgggttggagtgattctcgtgtctcagtcttccgggtggctgggattgcgggcgtgtgccaccacgcctggctgatttttgtatttttagtagggacggggcttcgctatgttggtcaggctggtctcgatttcctgacctcgggtgatctgccacctcggcctccaaggtgctgatattgcaggcgtgagccaccacgcccggcccgcatccggctttgatttggttttccttgcccgngg

SEQ ID NO: 708024 - DNA, 131 bp, Homo sapiens
cccccccgaaaaaaaaaaattgaaaaaaaatttgttttttccaaaatttggtttggggggggggggggtttttttaaaaaggccctttctggggggttggggggccaataaaacccttgggcccctcccca

SEQ ID NO: 708025 - DNA, 174 bp, Homo sapiens
tgagcggtcacacgccacggagaaggtaggtcggtcagcaccaggcgcgtgatctcgtgcacgtcggggtcgtcatcgaccagcaggacctgccacgcgggcatcgacaaagaggagttcatggcagagtcctggcggatacgatcgggatgtggccttctccggtggcgtggt

SEQ ID NO: 708026 - DNA, 211 bp, Homo sapiens
  misc_feature (44)..(44): n is a, c, g, or t
gtaaaggcctcatcttcttgattgcagttcaaatacttacgatncacagtcaagtatgaattttatgagccattgtttggttgtaaatgctcgtgtgatttcctacagaaatactggctctgaatatattgtaataaaggtctttgcacatgatgaccacatacgtgttaggtaggctgcatgctctggaagcctggactctagctggagc

SEQ ID NO: 708027 - DNA, 603 bp, Homo sapiens
aggaattacacgtaaacaatggctgtaaatcaccattgcatgcatggctgcgagttgtaatgtgcagatttcgcttataagaacacttctagtatgaatgaaaaaaaaaaagaaaaacaaacaggttgaaaaacgagtgcagtccactgccagacgcataaagtaagtaccgacagaacggaggagggagagcacattaagcacgaaagaaaagctcacgtacgcagaaaagacaagaggacgagcaaagacacaagacgcgaaaaagcagagacagagaagagaaaaaagaaaaaaaagtaagaagaaacaaagcgaaccacacaacacgaagaaaacacaaagacgaacagacacaaggaagaaagaaaaacacaagaatagaaaaacgaacatccacaagagacagaaagagtacaagcacagagaaacagagccaaaagacaagaccgagcagagagaagcaacgagaaaacagtagaggaacagcaacgagaacaacgaggaagacaatcaaaagggcaaaacagataaaaggaaaaacacacgcatccagacgaagaccagtaccaaaaaagctagaactgcgaacaaccgagcaca

SEQ ID NO: 708028 - DNA, 107 bp, Homo sapiens
caagcgacatgcggcatgcgattctaagagtacccccatccaatatggccaacaattcaaaatttttaaaatttaacttataaagtctgagatcattatatacaaga

SEQ ID NO: 708029 - DNA, 371 bp, Homo sapiens
gattacaggtgtgagccaccacgcctggccaaaagatagcatctctatgttagtttccctctctccatttaaaaaaagatatattttaggccaggcaccatgttcacgccagtcatcccagcactttgggaggccaaggcgggcagatcacttgaggtcaggagttcaagaccggcctggccaacatgatgaaacctcgtctccactaaaagtacaaaaaattagcccgacatggtggtgtgtgcctgtaatcccagctactcgggaggctgaggcgggagaatcaccagaacccgggaggcagaggttgcagtgagccgagatcttgccactgcactccagcctaggagactaatcaagactctatctaa

SEQ ID NO: 708030 - DNA, 219 bp, Homo sapiens
ctatgcagccctatctgtcaacaagacctgtctctaagaaaaaaaacattttgaataggctgggtgtggcggctcacgcctgtaatcccagcactgtgggaggctgaggtgggagatctcttgaggccctggaattcaagaccagtctagtctgggaaacacagcaagacccgccttgctgggcgcggtggctcacgcctgtaatcccagcactttggg

SEQ ID NO: 708031 - DNA, 334 bp, Homo sapiens
tgtcgctctagagatccccttcaaatgggccagaagtgcatgctttatgtgaagcccctggagattttcaatgatttgcctatttatatatgttcttttttatcttctttcttgagacaggtcctcactctgcctcccaggctgatgtgcagtggcgtgatcattgctcactgcagccttaacctcccaggctccagcaatcttcccacctcagcctcccaagttgctcggactgcaggcccacaccaccacacctggctaattttttaatacctttttattagaatgtattctctcctttttgtccagactggtcttgaatttctgtgcccgt

SEQ ID NO: 708032 - DNA, 726 bp, Homo sapiens
  misc_feature (606)..(606): n is a, c, g, or t
  misc_feature (710)..(710): n is a, c, g, or t
caggagcagccactctttgtcagagtcctcctatggtcagaccactaggagcccgatcagcccggaactgcactcggcacccctcacccatgtggctcgcgacagttcgagacacttagccagcgaggataccagcagtgccacaccagagctggcgctggatgaacagtctgtccagccctgggagcggcggaccttccccctggcgcacagtccccaggcggagtgtgaggaccagctggatgcacaggagcgagcagcccgctgcactcgacgcacctcaggcagcacgactggccgggagacagaggcagcgcccacctcgcctgccatggaccccctcaagagtcggcatatggtggcagcagccacagctgagcgcccgactcacagatgagcggaagacagacatctagacagactcactaactattggcgttaaagctccagacatctctgcgtatgatattcagacatcatatgccggacattctcacagtttctagtgaacttaaggaatatagatcctactttggtagttatcatactgggaataatgctcgtgctgtatttgaacccatgtggtcttgtgacacacctgagcancttctcccgttggccagaagttcaggatgagaccctgctggcctgagctctgcacatcctctgcactgttgaatcactggacttactgatcttagatgaccccncgtacttcaccctgcg

SEQ ID NO: 708033 - DNA, 1413 bp, Homo sapiens
  misc_feature (4)..(4): n is a, c, g, or t
  misc_feature (70)..(70): n is a, c, g, or t
  misc_feature (79)..(80): n is a, c, g, or t
  misc_feature (1413)..(1413): n is a, c, g, or t
tggncggtctcagtctttaatcgtggcagggcctcacgcacgcgcgcacgtacacacactcaggcttcanatcttgttnnagaaacgctgtgcgagaaatattcagacactctctgtgcacgtgtgcctccttacaaacttgtggtgtgattcttcctctcctctccagacaagttcctgttcccacaccttgtgtttcgttcctctccacccaacacacgctgtgacatctctgtgtatagcttctcgcggatataccgtatagccccagcggggacacccagtctttggaaaggcgccccacagaacacagcccgcgttcacaggctgtgtgatataagacgcccgcacacacacaggtgcctctcaccagctgtgggcccatgtgtgtctcgtgtcttcattctatctccacaaggggcctttgacacatctctcacgacaggagatgtgagaggagaccctgtgcgccaccacagtgtgcgagggctctctctgtgtgggcgcttttctttctctccggggtatactgtgccggtataagccggctctctcttctcccggcgagctgtgtgtgccgggccctctctctgtgtgtgtccctctctctctcctctctattttgtgtgtcacctgttgccacacacacaggtgtctcacagggtggctcatcttcaatatccctctccggtgtcactatctcactccgatgctgtgaggtgtgtgtgcgctagtgcgacgtatatcatatgtgaagagcagtggagaagaggggctcatcaccaaactgttgtgttgcgagccaattgttggggcgggaacataacattaacccggtgttgcactgtagggggcgcctacatagttggtcgtggaggaggagaccccctgtgtgtatgtgatcccccgcttgggtgtgttgtgggccccccaaagtagcgccaagaaagcgcctcttctatatcttctatttctacagaagggcacaagcaggtctttacccaacgaccgcagggtgtgagcccctcatccaccgaaggcactctttatagggagcaggcaaacgttgtcggcacgctcagtgtagtcgttggcagcaaaggtgatccgcttcccctccttgcgtggttgacaccaccaacagacggaggccacataatcgcagacctaacaagaaatcgtctcctctgatgggggtttcttcctccttacccccccaatgcttttttacgccccaagcaggaatcgtcgggtggggcgaaactactccccgacggaggatcgaagaaaacagaagacgtggcctcaccacccacgcgggtgggaggatcccttccccacagacatttagagtcttacgcaccagcgtttaagggaaggtgggcccccccccatggtgggggggcccctagn

SEQ ID NO: 708034 - DNA, 445 bp, Homo sapiens
tttattaatcttcaccgggatggaagtgtctacgagtggccacacatcacgccgccgtgatccaggtacaggatgtgatgctcttcctcaaacacctgccgcccggtgtgaccacagtctgccgtgatgtacatttcttcattatataccaccagctgtagagcccaggttacctgcacccatgatgaggcctggggctggtgtccttggtgtgcacggagcctgatacgtatggatagtctgcccagtgcaggtgcaggtgcaggtggcagtctggaggcttgcagttggttggtttaccattacatgtccatgatgggtggcctcaggtaatcccagtcgcggcccttgtagtaggttataatgcgtcatcactttcccatcaattatatggtttgccaggaagactcctttcacccctctgacctccaggatgtcaataagc

SEQ ID NO: 708035 - DNA, 117 bp, Homo sapiens
ggccatgctcagacagctccagaatatctaagcccaggacagagaaccagaaacttccagagtcagctgactgtttctgcattgtaagcactgggcagcctggtgaaccaggcagtg

SEQ ID NO: 708036 - DNA, 140 bp, Homo sapiens
  misc_feature (60)..(60): n is a, c, g, or t
ctagtcatctaagatccttacgtgttgcaccggtgtatgcctgttcggctgcagagtganaggatacacacacgctatgagatctcaggatctaagtgataactaaacctacatagcttctgactcagtgcgtccctgtc

SEQ ID NO: 708037 - DNA, 129 bp, Homo sapiens
gccatggtcatcaccactccttccagggcatgagcagctcgatttgggacaaagcaatcggacatagagatggagggggagccccctgaggcagcccagatcttgaataaagtgtcgacaacacccgga

SEQ ID NO: 708038 - DNA, 358 bp, Homo sapiens
gaggggtgcccagtgtctaacagcatggtgtctcagttacatggggaaacttgggatccccgaggctttgaagatcaagaatcaccagggacggatggagtagggaactaacgtcagtccccgtgggaattcgcccctcaaatgcgacacccgcaggtggataggagccgtgcaggcaggacagtctgtgcctgcccaggatgagccaactcagaaggcagaagacctgactccggaacctctccctctgtgcttgaccttggacaagtcgctgtctccctaccccagagtctgccgagtctaagcgtccttgcgactctacacttatgtgaaaccttttttcctggaccccctcgtg

SEQ ID NO: 708039 - DNA, 153 bp, Homo sapiens
attgactgactttgacagtggtagtgctccatttaataacagataataagctactaaagtgtttttatttgttaaccagtttaagtggatccttgtggtaatttaatctgttgttctcatcccttatatggggcatttttctttaacacacga

SEQ ID NO: 708040 - DNA, 353 bp, Homo sapiens
gctgttagtacgtcatgctttaaacgtctgtgtaggagagaagtggggtttataatgtgtctctgacgatatcttgcggcttgcagacttgaaactattaagcttcttaagcgcctcgtaccggaaatacttctggggaaagttcatggtcccaaaaggtcatagccatacagcttcactagagttcttggaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtatttta

SEQ ID NO: 708041 - DNA, 125 bp, Homo sapiens
agttgacactacagtatgaatttatttatgtgtaataagatttgagaacggttaaaggcttgccacattcttcacattgtagggtttctctcctgtactgaattatcttatgtgtagtaaggtgt

SEQ ID NO: 708042 - DNA, 403 bp, Homo sapiens
ttttttggccaggaggaagggcagatgctccctccttcctcaagcctccctgggtcattgatccattttgagggcatttgggggtcaaagttgagaccagattgcttcagtttgtataaaattagcattttttatcaccccaaggccccccctgttttttggcctcccaaaccagtgaggatgtaaaggtttgttgaggtggaggaacaaaagtgaaatgagccatttgctccatttagaagtcagtcgcttcggctgttcatttcccctaatatttatttaggccctattttgggccaagcattgtttttcccccagtttgccccaaatatgaaaaaaaaaaaatttttggaactgtgaggcttcaatgtgttgtggcccaatatacaaataaaccaatgga

SEQ ID NO: 708043 - DNA, 148 bp, Homo sapiens
  misc_feature (27)..(27): n is a, c, g, or t
cgcaactactaagagctgcctgtgtangcagcttcaactagaatcaaaaggacagtcagaaatatccatactgctaacttaaggagtagcgaggcagagtaatccaaacactgcatccccttttcttatacatacaatagcctggcac

SEQ ID NO: 708044 - DNA, 368 bp, Homo sapiens
tgaggttcaatcgtaagcatgcctcatatctgctgtcctgctgacagattatacagtatctgggtcccatactttgcattgacgcatagcatatgtcgataggccatacaagcattatgccttcaaaatattgtcaagtattgcttcactaagaaatgagaacatcccaaatcttgatccgcctaagatgtgaaatgggcacttagttaagcaaactaacatcatgatatactggaaacaggtatctctttcctttacccttgtgcctgctgaggatcttattctcagccttgctgttttaaactcaggggtgtgtgtacaacatatttaagcaaattctggaataccaaagccaagcagtcttccag

SEQ ID NO: 708045 - DNA, 128 bp, Homo sapiens
attcgcggccgcgtcgaccgagctatttttatgtataaaatatttcggggagacagagtatgtgctctgaattttaactattgctacatagtgacagggatcatccatctggccctgctcagatgtta

SEQ ID NO: 708046 - DNA, 165 bp, Homo sapiens
  misc_feature (141)..(141): n is a, c, g, or t
atcgtggacgggttttccagcctttgggctttgcgcaaggaacgaacttcggaaggagctggaaaggtcagaagttagtgaaagaaggaggcacacaaagggcgaaggagccccatcccttctccgcccctaggagcgcanaggcaggaccgggagtcaggcggg

SEQ ID NO: 708047 - DNA, 677 bp, Homo sapiens
ggattgggctgaggaccaactagaaaaagtagagcttcgagtatttgatttttttttgagacggcatcttgctctgtctcccaggctggagtacagtggcacgatctcggccttgctgcaacctctgcattccaggagaatggcatgaacccaggaggcggagcttgccatgagccaatatgtcgccactggactccagcctgggttagcagagagaaagtcttgtctcaaaaaaaaaaaaaaaaaaaaaaaattaggggaagcagagggggtatcaaaaccccctcaaaagggggaagacgaccagaaaaccccccccaggatagaaacgcgaataaaagggcgccactttttattaaagcggtggctgggaattcacccagacttggagaagcccgcggcgtccgtgacaccgtcctacttgaagggttatgatcataccccaaattgtgggcgcgctctgggtgtggaagcgtgaacattggccaagaagccgtggggttcaacatattttgaacgccgtgtccattcgggagtaagatcttcacaagataccatattggcgcaaaggcattaattcccatgttgtatatatgcgggaggttcacatccctgggcaattataagttctcgcgtggcacagatgacggtgaactagcggacactgaattcgggac

SEQ ID NO: 708048 - DNA, 559 bp, Homo sapiens
  misc_feature (515)..(515): n is a, c, g, or t
gatctagaggatcccgctgcgcctactactacaacccaccggaagtgcagatcacctgaggtacaaagttcgagaccagccgggccaacacgatgaaactcccgtctctactaaaaatacaaaaattagccgggcgtggttgtgcacgcctgtaatcccagctactcgggaggctgacacaggagaatcgcctgaaccccagaggcagaggttgcagtgagcggggagattggcaccacggcactccaaccggggtaacagatagagactctgtcggaaaacaaaaaaaaaaacctacaacccaatttctgggtggtcctctccaactggttacaccaccaatatcatgcacacttggtcctaagcctcagttccggatctctggctctttccggtgagcggagtggcatgccagcagcctagtgccattctatcaatggtggggggaataaggtgctaattggccccaaggtggtctaggggagacctggggcccagtctgggatgtacagggntctgggaagggggcagccttgggggagaacccggctggaggggc

SEQ ID NO: 708049 - DNA, 474 bp, Homo sapiens
aatgtccagtgattggcctttgcttcttaatttattttaattttttacgtgtgccacttaataacgggcatttttaataaaatattgttacaaaaaatgtacagtactgacaccaccacaaatcatggaagataaaggagagtaggtgtgggtgggtgttttatgggtgtagaggggtaagattggaacagtattttcccattgactacttttcggtcgtgggggtagttgtaaaggggaggtgtaaagggcggggtggtacaagtcgaaggaggcgtggccggcgctggtagtggaggggtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcatatcaaaaa

SEQ ID NO: 708050 - DNA, 743 bp, Homo sapiens
caacaaaaaaaacttacgctaggtacgaggctgggtttgggttgtggaaggggcagagctagtgttcgtgtgaaagggtgaagggcctgtgatgtgctgcgtgcggcgaggcgggcctgagagggtgctgtgcgtgcgtgctgtgcggtggctggggttccctgcgccgctggagtccctggccctgatgatgcctgctgtccactgttcctgcctcctgctccctgacgcacctggggctgccgacatgacgcccgatctgctcaacttcaagaagggatggatgtcgatcttggacgagcctggagatgcctccctccccctcgactcaccaaccagcctctacttcgcagtggaagaaacattggatatgtgctagacagattcaaggtcgtcaaatattacgaggagactccactgctgaggaggcagatgagctggatggtgagaatcgactctgcgtaccgtgcacaggagtgtcactgagtacagcggtacagcgcaacctatggcttccagatccacaccgaatggatgctgtctataccttgtcgtgccatgacctcatggcatccgggcggaactggatcgagagctctgatgaaagaaccgtacgtccgaacttcagccccagattgtcaccaagctctcggactctaacaaggagaacgcgctgaacagctacagcacccagaaggggcccccttgaaggcagggaaagcagcggggcggggatctgaggc

SEQ ID NO: 708051 - DNA, 374 bp, Homo sapiens
  misc_feature (138)..(138): n is a, c, g, or t
ccagagtgagagatagggacagtgtgacagcccagcgaggctgggtcgggggtcaccccaggatgttccaaccacatggggcagcatctcctccactccacatgctggccaatgggcacagtagctgcctgtatcgcnctgccaagggggtgtggctcaattgcttgctgccctagtgtcctagtatgggccctggggtgcctgagaacatgacagcaagcctcatggcgccgtgtcctcttgaggctttctctgatttccatcagatgagcgcctccctacagctctgcgtagggcctgggtccagtgcttgtcgttaaatgaatgaccacgatctaaacatggccggggctcccttgcttgactctccgatg

SEQ ID NO: 708052 - DNA, 123 bp, Homo sapiens
cagcatgcattcactgctggcggtcgacgtgtattcaccacggcggtgcatgccacccgtgtacaagttccgtcgacacgtgagcaccgtgcatgagctccaaatatcgttaagcgggagcct

SEQ ID NO: 708053 - DNA, 475 bp, Homo sapiens
cacagagaaagacaggctctgttatagtataagccagagcccactcttagaacctctcattgtacctttccatgtggaaatctatcctcaacggaaataacttctcagtgttctatcgagctattctactactcctcaaggattattcaggccccctcccttccctacacatcaagctcgaggatttgcccccacccaggactggcaaattagctttattcaacatgccctgagtaacaaaaactaaaatacctcttagtctaggtagacactttcactagataggtagaggcctttcctacacggtctgagaaggccaccgcagtcatttattcccttctgtcagacataattcctcagtttagccttcccacctctatacggtctgataacagaccagcctttattagtcaaatcagccaagcattttctcaggttcttagtattcagtgacagactaatggtctattaaaaa

SEQ ID NO: 708054 - DNA, 597 bp, Homo sapiens
  misc_feature (202)..(202): n is a, c, g, or t
  misc_feature (213)..(213): n is a, c, g, or t
  misc_feature (225)..(226): n is a, c, g, or t
  misc_feature (241)..(242): n is a, c, g, or t
  misc_feature (259)..(259): n is a, c, g, or t
  misc_feature (273)..(273): n is a, c, g, or t
  misc_feature (282)..(282): n is a, c, g, or t
  misc_feature (302)..(302): n is a, c, g, or t
  misc_feature (314)..(314): n is a, c, g, or t
  misc_feature (322)..(322): n is a, c, g, or t
  misc_feature (331)..(332): n is a, c, g, or t
  misc_feature (354)..(354): n is a, c, g, or t
tcatatgtctcgatcgttacagcatcactgagtcttagccagaaagacaacttctgccgagttgcctgaacctgtcctctgctttacgaagttgctcctttaaaaaacaagtatcttctttacttgagggtggtaggcaggaaagttctttgcagattttcccttttcagcccaaacattaactgcagccctgccaatctcnttctttgaaantgagtaatcacnngctttctttgttccnncatctaaattttttaanagtctggacctctngacataagncttggtattttctaatttcntgtattcttcanaatgtacncttataaanngttccttttcatctcttctctngtcttcaactgtacattcacagttgttctactttcatagttgtgcctctctatgagtttgtccctttaaacgtgtctaatatcggtttctttttcaacttgttttatgtgttactgacacaatatcttcctcaagctgatgggctttggatgtagcatcactgaacctcttcttaaactcttcattttccatttttaagctttgtgttacttcagtaagacccttttgttctgcttgcagctg

SEQ ID NO: 708055 - DNA, 905 bp, Homo sapiens
gcccctgacgcctgcgtagcgtcgcgagggccgcgagaaccgttcgcgcaggaaagagcgaactagtgttgggatggccaccaactgggggagcctcttgcaggataaacagcagctagaggagctggcacgtgcaggcctgtggacctgggccctggctgagcggagtacttagcttgaggacctcgacgatggagcccacttcctcggaggtggtgatgctatgcccctagttcagcgctctttcccctcactggtccccattgccctggtgtacgctaagcttatgctgtgctgatggacttcaacctgctagtggatgctgtcaggccgagaacgctgccttcctggagacaaactctattgccatcaccagtcaaacaggatgactttaccgctcgtctctttgacatccacaagcaagtcctaaaacgagggcattgcccaggtaaccattcccagtccctactccggtctgtcacctgtccctcccagtctctgtctcgttagtctgttgtagcttgagagaactttggtccaggcccgtcagctcatgggaatctgcctctcactggtcctcactgtggttcatcccagtgtaccaattctaggatgaccagcacagaattattccactgggctcgggagtcgtctgctgggtacctctaatctctgtgtagagttcatggtcacctgtgtgctctgtggctaggtcctacaagtcagtccctgggcaggtactgacaggcgtacaggtgttccccacagactgtgtacctggtgcctgaatcgatcagaactacttgttccaagcgcagcgcaatatggctccacaggcactgtaaaaaagatcgaaatcaacacaatctctgacagactctgggggcctggcactacgtgagcca

SEQ ID NO: 708056 - DNA, 323 bp, Homo sapiens
gtattctgaagacaaggaagaaccaaggatggccaaagaatagcattaacatgtgaagaaaacaaggtgagcagagatgattctggcgctggaatctcctatcccaacattaacgtgtcatcgtttcagacaaacctacagatattccctgacccactgacacacagtaagctgtacattctctaacggactttagtgtgacaactgctgtgtcaactgtatgttcaccatattataaaacaacagcactctgaccaggcacaatggctcacgcctgtaatcgcagcattttgggaggccaaggagggtggatggtggtatag

SEQ ID NO: 708057 - DNA, 923 bp, Homo sapiens
  misc_feature (42)..(42): n is a, c, g, or t
  misc_feature (47)..(47): n is a, c, g, or t
  misc_feature (60)..(60): n is a, c, g, or t
tcattacctcgttacaccaaaaagaaaaaccttcctaagatngacgnacagaagagctgncgggaagaactctgtctgaggaaaagaatccacagctctaccctaagttctagcccagacttctactactcaaaagcggccccgcgaaggggaagccgagggtgccgagaccacaaagcgcccagctgtgtgcgctgatgcgttgcgaactccgcggtttgaacaccaaagacatgtaccttctttcactctgtcatatttcttttttttgagactgtatctttatagactcgattccaactatcggaataactcgctctatcacagcacactgatgcacaattaaaaccctgatggaacctgtccctccctaatcgcccgtcccccccaatacccacatattgccactaaccattcactcccccccatcccaacaacatcaaatcaccatctccattacacgcccatcctaccctacatcacctcctcccccccctccttcgcatcctatcatccctaccactacccaactcccctaccgtcccctctccctctccacaccacttccctccgttacatactcccacaaccgaattatctaaatcgacctccaccataacccccacaccaccacactcacctcctctcccacactccctgccctctacaatcactacacgttcttgccccccatacacacaaataccactcatatccttctaaacctcttctttaatactaattcagtttaccccctactcctattgtaaggcctcctcacacccctccccagtgtatacccttcatattcacccctataatctccctcagctacccacctacacccccctccacccacaccttctcctcgtcactccaccacacaccacataccatattcgccacattattttactctcatt

SEQ ID NO: 708058 - DNA, 430 bp, Homo sapiens
catcgatctcggtacccgtcagacgctgaactatgtgcttattacatcaacctcacctacacaggtattctcatgttcaaatttcagaacaactgaaggcaaatgtgacctttggattttcttaacattatttccctctatcctcgcaaataaatgtagcctgacaataactgacctttttttgtatttttagtagagacggggtttcaccgttttagccgggatggtctcgatctcctgacctcgtgatccgcccgcctcggcctcccaaagtgctgggattacaggcatgagccaccacacacagccctaagtctatgtttagatgtctggggaactgcctgactgttttccaaagtggctgcactattttaaattcctaccagcagtgtgtaaggataatgatttctccacatagttcagcgtctga

SEQ ID NO: 708059 - DNA, 115 bp, Homo sapiens
gttaagaaactgtcattctgtaagagtggccaataatgttagttttatttatcaatttacagaatgacagtttcttttctaacataatattctcattaaattaaagaaaccccat

SEQ ID NO: 708060 - DNA, 127 bp, Homo sapiens
  misc_feature (111)..(111): n is a, c, g, or t
tggctgagataacagaagctgtcagctcacgatgctgagatgtgcggtaaaaactactatgaagtcacaaggactcttgaaggtgtcagaagtggaagaaactggagcttncttagagttgagagaa

SEQ ID NO: 708061 - DNA, 216 bp, Homo sapiens
gtcttgtgatgtaattattatacgaatgggggcttcaatcgggagtactactcgattgtcaacggcaacgagtcacatgacgatgggcatgaaaccgcggtttgcttcacagattcacaagcattgaccgtcctgtctccccggtggggtaacgcgttacgcagcctgccttaaacactcaggctacgccttggcaggaaagggctacccggtgac

SEQ ID NO: 708062 - DNA, 1149 bp, Homo sapiens
ggtgtgaactcgaaccctgcctgctgtctgaccgctggcgtgtggctggggatgctgagagtgttgcctgctggagtgccgtgccttcgtgtgctcccatgtgactgtgtgctgcctgctgtcccgtgcacatgccctgcctgcagatgcatgatgtgaatgaacctgatgcttggaactgtctgtttgcatgtggtgcccctctgtgccatgtggccctgtgcccatgcccctgactcctttcttggtgccctcccagtgatgtacatccccatgatccctgtgtgtcgactggatgtccctgctgggcttgaggcaacaatggcactgtcacgtgtgcccatgtcttggtgcccaatgccccagtgcagtgtgcccatcgcttgtgcccactgtcgaagtgcacttccctgtgctggcgtggctctgtggcttcacacacctgccgagtgccaaggccctggctgcccttgccctgccctgagtgtggcctgtcgctttcgccatgcccccttcttagcactgcacctgccaggtccatgctgctgccaccccagacctgggctttgcctgccacctctgtgggcagagcttccgaggctgggtgggcctggttctgcatctgcgggcccattcagcttgcaaagcggcccatctgcttgtcccaaatgcgagatacgcttctggcgacgaaaagcagcttcgagctcatctgcgggcggtgccacctcctgcccggaggcccggaccttcatattgcggccactgtggcggagctttgccagtggacagctagttgcccacaagcggtgaagtaagctatgcctgacgcaggccgagccaggtctggggcccgtgcatgtgcgccatggtaccgcccccgggccggtgagaatcgtctacgcccctatcccactgagtccgttatgtaggtacacgggtcctggagacacttcccactgtagtcggctcccggcgcggagaacaccgtggagtactgctcacgaaagtccccgaatctggaagcgctcccacacagcgcacttggtcgccacggccccaccgtagaacgccccacagaagtagggagccttctagcaccgtagtttagactacgtccgctcgagcccggcgagcctactctctgct

SEQ ID NO: 708063 - DNA, 951 bp, Homo sapiens
aattctctactatgatccagctggccctccattcctgcttcctgtgacctgtgaatgtagactgtaccctcattggaatccttggtgcctcgtcctcatgtgcatggatatcacgacacagtagagaaaaagcggcgaatgggaatacgcactgtttgagaagatgctacgaggatggaggtgtggagttacgactagatttgatgcatatttagggatggagtctgaatcagtgaatcattgaatgtaggacagactagggagagttcttgtgccaagatcagacatggtatatgcaagaataaatgtgtgcgtgaatcaaaccagaggttgtgttatttcttaatactatatgtattcttgctaacctgactaatccagccagcaaccttacaattctaattatctgactgtagatcctcccaggtgtgtctattgtacataaatgtgtcctcacttgtgaaaaagctaatatctttgtttcttttttttccaatcatgtcaattaatttgtggttattgggttatttatgcactgaattgttgaatggaagaaatattggtgaaaaatattttactgtgttttgattcgaaggacaagctcttaaaattactattaaagtggagttattatgtgcaagttttataaactaaggacattacttgtgtcattctattaagatcttgtcaagttggtcatgcctggtattgacataatttactaatatttaatccttgaataaaattgtgtttgttaatttttatcaaacataaatggtggtttcaatgcactcgattgatgggggggtatttaacccgtggttgtttacttaaggagcacacagtagggaaatgggacaacacaacgcagataacaacagaagggggttgagaatacaagggagaaagaggggtgttatggagagcacagcacaaaacaaaaaatattgg

SEQ ID NO: 708064 - DNA, 395 bp, Homo sapiens
cctatccggtccggggttgagaactgatgtgtgactgatatgactgcctttttatgcgagagggcactggggctttaaaccatgccgcgtcggggcctgcgaaacagctgccctgctccagaggctggagtggaaaggtctcgcggcgagagagacaggagttaggccgttgctcacagacctcagaagcgatcatgagacttgaaacagagctcagcagcacaaatggttccagacacacggctttagtaactgatcacctaaagcagaacctgcctcaccgcggcagtctctgtgcccccattcagaccaccagctgctaagcgacaccccgagaataaccaacatcgtgccctttctgaggaccctgaaacaccaagcccctctgcaggatg

SEQ ID NO: 708065 - DNA, 386 bp, Homo sapiens
  misc_feature (22)..(22): n is a, c, g, or t
  misc_feature (39)..(39): n is a, c, g, or t
  misc_feature (51)..(51): n is a, c, g, or t
  misc_feature (172)..(172): n is a, c, g, or t
  misc_feature (191)..(192): n is a, c, g, or t
  misc_feature (222)..(226): n is a, c, g, or t
  misc_feature (232)..(233): n is a, c, g, or t
  misc_feature (243)..(244): n is a, c, g, or t
gtccacatgcctccgtccctgncgtatggcgccacctcntctggcagaagntggattttggccccacctcgtcggcaggaacaggagtagatccagaagggttgggaacctaacctgagctcagtccagttcaccccgtcacgctccaaagcctggtgggtctccagacacngccaggcccctcaggacgnntggagcctggaggagacagccacggggtgnnnnnctgggnntgaccccacnntggtgggcagcagggctgcccggcaggcttggtggactctgctggcagcaaataaagagatgacggcagcctggctcctgtctgccttgcgtgtgtgtgtgtgcctctttgggccatggtggttaggccttgtgggcattct

SEQ ID NO: 708066 - DNA, 161 bp, Homo sapiens
acttagagggtagagctaaagagtcagctgctctgctgtctgaccaaagtcccctttgagctgcgggagatcagacgaagcatcaggctgataatgtggaaagctctctggcccattaggaggtggcatggtagtatagaaagggaacctcaggcttcaga

SEQ ID NO: 708067 - DNA, 252 bp, Homo sapiens
atgtgtacctgaaactgacatagaggaggagaattgttgaacctgggaggcggaggttgatgtgagcctgagatcgcaccgctgcactccagcctggtgacgaagcaatgactccgtctcaaaaaaaaaaaaaaaaaaaaaaaaaaaaaattaagtttcggtttaagggcctcttttgaaaaaattggctgggaaatttggcttttctcgagagggcgggtctggaggagggcctaagaggagcggggactg

SEQ ID NO: 708068 - DNA, 817 bp, Homo sapiens
acgtcttcacctgctggagatctgctgcccctgtggcaggtcccctgtttcctcacttgcggctcttcgaatgtgctctgtggtgagtgccctgatgttgtgggctggctgctctagtgtgaatgggaccatgtgagctcctgaactacccctcagcatgaaatgtgtgttgtgtggcatgtggcctgctggcaattggagaccctggtgtggggtgggatggagaatggactggtcctggaatggtgaccttttgacatgcatgacccgtacaacctgcttgcccttccctgtcacctttccacgcacaccaatgcacaaaccgtccagaggatccgtcaccaggaatggccactgaagcaataatcagtcttatctagagtagaaaaacaaacttcagcataagagttggtagagggtaatcaatcatacatcatgacttaggataatcaataccatgaatgatagtatggtgctttggaatgttgatgaataacgcgaggggaaggatagaaaggttaggatagtggggagatatacaacgaaaagaggagatgccaaagaaaggtcgcttcttcgtgcagtgacccatggatgtgtggcagagaaacaatccaccacttggacagaaacttggaaagaaaaatggaataagtgagaacaagtaatataacatacaaataagatgtgacaaagtggaaagtggatgaaaggtaatgagaaggaagcaagagctaatagaaataatagtagaagagtaaaagaatgtaggaagaagtaaagagaataagggaaaaaaataaaacagaataaagga

SEQ ID NO: 708069 - DNA, 173 bp, Homo sapiens
aaagacgacatgctggtggcaggacataggacagcaatggttgtatcaactatgaagcgtctgtgaggcgtatcctgtcggggtgacgggcccatgtgggcggagctcgtccgcatggtgctgaatggttgatgaccttcccagtctccccagattccgtgcctttccctgtg

SEQ ID NO: 708070 - DNA, 705 bp, Homo sapiens
  misc_feature (218)..(218): n is a, c, g, or t
agtggggatgtgtatatgcaggcctgaaaagtgatggagggtggggtgggaacaatggttgtgaattgatgatgcggaggatgaagtgctctgcgcgatgcacgactgctggggtccagcactgggtggcagacgagttggcattctgtctattacacatcaagtaaactaagtccccaatgacttatgtgacctgacactacactataaagctcggntcagagttgctggctgccctgcgtcctgtggatccgagaacacgtcgtcgaaggaagtaggtccgtgtgatatgcgtctctgctactgttggggaatatgggtggtgcgtagtgagggcgaggtaacgacatactgatggcaaagtcttgtgatgacatgtagcagagtctcctgtctcactcgcaaaatcatggaagtggtttaacagtttttggttgactaagctaatgtaaaattcaggtattagaaaatttatggtctcaggtggtccataggcatcttgtgcatgagggaaagcagaagtttacctgaagtgatactgcatattgttgggtgcatgcattcccatagatttttagcatctcgccaccaagtcttccccaatttcctttgaactaaacctgtgagaaaaaacccgggacaacatgacaaagagggaaataccatgggaacaccgtgattctcaggcggcaggccgaaattcga

SEQ ID NO: 708071 - DNA, 154 bp, Homo sapiens
cacacgctagtcatcgtagtgtcaggtacattggtggccaattgatttgatggttagggagggatcgttgacctcgtcatgttatgtaaaggcatgctgtatcggatgggagggcgatgagtgactactgattgagcttggtgtgtggtgtgta

SEQ ID NO: 708072 - DNA, 578 bp, Homo sapiens
  misc_feature (575)..(575): n is a, c, g, or t
gtgggttgaccgtggctttgtgcttgttaaacctggtatttctactgatacagtatttgtgtaggtttctcagagtgttcagtttgatatactctaaaatagtaagcaatgcttttttttctcagggtgtcaatattgagaaccaggtagatccccaccacctacagtaaaaaggaccctaaagtaaattggttgaagaaattagatcccaaagattcttggtgaattttgaagtcttcatcagtatatccatattaaaacgagatgccagaagccaaagtaattatgggctgccaggccaactggatcagtttcattaaaaagggcaaacttgaagataaatcttttgaccccagctctttagaggatttaaagtgcccttgatggccagtggaagaaatcccaacatggaattcctcgaataccaatttattgcctttaaataattttgtttaatgctacataaacccaattaaaaaccctttcccctatttttaaaaagtcagcatgtatttttggctcgaagtttttctagtgttttttgtggaaggaataaaaatttgagtttcagttgngta

SEQ ID NO: 708073 - DNA, 759 bp, Homo sapiens
aagatgctgaggaatgggtccagcagctgaaattcatattacaagacatgggatctgacgttattcccgaggatgaagatgaaaaaggggacttatatgatgatgttgatcatcctgttccggtcagcagcccacaaaggagccaaccaatagatgatgaaatttatgaggaacttccagaggaggaagaggacaccgcttcagtgaagatggacgaacaagggaaggggagtcgggacagtgtacagcatccctcaggagataaaagcaccgattatgctaatttttaccaggcttgtgggactgcactggatctctttctgatgagttgtcctttaagcgtggtgatgtgatttacattcttagcaaggaatacaatagatatggctggtgggtaggagaaatgcagggagccattggcttggtgcctaaagcctacctaatggagatgtatgatatttgagagtctgggcagaaataaatcaacatttctactgaagaaaacaaaacttaaatgtagctttccccttttgctggcacagaagtctgtccatctgcaagcgctttggaacacagactgcctggagccaccttcctttgggagaccttcctgcctcagctgtcgtcctgtgtcgtcattcactaaagctcctgacgtcagattaagcaagcagttgatgggttacattagagacaagccgcagagataaggcctgttgctgtttccgcagatgatgatgaagttttaatttacccacg

SEQ ID NO: 708074 - DNA, 237 bp, Homo sapiens
ggtagcaaaaaaaaaatcataatggtgatgcaaaccggctacatctacaatggaaggtgatacataaattatatagatcacaagtttcctttatatactattaaaaacccaattatattggataaatatgtccagaggacaacatgggttcttaatgggatgggctggagtccaaatatgcaaaatatagcttctgggttttggaccatggtggctatggaaacttctaaaacaagg

SEQ ID NO: 708075 - DNA, 100 bp, Homo sapiens
gttcgcgtatcataagtggagtcgtaaagaggtatctttactataaaagctattgtgtacgctcgtcatattcagttgttggctcaggagttttgatagt

SEQ ID NO: 708076 - DNA, 1012 bp, Homo sapiens
gggctttcaaggtggaaggtgcgcagtttgtgctctgtggagtgagtgtctgctggacgagaacagcatgctgatccccatctgctgtgggtggtgccctgtgcgtgtggctggtcctcatctgtcctcatcgcctacctctgtcggcagtgaagaggagtcacgcaggctaccagactatctagcctggtgcacgcagtgcacagacagctgcagtgggcctactgttcctttactctgaggcttagggtcctagtcgaacggggaggcacactttcttggcaaacgtctctcaaatctgcttcatccaatgtgaccgttcatcttgcagcatattactatgcacaacagagtaactatcgaaatgactggtgtaaatttatgctaactgggttcacactattattgctaactgcgttcaacacattcaatcatctacccaaagtacgcgcatttcgagcggtgcgttggtgctctctctgcacgccgctgacgggatgccgctctctctcgactgtgctgacagcttcctacctccctcactaacgacaataaaaaataaagctctatctacagaaaatatagcaacaatctcaacaataacataaaaaacacattacatccacaataacacatcaatacaacaaaaacaacaatccatacaatacccacccaactatgactactttacattcaaaaaaaccacataagcaaaacaaaatccaaaccaaactccaccatcaacactatcaacacaaaacaacgcacacaccacccatacactacaagacacatccaaatcaaacatataaaagaacaacacacaaacaacatatcaatttaacaaacaaaatacaaaaaaacacaaaaacagaacaaactacaggagaaataatactaaaaagagcaacaccaggcgcatggagaacacagcacacgcgagcaaaataaagcgaacaacaggcaagagagaaacaaagcggcagcaacacccacaaaaggcaaaccaacg

SEQ ID NO: 708077 - DNA, 219 bp, Homo sapiens
  misc_feature (10)..(11): n is a, c, g, or t
  misc_feature (17)..(17): n is a, c, g, or t
  misc_feature (34)..(34): n is a, c, g, or t
  misc_feature (36)..(36): n is a, c, g, or t
  misc_feature (74)..(74): n is a, c, g, or t
  misc_feature (93)..(93): n is a, c, g, or t
  misc_feature (124)..(125): n is a, c, g, or t
  misc_feature (128)..(128): n is a, c, g, or t
  misc_feature (133)..(133): n is a, c, g, or t
  misc_feature (144)..(144): n is a, c, g, or t
  misc_feature (150)..(150): n is a, c, g, or t
  misc_feature (219)..(219): n is a, c, g, or t
aaaaggggcnnaaaaanacctcaccccacagaantncttgtgaagatttttagatttagggcataataataggntcaacacagaaacctgatnactaatgaacacccagattaacatcaactannaantttgntttctagtacntatttncatacatgtaaatttaataaatactactttatcttatgtatgatgataataaaaaagttctagaatttn

SEQ ID NO: 708078 - DNA, 1571 bp, Homo sapiens
gcagtgtcgtcggcccaggtgttgggtcgactcggggagggactgggtgttgacctgggtccggggaacaggtaacacttaaggatcttgtgactttttgtcagaggtctgcatggaataggagtgtgtacgatgcgtggtgatgtaggcgatctcttctggacatgaaaatgtccccatatcattaatgcagttggtctctgaatgaaagagtgagagccgcattggggcaaggtagccctgtgtcctcatgaaaagactgaacgccatggactattagcgatctctatggcgaaccgagtgtacctattagcagttgggtcgtctaattgctcttggaaggctcgggacactggagtgccttgtgtatgcgtactccaatggccatggttctatatacagtcctgatgcgtgtcagctagttactgtgtcacggcctacaaagaatcttggttcaatgttcctgtaaatatagtaaacgttcacacagagcatcaacggtgcctaaagtggtaaaaatacctgggccaaacgccctgaatcctgcctaaggcacgtgcaccatccacatctggtgagtcgacacgctcttctctgggtaagagacgtaacatcccactgatttgggcacaatatgtttaccgggggaaagctgtgagtgattgaaccgtgcgtgacatgcgggaaacgagttccaataattctttgtataataattaaacccacggattaaaatggctatgccaaggtgtgaaatatacccaaggggacaccatccactacttcatgagtggcattggcgtaccaacgggtttacggtcccagggcgaccaggattctggtttggactcgcttggcatggccaacattgacctagtgtgggtttcaaccccgggtctgtcccacacgggtggtccgtgggaacacatgacttcggcggggcacttttggtcacatcgggaccaacgggccattggacataaccgccgaatttgggtccaaaaaacacgataaatagaggtcccacaccaagtgtaggaacgcgttggtgagggaccttggtgtgcgccacccttgggtggaacactttgggtggcaacaacgtctttggaggccatgggtggaacatcaatcacattgggccttggtgagacagcgaattctgcgtgaagccactttttctctatcggaacgagacactttgggccattctgtagaagagtttgtgtggcacagctaacacacgagcatcgcgaacacacaacccctctatggagaaacggggcgcagagcaaccggggacgcaagaagcaacgggccagaagacggcgaaccaacttagcaaaaagcgagccaacaaatagaggcccgcgagcaacactcactcactcacaaatataccaccgcgagcgacgaggcacagccaaccagtatgatcgatagacacgtagtcaaacgagcgcggtactgaatacaaagcacactagacgaacgcgacaaccccacgaagcacaacccgcacaaacacataagacaacaccgcggaaccaccaacaccatagtacagcgtc

SEQ ID NO: 708079 - DNA, 167 bp, Homo sapiens
aaccagttcctctgggtgcctcccacttgctagagtttacgtgagatgttgatctgtgcttcctggatttgacttttaaaggagttatcctggcagcacatgtagtattcttggatgatcttgctgctcttatttctcctttggtgtgtgtgtgtgtgtgtgtgtgg

SEQ ID NO: 708080 - DNA, 453 bp, Homo sapiens
  misc_feature (2)..(2): n is a, c, g, or t
  misc_feature (25)..(25): n is a, c, g, or t
  misc_feature (33)..(33): n is a, c, g, or t
  misc_feature (35)..(35): n is a, c, g, or t
  misc_feature (39)..(39): n is a, c, g, or t
  misc_feature (46)..(46): n is a, c, g, or t
  misc_feature (48)..(48): n is a, c, g, or t
  misc_feature (50)..(50): n is a, c, g, or t
  misc_feature (59)..(59): n is a, c, g, or t
  misc_feature (63)..(63): n is a, c, g, or t
  misc_feature (65)..(66): n is a, c, g, or t
  misc_feature (69)..(69): n is a, c, g, or t
  misc_feature (72)..(72): n is a, c, g, or t
  misc_feature (79)..(79): n is a, c, g, or t
  misc_feature (92)..(92): n is a, c, g, or t
  misc_feature (106)..(106): n is a, c, g, or t
  misc_feature (111)..(111): n is a, c, g, or t
  misc_feature (119)..(119): n is a, c, g, or t
  misc_feature (122)..(122): n is a, c, g, or t
  misc_feature (124)..(124): n is a, c, g, or t
  misc_feature (128)..(128): n is a, c, g, or t
  misc_feature (130)..(132): n is a, c, g, or t
  misc_feature (147)..(147): n is a, c, g, or t
  misc_feature (150)..(151): n is a, c, g, or t
  misc_feature (153)..(153): n is a, c, g, or t
  misc_feature (163)..(163): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (189)..(189): n is a, c, g, or t
  misc_feature (192)..(193): n is a, c, g, or t
  misc_feature (196)..(197): n is a, c, g, or t
  misc_feature (200)..(200): n is a, c, g, or t
  misc_feature (202)..(202): n is a, c, g, or t
  misc_feature (207)..(207): n is a, c, g, or t
  misc_feature (212)..(212): n is a, c, g, or t
  misc_feature (215)..(215): n is a, c, g, or t
  misc_feature (221)..(221): n is a, c, g, or t
  misc_feature (223)..(227): n is a, c, g, or t
  misc_feature (229)..(237): n is a, c, g, or t
  misc_feature (244)..(244): n is a, c, g, or t
  misc_feature (246)..(247): n is a, c, g, or t
  misc_feature (255)..(255): n is a, c, g, or t
  misc_feature (259)..(259): n is a, c, g, or t
  misc_feature (262)..(262): n is a, c, g, or t
  misc_feature (269)..(269): n is a, c, g, or t
  misc_feature (283)..(283): n is a, c, g, or t
  misc_feature (285)..(285): n is a, c, g, or t
  misc_feature (289)..(289): n is a, c, g, or t
  misc_feature (292)..(292): n is a, c, g, or t
  misc_feature (304)..(304): n is a, c, g, or t
  misc_feature (314)..(315): n is a, c, g, or t
  misc_feature (326)..(326): n is a, c, g, or t
  misc_feature (352)..(352): n is a, c, g, or t
  misc_feature (358)..(358): n is a, c, g, or t
  misc_feature (451)..(451): n is a, c, g, or t
tnaaaaaaaaaaaaaaatttatttnaaaaaggntnagtnaaaaatntntntgccaaaanaaangnnggntgngggaaantttcatttcaaantgtatgaagggggnggggnaagggggnccncncctntnnncccccccctttgtgnggnngngggggggggntccccccgagggcnggnganaccggnccnnccnnccngncgaanccccntcncccccnannnnncnnnnnnnnnccccttntnntttggggncccnttnacccccnccccccgggggggngngggnggngaatcgctttancccggggggnngaggttgccgnccccccccccccccccccccctgggngccccnccccccctccccccccccccccccccccccccccccccccccccccgtggcttctttctcctttttcccttctttgggcctttttcccttctncc

SEQ ID NO: 708081 - DNA, 1631 bp, Homo sapiens
agctagtctgcaagggagcccctagacccctggcagacatagctagcttcagtagcccctatatctactactactagctagataggatagtatgatagcactaggaggtctatttagactagacccttagcataggcagcctgctaggaggaggagagagctctagctaggcatagagccacagttatcttgactaggaggccatacaaccctactaatggtatgagagccatatagttctagagccctagacatagtagctatagggcactaggtaggtgccttgggcctatctagcagagtaggcctacctagccctagatacagggcaccactaccaccgacttatcctagggacctactacagattagcacaacagcagccacaaaccaagtgcagtatcaacatcatagcacacagattaagcacagcccttaggcaataatcgcaggctatataacatagcatgtaatatcccacctgtaatcagcatcagggcataccatggcacagccagctagcataggatgggctatgcggcacataccagtaggagagcccaaacgcgtgtatactactaagtactcctaggtattcaacataggtaggaataaagggatacaaccacgtcagtactatatacactaggctagaatagccctatgctaaagagcgagtaactagtagaggataaaagacagctagggcacagcaagggaccacgtcgatggccatggaaactggatacaccccaggacataacgcgacacctacacgcacacgaggcccctagctgagatcccctacgaccataggtagttcgccaccggtgaatagcgaccaacgtacgagaaaggacacaagcacacatgaacaacccaagcctaccggatgtaatcgcccaaaagctatggtaccacgtaggcataggctcatacaaggacagaccagatgaatccacgagcacactagctagacacacaatagtgcaaatgactgcaacaaataaaacatgacattaccatactaggagaacccctactaatcaaacaactactacacgtattataggcgacatgagtacacacagacgataccgtataggagaactacagtggacagtcaccgtgcagctcgaaaagcgggagagaggtcgagtatccacgaacagcgcgactcaacagcgagagagatactacacaatagaaaatcgcaatcgactagaaagtcgaacattatacgaccatctcataacacatctagatacaccccgatgagaacccacatcaccccacgctatcaacatacaatacgagtaagacagaccgaactgacaccaccatataaccagcactagacgtcactgagcgaacaaccatgacctcaccccactcgtcgctcgaccacactagtcagacatacaacacaaactgctcaccagccccaacgcactcagcacaattactcgccacgatacatcgaacatccaaccaatacatacctacatcatccactagctacacctcaacaacacacgcacgctacgtcccacatagccagtccttcatcatctatccaaccactcacaaccacatcaacgcaacctcactaccaccccacgcaaccagcc

SEQ ID NO: 708082 - DNA, 155 bp, Homo sapiens
gacgctctctcggtggggcacagggatatagggtacaggcatagagtagataaggatcaggttaggttaggatatccatcacttcgagtattaaccaggtgtgagggaaccatttcaaagccttttctacgctatttggaaactatacaactaca

SEQ ID NO: 708083 - DNA, 1038 bp, Homo sapiens
ggcgccgagcgatggtgcatctctcgggacaactggcacaatgctgcctgcaaaacctgtgtggtgcaagatgaaatgccctaccacaatgaatgcgtgaatgtatgatgtttgtggtgctgcccatgctgccacacaccaatgatttgtgccccctgacctgctatccatcacatgatcctgtgttgctgtgtggcatgtgtacacacagcacacatcacctgatgcaccttgcagtgtttgtgactgttggcgtgacattatcatccctgtgtgttgctccaagcagttgtattgtcacatcctgtcacacaaccaatgtgaatccatcagacatagtttgtactaccaaattggcaatcatagatacactgactgcttgggtatctgataccaatgaaccacttgggtgacacgaactttgccatcgttgactcactctgagcaatgacgaacaccactggtagcctgaccatgttgtgtcactgcaggtcctcaccgtcattgctgacttgcaccccttgtgtgacctggccaaaggcaacacgtggacatgcccaaatggctatgaactaccgttgcagtgcacagcacaggaagcatttcttaaagaccgacacaacacagcggaattcgtcacgacacagacacatctcgcatgcacagcacaaatcattgcattgcacaaagctgcacacataacagacaaagtcgcccgagagcaaatccaaggcccagactcatcccattgagcatgtgcaagcccagatatcccgagaccaagaggtgcagaaacaggcatttcattcttgccaggtttgacacattcatggcgttatacaaaatggggcccagcgggaacacaaggtgatggttggcggcaccacgaatgccaagcaatttgggccatacacttggttcggcattaagaatgaggcgaccacacacaggaatgattataggggagagttgtcccttaaattcccgttacagagggaaagacaaaataccacaaggtggccccccaggacgagagaa

SEQ ID NO: 708084 - DNA, 367 bp, Homo sapiens
cgtcgacgttagttaccagagagacgagacagaaggttagttaccagagagacgacagaaggttagttaccagagagacacgacagaaggttagttaccagagagacgacagaaggttagttaccagagagacgcgatagaaggttagttaccagagagacgcgatagaaggttagttttatacaatgacgtaggttagactaatacaatgacgtaggttagactaatacaatgatgtaggttagttttatacaatgatgtaggttagactaatacaatgacgtaggttagttttatacaatgatgtaggttagactaatccaatgacggtcgacgcgcccgcgaatttagtagtagtagtaggcgg

SEQ ID NO: 708085 - DNA, 153 bp, Homo sapiens
cgatattgcttacaatgcgagatatagtttaccaggtccacatctgtatttcgaccgtcgtgagacagtaaatggacagtgtttagctgtccattcccgtacatcttgtaaacagtttctttctttgtgcttcaatctagaatgtatcgttgt

SEQ ID NO: 708086 - DNA, 361 bp, Homo sapiens
agtatgcctctgcactgtgaattacatgtgccttctggtgggccagtagccatttccccttcacagtgggactaaagacacttggcatctctcatctggcacatcattccaagaggggctgttgttctcaaggaagagcacttggaagaatgaatgaatccatataaatccatgactgattgaacgctcaccctgtgccaggcactgggaacacagtggtcgacaggcagatgaagcccttgttcttgtggagactccatttctattaggaagacatggacaataaataatacatattgggtattagatgaaagtcagcttccagactcttgctgagcatgactacaaaaggtgagagaaa

SEQ ID NO: 708087 - DNA, 736 bp, Homo sapiens
tgagcggatcgggggtccggagcctgtctgcggctgctaaggcgctcggcgcctgtgttgctgtggctggccaaggctgtgagtccctgccgcggaccggggcagggcaggcgggggacagaggctggaggtaggagcgggacggtccccagcgggtccgagcggagcgggcagccgggtaccccggcgcgcatgccacggggatcgggaaggggctgggagagccctggaccggtgcaaggcggaagccagcggagttgtcactcggagtgaggcccatggtggatcgcttcggtccatatagccacgtgtcccaacagtgttgcaacacagggaacccccgaggtggtccacattccactggttgcacggacaccaagacgggaatctggctaaaagtatccaggcatttcccattgtcatggctcaaggaaatcccaggtagttggcattcactgacctttgaatgccagtggatgggtaaagcccatgcacggggcgccggcttttgccgaggccttgccaaattacgggcccgatattccggaacgtgcaacgacatgtttgtggagtaacccgagggcagttgttggtttaccccaacaggccgtggattcgacaataaccaagggcatcacaccacccgatgtgtatcaccagatgcaagtgttacagaagcagacggtgtggccccccaagtggttgcgtcccccacatacgggtggccgtgaatccc

SEQ ID NO: 708088 - DNA, 358 bp, Homo sapiens
gtgttgacatgacgagacaacatgcacacaggctagccagcctgtggccatgatggctcgaggggcccagtgggctcaggcacccgtccccacacgagggccccttgtgttggcctggccctgctttctactgccaatgttttgccagctccatgttctcccaaataccgttgatgtgaattattttaaagtgcaaaactgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccgtcggg

SEQ ID NO: 708089 - DNA, 337 bp, Homo sapiens
gccccttatagaacccccgaccgtgtacacacacacacacacacacacacacacacacacacacgctctatatttacagggcttatctgctgaagctacttgcacgggcagagatgaattctgaaatgcctagcacactgtcaggaacacaacagctagtcaaaggtgtgtggctggttggatgtgagagaaaatagctgcatacgatagaaaagcttacgcctagatgatgtgtatgtcaatcaaaaccaactaaggaagaataagttttaaaagaagattatctgggtataacagagctcggctatagggcaagttacttgggaagctgaggttg

SEQ ID NO: 708090 - DNA, 1090 bp, Homo sapiens
tccagtgattggcatggcagaaggctagtggactacgcagtgtatactccagtgcaatggacctttttcctctggtgagaccagcctggaaggcagtggggctggaaaatgctgacgcctgtagtgtcactagctccaacagcctgggttttggtggtcatttgggtcacgtgtgccagtgcctccctcttgcctatgttgttatggtatcatgcgtgtgctctgggtgcttatctagggcagcatgtcggcctgatttgagcccacgtgcatgggtaacagctccttgcccctggctagtaagtaatctccaggtctggaggtggccctgggtatgactggaggaagtcctgtatcccttctgactccagcctcctattattgcaactgtttccttgtcacctgcctggcccaacgtccttattctggtttattaatgagacacataaatctgatccccactaatctccactggcaacgctggccaggaacgggaagcctgccagaaggcttcagctcttttcagggcagaatggttcagacactgggcgacttgggacgattgtgggtgacggcaggggactacacagtgagacttccttgggacgggtccggggactctttggctggggtgaccgttcgcttactctccctccgattccagatcttcctggactccaaatgacctaagtgagagggcagtgtcttggaatccctcctcattcctggacttcatcctaagtgtgaaggaatggaacaacttgagcttggtccccctgcgacagcttcttggagacaatcccaaggtcctcgcctattgcaattccccctatggcacatggacccctcgaagttaagctctcgttggcccacgaacgtacgtcttatgactagtgaaactgatgctgtgggtaaaggtcattggggcccacattcaagctttggggacctcacggcctaggccgacagttatgtgctcaccagagaacccttgtcgcctggtgcctgtgacttgaactcacaatctgggcggcgtctacgaggcgaccacagtgtaactatgagcgtgctttgtacccccgcgccggtg

SEQ ID NO: 708091 - DNA, 185 bp, Homo sapiens
cacacatatctgtcctggaggtactgtgtgataatactgagaggaaatggcccccgtggagaatcctgtagctatggacttcttcttctcccacaaagatagcatggtcactcttgggctccctcccttgcacaggaattactgccactcgtattgtaacactctggtgacaggaactagcatgg

SEQ ID NO: 708092 - DNA, 895 bp, Homo sapiens
cgctcccgggttcaagtgattctcctacctcagcctcccaagtagctgggattacaggcacctgccaccagcctggtaattttgtacttttagtagagatggggtatgaccatcttggcaggctgctctcaaactcctgacctcaggtgatccgcccacctcggggcctcccaaagtggtgggattacaggcatgagccaccactccctgcctttactttgattaacattcaatataatttcatactggaaagaaattcctaacaaagtgagaagcaatggtggcaaaaacttaaaacaccttatttgcaccagaaaaagcattttatgttctgaggaacacaattataccaaataacaggactggtgaaacacagacataaatatctgtttacaatctttaacaccaagagagttccattactttaataaaaggcacgataaggggcacttactgtccaaaagggtcttctccgcacacacattctcacccccttaaacgtggacgacagacgacctcactcttggaccactggcccttacacaccactacaagagggttgtcagtaccttcacttgacatcacatttactgtgtcaccattctgtccaggcggaaaacctcggcaagcagtggtcaagcttggtcaacattagggccttatctcgcacagcggccgccgatattatcaaggggcaaacactttccaactcatcgaaaaccccggtatagggcaatttgcggtgcccagcgaacatatgcaccgggcgggaacaccatttcacatccgcgccggacacccacaatccgtcactcaccatgccactgaacagcagcacgaccacactttgaacgacgccccgggaccagacacccggcgcatagttgctcacccc

SEQ ID NO: 708093 - DNA, 991 bp, Homo sapiens
  misc_feature (24)..(24): n is a, c, g, or t
ccattgctggtcgacccgcaatantgcatatgtcgaccgagcctcgggccgcgtcgggcgacctgcgagtgcctgggtggtcgggtgcacacatattgggcactgctttgtggcacagcgccctgtgtgtggcagcgtcaagcttctagagaattaccttatcagtgcaggagaggattgtgtctgcttggtgtggatgccatgaagtgtgagatcctccagtgcctttcggtggacaccagggacgtggtgatcctgggccatagctgcccatgagagtgcagtgcctggtgtgatcactggtgggtgatgactcagtgcattcggctgtggcacttggtagggcgtgggtaccggggattgggcggtctcggactcttctgcttcaatgtcccgtaggtagtgccaggtacactcaatggctgtgacttctggactggcctctttgggcgacttgcttggcacgtgaccttgattacagggtgccctgtacttctctatgacgtcgcaggtcaagtgctgggacgcagctgctagaggataacacatttccaggtcctacttgccttgctggagtgcagcttcctggtccccgagcggcttcgggattgtgtgctaatggccaaatggcgaacggtcgtgttccatggttgtcccccatcaacactccaactgcttgctgtggaccagaccctgtttcttgggaaggtgcacagctttgagcttgggccctgacgtgggtcattgagcgagcctccttgttgcttggcatcgggggcccttggcggggtagtagccttgccttagagatctcagacggcaccctcttgtcaagtgccctctttgtcactggaaacggttgtcgggtacctgcatgtcccgcgaagcaatgcgacgaatgggacacatgtcagtgccctatcctacccccagtgacttcttggtgcgtgtgtgacggcggggatttggcttctttctgcgcttcagagta

SEQ ID NO: 708094 - DNA, 818 bp, Homo sapiens
aatctcttacgacctccatgccggggcactccacacattgcgcatgtccacaaaaacgcttgctcgaacggaaccaaatccagcatttcgtagaatgtcgattttggtcatcgtaccttgcttgaaatagtagtcctcgtgcagatccaaatgtaacgattgttagaactccagcgcgagttgcgacggtacaaggcagtgtcgaatctatccgtattacatccacctcgacacgcccgaccaacctcttgggcatgggatcacagtgagccttcgagggtagcaccaaagactttgaggcaaagaaaaaaccacctgtagaaggaaaaggctggatactggggagcgcctctgtctgctttgctggccatcctcttcttcaacaacaaaggacacgctaattctatgcagcaaaagtttccaaacacgttagcctaagaatttcgagtcatgcaaaaaataaattcccagagtcacagggttaacaaaaatcagattccaggccccatccttgttgttcctgagtcagactccccagtcaaactgccagagaacctcttctttgaacaaacacttcaggcaactttcccaggatacagcaagttcagaaactctcacacagcttcttaggtatctcagatatggctctggccctccagatgttaccaaatgaaaacaagaaatctggtcccaacaagcaaaagcccagagagacctcaaacacaaagatgcaatccaaccattcagtacgagcaataatgagccggacgttgtacttcggtcgggggctggactgaggtcattacctgcaagcgatg

SEQ ID NO: 708095 - DNA, 867 bp, Homo sapiens
aatcccagcactttgggaggccgaggcaggcggatgacctgaggttgagagttcgagaccagcctgaccaacacggagacaccccgtctctactagaaatacaaaattagctgggcgtggtggcgcatgcctgtaatcccagctattcaggaggctgaggcaggggaatcccttgaacctgggaggtgcaggttgcagtgagccgagatcacaccattgcactccagcctgggcaacaagagcaaaaccctgtctcaaaaaaaataatcatcaaattccactgtgatggctttattttcttgagaaaagctaagaagtaacaacactaaagttactttaaaggagagtagactctgcaataagagtcgtgagaataaagtgaaactctccagttcatctttaaaattagaaaagaggctggatgcagaggctcacacccgcaatcccagcactctgggaggccaaagtgggaggaatgttgaggttaggagttaagaccagcctgggtagcataataacaccctgtctctacaaaaaattaatttaaacagattactgggtgtggccaggcacggtggctcacgcctgtaatcccagcactttggaaggccgaggcgggcggatcacaagtccaggagatcgagacatctggtaacacagtgaaccctatctctataagaatcaaaatttgtgggctggtggctgacctgtagtccagtacccggaggtgagcggagatcacttgaccaggcgatggggtgcatgaccagacctgcctggctcaagtgtaaggagcgtcaaaaaaaatggggtggcgcttcccctggcgcggggtttcccctgggtttcctgcgccccttttaaaag

SEQ ID NO: 708096 - DNA, 127 bp, Homo sapiens
tgactggaacctgtactggaaccagctttgctacgtctccttggaaacagagactgggcctccaaatggagataggatcccagagtcttgtagggaccctggcgactgttaggggactttactatct

SEQ ID NO: 708097 - DNA, 164 bp, Homo sapiens
ggtgatctagaggatcttctgggtgatgatgtgaaatcacctgggatcttgtaaaatgcagattctaattcagcaggttggggcacaggctgcagattctgccgggatgtgtgtgtgctgtgatgtgatgctgtgtgctgtgtgatgacgacgggggtctcacc

SEQ ID NO: 708098 - DNA, 190 bp, Homo sapiens
ctgacaacagagttttactccttcttaaaaaataaagaggatgaagccgattgcatactatatgcaatacacaggaatgaagagaagatgctattgacactttttgtatttgagctttcatagactttttcttcccttaaccactgcagcaaaaaatcaccatgtaccagcctatccaaacttatccatg

SEQ ID NO: 708099 - DNA, 493 bp, Homo sapiens
  misc_feature (37)..(38): n is a, c, g, or t
  misc_feature (113)..(113): n is a, c, g, or t
  misc_feature (339)..(339): n is a, c, g, or t
  misc_feature (343)..(343): n is a, c, g, or t
  misc_feature (345)..(345): n is a, c, g, or t
  misc_feature (353)..(353): n is a, c, g, or t
  misc_feature (355)..(355): n is a, c, g, or t
  misc_feature (391)..(391): n is a, c, g, or t
  misc_feature (398)..(398): n is a, c, g, or t
  misc_feature (401)..(401): n is a, c, g, or t
tttttctcccggggttttccagtttcccccccccttnnggccaaagggggttttttttgggccccaaaccaccggggtttctcaaaatttgtttaaaacccccccccctttcnccaaatgggggggggggggttccggtgggggttttttttaacccgggctttttttttgaccccccggtttgccggggggcccccccccccctttttttccccccttaaagaaacccggggggggttcaccccccgggttttttttttgggcccggggggggtttccctttttcccccgggaccccctttgccccttgggccctttttggggccccttttaacccgntttntnccaaaaancnggggggggccgggccgggttttccggggtttttttnccccccnggnccggcccccttttggataacttgttgggaaaattccctttttttttttccccctgtttttaatttgccgaattaaaatttttgggcccccca

SEQ ID NO: 708100 - DNA, 119 bp, Homo sapiens
agatactaggcgatacccttcacaacgatgcttgcgagaaagttttggccaatgtcctcaaaaggaatggcaacaagaagcaaaaattgacaagtgggacctaattaaactaaagagct

SEQ ID NO: 708101 - DNA, 191 bp, Homo sapiens
  misc_feature (2)..(2): n is a, c, g, or t
cnactctagatgatccacttcacctagtggatcccacaccggggctgctggtggagctgcctgccagtcctgtgccgtgccctcgcattcctcatcccttgggtggcactttccatagtactacaatgtttagcgggcctacggtgttgtgagtgtaaattagtgcgatgagtagggcaagggagcctact

SEQ ID NO: 708102 - DNA, 1095 bp, Homo sapiens
tggctggcttaaggatcagtgctagcaacgggttcctccacaggaggataaagatcaccatcaactggtggtatacaagctatctgacagattatcagctgtcttgtaaaaagtttttttatcaaggggtttccaagctttccataacacagggcaggtctactaatttggaggccaagggaacacgggtccattcctggacagattccatggacgcccatcaggattgaaactcaattggtcagtctggtccttgaggttggttaggaccaaatctggtactggcccttctcacagtaaagaggcattatcctgggaggcagactgtaaaataaaactgggctctccagttccgtggaggagctatcattcttgggctttaactccatctttaatttcccttgtggattccattttctccaataaatggctgggttaccactaaaaatgttccagctactggcgaatatgtttcaaaaccaccagtttggctatgatttggaacatcttttaattacaagaagttctcgggtagatcagcagctaaagcgtctaatttggcctaagtttccaatttaagctccagagtcttttctctaaatattgcggtgaccgaaataccagtcgttaacacaacgggctgattcacagaccttagttccttaatcgatgcaatgccaagtcccaacctttaggtgccgttgctggacaaagcgaaaagagctagctagctagttaggacacaggagagcaattggggcgttcccggaacggtttctcggacaaaaagccgaagagatcttcacgtcaaaatttcccggaaaagaggtcaaaatcggggtcagaagctctggactaaaatcggaaagagggcagtaaaaaaacccccggggcccaatatcgtcccccctttataaaggggcccaatggaggataaaataagacggcacggtaaacacgttgggcaagcatcgggcttataggagcgtggggtgatggaacccacaagcagaaaacaatggagatcgtggagagtacaacgcagtcgacaccgactatccacacggtatgaaccagtagagggggggggtgtag

SEQ ID NO: 708103 - DNA, 597 bp, Homo sapiens
tgactctagaggacccctcttcacccctgacatggtttactatacgaagggtaagggctgccactcacattcagcagatggcccgtcagagtatggtggaggagacaggataactcacagggcctgttctctatgacctgacgccgtggcctggatacaactgaagaagaacatggcccagtgctgtcttcagaatctccacaagcaccagcttgtgtacgatggaagcgatgagaacagaacggcttggaggacaaataaatttaggattactacattaaacaaaacctaacagtaacccttaatgtaggacttctcaaagcctttaacacactaagagggggatccaggaggtagtgcttataagttcactacagagcactggcaggactatagtgttctttgaagcaggaatttaaaccactattagaacttaattacacatggacgagtatgtcttcaaacaaactgacagcatcagaaatgatgtatcagaaatgtattcgaactgatggatggatctagaagaaggggagtccatgcaagataatcagtgcagattccttactcttccaaaagtgtcaggggagaagaggg

SEQ ID NO: 708104 - DNA, 175 bp, Homo sapiens
agttaatgggtgttgactgtagtataagtccagctttctgtagcctaagatttgattatcccatacttacttcacttgtgatacatcactgattatttgggttacactggactcatttcaagcagttagctaacgttcacatcgtgatgagacaactaatactgtaaattgattt

SEQ ID NO: 708105 - DNA, 135 bp, Homo sapiens
gggacaatgtgaacatggactcgaagacatggccctttctctggagttgattttttaaatgggccattattgtttttaaaaaaaaggaaaaaagaaaagcaaacaaataaaacccctttaagaggcagaaagaga

SEQ ID NO: 708106 - DNA, 118 bp, Homo sapiens
tctacagatcccccgcagctccatagaattgaaaattatcttctgcatctaactcatatgaatattcttctgcatcttctcatataatatgaaagcggccttgactactctattaggc

SEQ ID NO: 708107 - DNA, 507 bp, Homo sapiens
  misc_feature (323)..(323): n is a, c, g, or t
aaggatccccatatgtggatggggaattcctggttacatttctttacactcaaatggacccgggacaacagtagtctagtctccgggaagacagggtggcaaacagaatggcatggtgggtgggtatactcatagtcaaggggggtgcacaagtgagggtccaacttggtggaagggtaaggatttaagggtggttgggccagaacaagagaaatacctggcagaaaacacttatggtgggaaaccatgcgctggtgacttttcctggtagcctatgggagtggacagagggggtaacccaagatgtttttaagacggacggnactaagaatgacgtacttatagccaattactttccccctaatgtgactgaggggattcataatggtcacaattagcattagggttaagtatttaagggtggaggtctaagctcacacttgaaaggtattatctaatgggcacggggtcaccaggttcccaccctagcattcattgctaggttac

SEQ ID NO: 708108 - DNA, 373 bp, Homo sapiens
accttctaccccacggaagaaaatgagaaatttgctttttttcatatcgaaggcttaaggatgcatcatggctgggatacatatggccattatacctttcctcaaaaaaatacgtattaccaaattaatgtataatagtcttctgaatatagacataaacgccattattttacatgattgttgatagacctcttttcatcaaccaaatctaatgaacaatttgactctgtttacactaaaaaagctagtgcttatgcccaggagatagtcaaagagcctagattattatcttgatcccttattagctgattgacattaagatacttaaactttccattctgcagtttgcagctgtaacattaaaattatctat

SEQ ID NO: 708109 - DNA, 107 bp, Homo sapiens
tacgaactcgagctggtaccgatctcatttctgcatccctttggaaatggatctctttgaatacggttgctcttgttacggataatgcagtttatcactggagatat

SEQ ID NO: 708110 - DNA, 753 bp, Homo sapiens
cgcaactggctgatcttggcaagtccgagctgggtggactgaggggggcttggctgagtggactagactgagacgggcctaacagactgagctgaggcgagctgggtgggctgagagggctaccctgtcccttagaggacaggtggccaagctgggctgtcctgagccaggcgatcggggctggcccgggccaggcgggtttagctgagttgagtgagtggactgggtagagggaaatgagctaggctcagctgagctaggcttgagctgggttatcctaagccctaaggtggactgagctgggctgagctggacttatctggggagcagggcaaagtcaggctgagctgaggtggcctgccctgggtggtccaggattgagttaagctgaattaggctgacctggacttgactggacttggttgaaataagctgggccgacacaggtagggacaagctacagttctctacttaggataaaatgggtgctcgtggactatccgggctgaaggagaccaagctggggtattacatgctgagcttacctgacctggcctgagttcagcagggctgcgctgagctggacagacctgagccaagcttagctggttgggctgagtaagctgggctgagctaaatgggattgagctgaggagggctaggctggggagagacctgacgacggacagggttaaaagctggagtgagcaggccttaaattattgaactaaattgggctggggtgatctgaaa

SEQ ID NO: 708111 - DNA, 87 bp, Homo sapiens
tgctgcttcgagtgcacacggtgcctctggatgcccaggatggcaatgaggtggagcctgatgatgaccacttctccattggtgtgg

SEQ ID NO: 708112 - DNA, 138 bp, Homo sapiens
actgtgctgcggtagctcatcacgactccccggggacgggcgctgtcctcgtcgtcccgtgggcagcgagcggtggcggcgctggcccttcttctccttctccttcctctttttctcctttggctgggcacttctcct

SEQ ID NO: 708113 - DNA, 122 bp, Homo sapiens
  misc_feature (43)..(43): n is a, c, g, or t
  misc_feature (46)..(46): n is a, c, g, or t
  misc_feature (84)..(84): n is a, c, g, or t
  misc_feature (90)..(90): n is a, c, g, or t
  misc_feature (112)..(112): n is a, c, g, or t
  misc_feature (119)..(119): n is a, c, g, or t
ttctgaggataaaggcatggtcaccaaaaatcacagtacctgntgntggtaaagttcatgccaattcactgccttagatcaggngaaaangaaaagggctgtggccaaagtnttaaggncaa

SEQ ID NO: 708114 - DNA, 228 bp, Homo sapiens
tctgatcgctgggacgctggttctagaggcagctgtcacgggagttcctgttaaaggtcaagacactgtccaaggccgtgttccattcaatggacaagatcccgtttaaggaccagtttccgttaaaggtccagataaagtccaagcccaagagccagtcaaaggtccagtctccagtgagcctgggtcctgccccattatcttgatccggtgcgccatgttgaatcc

SEQ ID NO: 708115 - DNA, 1231 bp, Homo sapiens
atacgcctcacacatcattactcaaaccccctgacaaaacacatagcctacccacatatccttgtactatccctatgaggcataagttataacaacgactccactctgaaaacaaccaccaacagcacacacaacaaacacccgcaagacaagaaaaaaaaaaagaccaaacacacaaagcaccagaggtgcgggcgggcgagcgagacagcgcacacagaaaagcaaacaaacagcaccccaacatcagagaggcgaggcgcgcgaggaagaccaagtcaaggacacacaacaccagaacacgagcagacacaggacaagacagaggaaccaagaacaaataacccacgcaccgtcaccgaaccaaaaacaatacaagacaccacgacacacccacccccacaccccaaaacacaaaagaaacgtgacgcagagcaacaaccggacatgcaccaacgcaacacagaggcgcacacacaccgaccaaaaaaccaacacaacaagggacaaaacacacagaacacagaaaaaaaaagggaaccgaaacacagaccagaaaacaacacacacaccaaaacacagaacacccccagccgagaccagccacccagcgacgcgacacacacccagacagaaacaaccgccaccacacccaaaaaccagacagcgaggaacgaccccccgcaacacactaaacacaagcagacgcaaaaaaacacaagacgccacacgccgcgcacagcaccgcagaagcacgcaaacagcaagaagaccaaaagaccacccacaacaacacaaccaaccaaagagaccgacggaagcaccccagacgacgacaaaccaaccgcgccaaccacagggggaaaacaaagggaacacaacaagaccgcaaagaacagcggcagccagacacagaaacaagcaaaccaacacagcaccaaggagaagaccgaacgaacaacgacaagaaagcacaaaaaagcacagaagccaaacaccaagacgaaaacacagcaagcggtgtccagagacaaaggcaagaagagacaggagaaacccgcgaatcgacaacgcagaaacccgcaaaccgcgagcggaaacacgcacacactgaagaacggacaagaaggaagcaagacacacgaccaccaccgggccgcgaagaagacaccaaaccagggacacagacagaaggaagggcagacaagagaccacaccacagagtcaccat

SEQ ID NO: 708116 - DNA, 106 bp, Homo sapiens
taatgagctggtccatctacagcatactgatcctacttcgcactagttcggtactatgcctattgttcaatatcaagggaatgatagcattgaaggactcggggat

SEQ ID NO: 708117 - DNA, 278 bp, Homo sapiens
tcagggtgggggccctgcccctcccccgaccatgttttttcccctcaaccggaattcagggggcaattcccactacccggtgttcgccaaccttgaacttaaacggcaggtgcaaaaaaacaaaaccaggtcccgcttcctgcccccgggtttcccctccccctttaggcccctttttcccaggagcccgacccagaaactccacttacccccaggcggatttggggtgttgggcagggcatggagggaaaggaataaaaaaaaacaaagtcccggga

SEQ ID NO: 708118 - DNA, 129 bp, Homo sapiens
tgtctagaggatccagcgtgatatactaaaatgcgttaaatatgtaaccacatacattatgtgctgtgatttaaaatctacttaattttcatgatattaagatgtgttagtattttttttttactttgt

SEQ ID NO: 708119 - DNA, 180 bp, Homo sapiens
gtgggaattaaattcaagctacaatctcaagctcctctgaagaagtccctgtaagagttcagcccctgtgttataatccatgtgtgaattttcaggcctcgaccgtaggctattaccatggctttacctggcaggcctcgtggggaaatctgcctttccctcaccagactttattgccca

SEQ ID NO: 708120 - DNA, 169 bp, Homo sapiens
cggagattccttgccttttaaactcgtggtttttctctcattttcttccctctctccctccatctctgaccaccgcaggtaatacacgaagaaacaactatgaaatagtgtgtgtcgtcgtgtgtgtggcgggtgctgcggttcggtttgggtggtgggtgtgtttgtg

SEQ ID NO: 708121 - DNA, 255 bp, Homo sapiens
ctgcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaaaa

SEQ ID NO: 708122 - DNA, 215 bp, Homo sapiens
ctggctacttttttatattttcggttgagatggggtttcaccgcgtggccaggctggtctcaaactcctgacctcaagtgatccgcctgcctcggcctcccaaagtgctgggattacaggcgtgagccgccactcccagcttgttcatccagtttttattgagcatctattatgtgccgatattgaggtagactctgggagtcacagcagtgaat

SEQ ID NO: 708123 - DNA, 468 bp, Homo sapiens
  misc_feature (7)..(7): n is a, c, g, or t
  misc_feature (80)..(80): n is a, c, g, or t
  misc_feature (122)..(122): n is a, c, g, or t
  misc_feature (161)..(161): n is a, c, g, or t
  misc_feature (226)..(226): n is a, c, g, or t
  misc_feature (267)..(267): n is a, c, g, or t
  misc_feature (309)..(309): n is a, c, g, or t
  misc_feature (385)..(385): n is a, c, g, or t
  misc_feature (413)..(413): n is a, c, g, or t
gaacttnaatgtagacgcacaaaaagctcacattgtaaacaggattaagctgctcttgatttagcccgtaacatcaaggnttcattttgctcagcctgagatctcgctcaatttcaaactgnctgtgatccatcggtcgaggaaggctttccggtcaatgnacccctctttccctcgattatggatggccagttctttaccaatcccctctttcttcttgaagctnttccagccaggttggacttcttaagggtgcttaatttctgnttcttggcaccaaatttcccaaggctgctcatgcacttggantttttaaccctgcccggcaaggagtgatggcagacttgaaggaccattaaccctgggggttttctttctcatctgntttgaataaggatttggctctttagaangagcatccctttcttaggtacccttacttttttaccagctccccccttggggttt

SEQ ID NO: 708124 - DNA, 172 bp, Homo sapiens
gttttctactcttttcaagattcttctagcggttcctgcttgcctacttctgatagtgatattagaaagtaagagtttttttagctctgcctccagattgctacagtagtgagattgttcctagatcctctcagcacatagagtatacatgtatagtaactttggtcgacgc

SEQ ID NO: 708125 - DNA, 450 bp, Homo sapiens
  misc_feature (77)..(77): n is a, c, g, or t
  misc_feature (81)..(81): n is a, c, g, or t
  misc_feature (85)..(85): n is a, c, g, or t
  misc_feature (87)..(87): n is a, c, g, or t
  misc_feature (108)..(108): n is a, c, g, or t
  misc_feature (148)..(148): n is a, c, g, or t
  misc_feature (158)..(158): n is a, c, g, or t
  misc_feature (161)..(161): n is a, c, g, or t
  misc_feature (164)..(164): n is a, c, g, or t
  misc_feature (184)..(184): n is a, c, g, or t
  misc_feature (195)..(195): n is a, c, g, or t
  misc_feature (240)..(240): n is a, c, g, or t
  misc_feature (280)..(280): n is a, c, g, or t
  misc_feature (358)..(358): n is a, c, g, or t
  misc_feature (360)..(360): n is a, c, g, or t
  misc_feature (369)..(369): n is a, c, g, or t
  misc_feature (385)..(385): n is a, c, g, or t
  misc_feature (393)..(393): n is a, c, g, or t
  misc_feature (395)..(395): n is a, c, g, or t
  misc_feature (442)..(442): n is a, c, g, or t
cctctccgtctcctgcgggcgcaatggaggaggaggatgaggaagcgcgggcgctcctggcaggcggccctagaagnggcngacngnggtgccccggccgcccctggngccctgccggacctctgcgaccccagtcgcctggcgcacnggcttttggngcngtnactgatgtgcttccttggcntatggcagctnttattgatcaagcatcctcactgactgcacttacgaactccacgnatcccacgcaactcatgacacacgtgccatacacacccancccatatcctgctgaatagttacatgcctggtctacttggacacaccctgatcgttttgtgtttcataggtggctttntnctagaccgnatcttaggcaatcaancaaggggncncctccattatttcgatgattagtttgccttggcccagttgttattgncctgaggt

SEQ ID NO: 708126 - DNA, 146 bp, Homo sapiens
tccacagggcaggcatatgtatgcatttagttcacactgtatcctgtgcctcgaagagtacttagtacatagcaggacacattctggttgactaaaattatcgggaaatattcattgcctccactacaatcaagaaggagaattag

SEQ ID NO: 708127 - DNA, 1440 bp, Homo sapiens
ggcccgacggagcctgtacgcgtcgactgcccagagttccgctggaatccatctgtcatccggaggcccgatgccggactcctccgcgatctccagctttgctcttgcccttgtgaaatacatcgtaacgaataactgtacaacgtgcaaattcagtttgtgtactaggagtccatagtcagctcgtgtcgaatgcttggaagacagggaattcgtagctcatgattgcacctcaggtccctacaatatattcacgtaacgtgtcaacactctatgacagagagaaacgggagtcgcaatgctgggatgtaaaggctgcgatgaagacgtcgacaggtacgcacaaggggagcacatcagcaggtgattgactaggggctcccaaagagcgaccgtcatatgtctcgttgtggaggcaggaaccgcaaagtgccctcatggtactgcgaggtcagacacagatggagtggtaacggacatgccaaacgcctgtggtagaatcctctgacggagagtataatcttctgacagcaagcatacactattccgatgaagagtggcgtcaccacaccattagaagaacaccacaaagcttttggcttgatgcgggaacaagatgggaggtctaacgggaacatacgaatcttccttgggtttagggttaaaacgtctatgggcatgtggcttggaatagaaatggcaacggggattgtgggattgaaaggcttgagagcagacagatttcaatagaaaaagcctggaattgccagggtttccgaggattaagttcagctatcaagatatttggtggagttaggagttatttgcacaaaataataaaaccgtttagtgggggctatggggggtcacacgacaagggggaactttccatttggtgggaaacccttcttacggaacactgtgggcgagggaaagcgtgggtcttgtgccggtaggacgcttaaccaaatgctcaacaacaggacacgtgtggacacttggaataccacacgggtccgacgcccaacgagccagcggggccaccctgggtgtggccactcgggacacgagaattgggcgcgtaatgagggagaggccaagcgacttaggaacctggtcgaccgaaacgatcccagcggcggggggcgaaagtctgcggcacaaccgcgcggcgagggcacaaggggagccccccaagccgccggggtgtaaaacagggcgtacatctcctgggccaaagctctgggggaaaagacccgagaccctgggcactctgggggcgttcaacgacacaacatagaagaatagacccacccggagcgactcggaggctggggtgaaatcggcgtatcacaaaaacaagaggtcgagcaccagcggtcaccgaagacatccctgacgagaacaggcagcgggttcacctgggccgacggccacaag

SEQ ID NO: 708128 - DNA, 945 bp, Homo sapiens
atggtgaaaccccgtctctaccaaaaataaaaataaaaattatccaggcgtggtggcatgtgcctatagccccagctactcaggaagctaaagcacgagaattatgtgcatcctggaggtgaaggttgcagtgagccaagatcacaccactccactccagtctggacaacagagtgagaccctgtgtcaaaaaaaaaaaaaagaaagaaagaaagaaaaattggctttatgggcccagtgcaggggttcacacctataatcctagcacttggggaggctaaggcaggaggattggcttgaggccaagagttcaaaacaagcttggggcaacattggaagaccccaattctacaaaaaacgaaaaattagccggggagcggtgatgtgtgccttgtagtcccagtactcaggagactggagggggggagaatcattggagcctggggaggttgaggctggcagttgagctggtgtttataccatttgactcccagcccggggggtaacagagcaagaatccatctcaaaaagaaaagaaaaatgttttgtacataatgaggcaggaaaaaaaaaaaggtcctgtgggaattctttgacaatttggcaaggtgtatggctttgtaccagtgtaatgggtctacgtggatttttaagagatttaggaccggttttattgtgggaccatcgaaactctggaagtggagggtcccttaacacgattatcatatgccgcgggtattggatgatggcccggaatgtaccccaggtggtctggttgtcaaaaaaagtataagcgggggtgtttaaaaaaaagggggggttaagtccggggcaggtggacacgttggaggccaaagtgtaaaagggcggtaacggggaacgagttgaagacttggatagacagaacgaaaatatgacctggatagaagtaacgcacgtgtgaag

SEQ ID NO: 708129 - DNA, 232 bp, Homo sapiens
cacgaggataatcagaccaacggtcatttctgcttgacctcctaagtgcatcaggcattgattcactgaccttaatgtttgtgcgacattaaaaagggtgcaaattctctggaggatttcttataccatgaaggatacacatgtatcagcatccatggagatcgttctcagagggatagagaacaggcccttcaccactttcgctcaggtattagcccaattttaacggcta

SEQ ID NO: 708130 - DNA, 100 bp, Homo sapiens
attaccaggcccggcttcatagctgtaatccccagcaaactcccgacagctgaggcaggagaatccctatggtctcttgagtccacggagttttgagacc

SEQ ID NO: 708131 - DNA, 1411 bp, Homo sapiens
ctgctttacggctgtggcgggttggtcagtacgggagaggcatctgggttcggactggggccgggcactggcgtgcacaagtgaactgttgtgcacaaggtttgacagtatgagcacttgtaggccggagatgaccttgtacagcgggtctatgcatgcagcgcgcttgacacactgggccatggaagaaccgatgcaaatctgttccctggcagtttgatctgcgttcatatcacgaccaagacctctagacacgattggctcgcgcctagtagactgagagacgctctgtgtataggaacggacattgttagggtcgtagagagccaatgacaaagcatacgactcaggcatgtgagcgccagcagtttaccaacaacttggtccgagggtccgtatcagtggtttgaccgaataatgctcgggagtatgcactgtacctcatacccatgtctgccaagagaccaactctctcctatctcagtggtcacatggtagctcttgagctcttgctttggggacacacctgggaactcggggctggttcggtgaatacatgatagttcgaggaactatattgtgatcgattttcgatgtggggcaaacgagtgggactctggacaggggaactagaaccaagaggttttttggggaattttacaatacggcgtttacaaccacgcaacgttgaggggaaagggaaaggcgtccggtatatgccgaaagagttttcgagagcaaacaaacaagaagcacgaatgtccacttcgagttaaccaccctagtaatggggtcacccaggagtgggtaggttgcttgttgaggctctttacattgttttaattactgccggttcgttccttcctttggcgccagtggggaaagcgggagcattttgggccttaataattggaaagcgggccaatttggttccttagaacggaagggggacaaaattttcccccacggtttgcgccaaacatggccaaagcgtggacgtgacccgagtcggtgcaaatggccatgctggtggtgcactgggacaacctgcattacaaacttggggtctattccaaccttaatggttccaagaataacagctcgaagggttcgaaaagaatcccgtgggaattcacggtgtactgtgattggaaaggttaatgggggaagacctcaaagtgggttcaacacaacgtctgggcaccatttcgatgggagcctggcctttccacggggaggaactttctgaattcggaaattattcacatccctccattgatgctgcattttcaacgtgttaccacatcatcacgccatgaaccgggatttttcccacagaatgggtcttcaccagataatctgttaccaagtggtgaatggatatcattatacaccgatgtctgagggcata

SEQ ID NO: 708132 - DNA, 1230 bp, Homo sapiens
gcctcttttccttgcctaaggcagccatggctcgtggtcccacagaagcatctgaagcgggtggcggcgtccaagagctatcggagtgctgggattaagacttgagcgcggtgtgttgtgctccgtcgtcctagtcctatccggtcctcgccacaaaggttgagacgaagtgtcgtcacgcgccgtcatccagtttgtcccatgaggaatcagagcgttaagtactgcccagactagggacgatgacaagtagaagacatgattgcgcatggcagcaggtgtcgagttgaaagatcggatcggccaaggtaccgaggctggcatagtacacctaccactgcatggacttcatcgcgaggtcagtcagcattagacatagaccggcgcatgacgaactcttacggcgtcgtgatctgatcgcacaaccaaaggagtgcgctgtagactgtagcagtcggatacttagcagccgtgacgggaggtccaagatacaagagtcgatgcgaaacagtgaggacaagactcgtcggtgtgcggccacaaacaggcaagtgccttacatcgtgggtgaacgtcactgatgactccgacgatccatgccgggtacgcacgagtccccctcgagtgcaaagggtgaacaatggataaccgagttgcacgacatggagttacaggaaggagcttgggcacatagatgtaactggagtttgcatcacagcatacggacaagcttggttaacccatgatgataatggatggacttgtgaagtgttgctgaaacacctaagggaaacggacaatcgggcacggagacacaagcccaagaccacgaggacggcggggcaacacatagcgaagtcctctcgacggaccgacacggtgtccacggttggagacagaattggccacaaatcaggggggagaacacagccttaaaggccgagacaccgtaacattattcacgaaaccaatgacgacggggtcaaacggggccacatcggggcaagagaaacagccaaatggacattgtacagtcctgtccaccaccggagaggaaaaccgagaacaatcacggaccatcacaacccaaagtgggccacgaaagctacgcaaggcagaacacaagtagaaaagaagagacggagcacaacaccaagagacggcggaggggagacgacaaaacttgacgctacccacgggtgtaggaaccaagtggtcgagagagacacg

SEQ ID NO: 708133 - DNA, 630 bp, Homo sapiens
gcagttcatgctgcaggtgacctataggatcccctgtacctgacgctgggatattttgtgtgtgtgtgtgtgtatgttttgtagtgtgtagataaacacgtcgtctccaggccaggaagggccccttggaattaggcccacctgtctagatcctctcctcagtggtgggtcctgggctgaaaccagcttccacatcatacccccaaaggaagaatgggggtctttctggaatggaagacgctgacttcaagcattcttcaaattactctcgttccccagctgagctttgttgctgagggggttggggacaagccacaggggcacttgcatagcaggagagtagaatggggataaggcatatggtgaggacaggggagaaggggaagggcatcatagctgcaggtgaagggggcctccaaaaggcagctcctctaccccctcatcccctcaaattgctgctgggttgaggagtcagactgaggcagtataataccctcccccatccttaactctagaaccccggtttggtggggaggaggtgggaagctgtggagctatggaaaggcctcagttagtgagtcaagctgtgatgtgtgtgtctgaacacaagtggctcccttggtataccgg

SEQ ID NO: 708134 - DNA, 1372 bp, Homo sapiens
gactctgtaggagtcggtgaatatatcaagcactgcagagctaccttcacaattcgtggaccactacatatatctgtagatcgcttctatcttatagtctttccgacatcatgttggaagagtgttaaatggaggcgacatgaagtacaattcgaatgtgcatatcagtgccctacctggcagctctacatagtagtaataaaatcttgttcatcatgtctcatcatctattagtgctgtgagttcgcagtgtccatgagtttttgaactgggaagtgccattctacttcttcaacgtccaacacatacccatgggatgttcaataccgagtaattgtagtactccgttcacctaggtcttgtggacacaagactattaacggtacactacgactatggccagtaatgtgaaccttcttgtcctcttcctggccgatcgaaagtgtcctaaattgttattacactttctggcaggggccgtcctgctagttaccctgatcacatgcctattcgtcatgcccctctacttgcctatttaatgttgggagctaaggaacgcaagaatcttgctaatgcctgagtcatgaagtgcgagtgacaatacctttcccgttatgaactagtaacctcttatgctctgctatcaccaacatttggctttggtcacgaccttttttcaacctggtcgagttctgggtcgcagtcaaattttcagtgccatgggggcttaaacaaggcttcgttaaccaaggcattatttatatactttaggcgtagcatgggtgcggagaaactaattgaatttggcactggataacgtgtaacttggactttgttaagtaaacggaaatggcaaggtacacttgtggttcagcttttgtggatttcttgtttgaatccagataatggggggcacttccgcgtaagattatcgttacttccttgttcgaagttactttcttggggctttatatccttgaacatttcttggcaatacttactgctcagaccgcggaaaaacttgcctttaggggggttgagttcgctaagcaaaaagggggatgggaaatagccgggttcagtataccaccagcggcgctccctatttccaaacaagtgcaacatttctgggccgccatttcaaattagggccccggaaaggatggaggtatattttttccataactgttcggtagatcacgggacaatattttcagtgctggaaaggcggggtaagcacacagttaccagcagtggtaaggggaagaggagtaatactgtgtttggccgtatcgcgtaggcgaagtcgggttgctgcccaattacccagtggaaagaaaggtacgctcattgcggctgatctccatgctac

SEQ ID NO: 708135 - DNA, 471 bp, Homo sapiens
gagtcactgcgccctgatcatgctagacagccggctcacactgcgagggtcataaagacgcaggctgtgatgtcccaacaacgatatgaaagagcttgtaggatgaagtctacttcagaaagaaggcatttctgtgttgaaatctcatagagtcaatgagctctcaaatggaaaaaattaatcccagaggcttctataagtactagtagaagtctgcctgtcagagctctcgcatgttctgaagtatgcggaagttgacatggattcattagccaaggctgtaccagagcccttgaagaagtatactaaatgtagagagctggctgaaagactgaaaatagaagatcggggctgctagtcgcatacccggagtaacacctgccgccatcatcaatctgctgagatttgtgaagaccactcaacgacgacagtcggctatgaatgaatcatccaggcatgatcaatactcat

SEQ ID NO: 708136 - DNA, 175 bp, Homo sapiens
  misc_feature (136)..(136): n is a, c, g, or t
ttgaggtcaggagtcgagacatctggccacaggtgaaacctcgttctactaaaaatacaaaaaaattagccgagcatgcggcacatgcctgcattccagccactgtggagctgaggcagcaaatcacctgaactgngaagggggaggttacagtaagccgagattgcggtgtttg

SEQ ID NO: 708137 - DNA, 901 bp, Homo sapiens
  misc_feature (839)..(839): n is a, c, g, or t
aatcgctcacagctgctggattcgcttttaccgcgtgttgcggccgttcgagggcacatttggagcattttgggggtatccagtgcgtcacacaataggtgtaatacgtgttggcgggggtcacctaatgtctgcagtgcgtctgcgagcgttaacaaccattgggcacatttgggaattataacaaagtcaaaacacaacatggagacgaggtgacaacccagctttaccgcgtgtgcacgttgggttaccggcaacgtgcttggccgcccttgtccttagcgcacctttcgcggccccccattggacaaagccgtgcaggggagattgcgcgaacgtggggcaacacgctagtgaatggcaaagaggttctccaagagggtgcagggagagacgacggtgaacccacgtctgggcagcctgctttttggaggccactcttccataggttatgcctcccaagcattaggcccaacatattgggctcactcaattgccgccgtgtgcctataattcgggggcagacccacatgggtggtgctcccagatactcacctctcgcagaggagcccctactcgagagggagtcttccagtcctcgtgcccgcacatcattgctaacgtatgtttcgcaaatgattctgatgacagtcattcatggcctacgtcttaacacggcgaacatatggtactccgacacaattccttaggcccaacccttaggcgtaccggtccagcactagggccgccaaagcgagctaatactttagttgagcacataattgagaaagattggcaacacagagtttgttatttgaactgcaacaaggcgttacaanagaagtcaggtacgttcagactggcggtatcccctctagcggccactcttttgcgaacatca

SEQ ID NO: 708138 - DNA, 382 bp, Homo sapiens
catgcgggggggggtgtttaagggggtggctagggaataattgtctgggtttcctaggaggactggtgagaataggggggggtcattaaggagagaaggaagagaagtaagccgagggcgtctttgattgtgtagtaagggtggaaggtgattttatcggaatgggaggtgattcctagggggttgtttgatcccgtttcgtgcaagaataggaggtggagtgctgctagggctgcaataatgaagggcaagatgaagtgaaaggtaaagaatcgtgtgagggtgggactgtctactgagtagcctcctcagattcattgaactaggtctgttccaatgtatgggatggcggatagtaagcttgtaattactgtggcccccc

SEQ ID NO: 708139 - DNA, 206 bp, Homo sapiens
taatagacctatctgaagcctgttgattctttcttctgacttctccagtctgctgctgaatacctctagtgaattttcagttttagttataatacttttcaactccagaatttctatttggttcttttctacaatttcaatctctttattgatattctgtattggatgagacattgctttcctaatttttttgttctctgtccatg

SEQ ID NO: 708140 - DNA, 243 bp, Homo sapiens
ataaccgatacccgcgcaacaactgcttagaataaggggttggcgtaatcaacgcatccgccttttgatatagcgacaccaaatactgcttaaataacggtgcaatcagatttgaaccggtaaatgaatttctaaagtcttcataagtggagtggccatgatagacaacctttttgcccattttatgagccgcattcaccatgtggtggctcttcacgccgtagtatttgatgtgtaagacat

SEQ ID NO: 708141 - DNA, 128 bp, Homo sapiens
tcaggttacgaccacatctacaatcgttatcgtcacagcccaatgcatttgtactaatcttctacatagtaatacccatcataatcggaggctttggcaacatgactagttcccctaataatcggggc

SEQ ID NO: 708142 - DNA, 141 bp, Homo sapiens
agcatggagaggtgctgtttagtatatatacatctcaagacggtgtaatatattcaggccaaggatcaactcagctcgacctccatctccagatccttcttgttcttcttttgcctccttcctgttgcacattcttccaag

SEQ ID NO: 708143 - DNA, 517 bp, Homo sapiens
  misc_feature (116)..(116): n is a, c, g, or t
  misc_feature (435)..(435): n is a, c, g, or t
  misc_feature (460)..(461): n is a, c, g, or t
  misc_feature (471)..(471): n is a, c, g, or t
  misc_feature (500)..(500): n is a, c, g, or t
  misc_feature (516)..(516): n is a, c, g, or t
tgctgctggggaatttggagcctgaggaggccaaactgatccgtgtccctcttcaacgaatccaccttggacacagaatcttaaacccactgaatggatgggaacagctggcagantttctaggacctccacctctggtgcaaacccctcctttgtgcctctctccaagttcatgaacacccagtattttggaactattggtttgggaacgcctcctcagaatttcaccgttgtctttgacacgggttcttccaacttgtgggttccgtccacgagatgtcatttcttcagtttggcatgctggtttcaccatcgctttaatcccaaggcctccagctccttcaggcccaatgggaccaagtttgccattcagtatgggaccgggcggctgagcggaaatcctgagccaggacaatctgactaatcggggggatncacgatgcttttgtgacatttggannaggctctgtnggaagccagcctgaatctttgctttaagncactttgaatggatcng

SEQ ID NO: 708144 - DNA, 533 bp, Homo sapiens
  misc_feature (249)..(249): n is a, c, g, or t
aactggtcgagtctgtgggcatctctgagatgtctgtagagatctctggagcctctctgagactggtggtgctatgatctttggaggcatctgactccccacaatctattagcagcacagatcagctttttgaagggcagggtcaacagacactgcgtttcttgtcatggctgtctgaccattgctgaagcagctgtcttcttttttggaaggaggggtcttccaagtgccatcgaccgtaggagtttnccctttctttgaaggttccgagtgcaacttaggcgccttgctaagggggctggttctttttactcagaaagcctctccgttctaagagcctccgcttcttgacaaaatttcggtgcttggcatttccttctaatgcctttttgggaggaggttccccaaaatccagattgagcagtaaagtagacatagggacaatggaaggcggaagagtagttgggaagagtggcttatggatgaacagaggatgtgggactcattctctgctgaatcctactgtccacatg

SEQ ID NO: 708145 - DNA, 107 bp, Homo sapiens
cgaattctcctcctactgaattctcctcctcttcatcctgtgagaagcatgagttgggagcatcacagaggagtctggcactgctccccggaaagctcctctcccac

SEQ ID NO: 708146 - DNA, 1123 bp, Homo sapiens
  misc_feature (1)..(1): n is a, c, g, or t
  misc_feature (696)..(697): n is a, c, g, or t
ntcaggataagccacagttgtagctcgacagcagcaccatagctgccgtctccgtccccaggcactttttggttatggatagtaccgtaccaccgtatgagaagccacagactgtctttggctcagcatgcgagatgaagcgctgatcctgtagtcacctattttcgtactgaaacatcgcttttacccacttctcagataataatgcgggaaaacaggcaacgtgaccttgtaacctttattgcatgaaggacttctttttgtttctaactataaacttggatcacctatggtaaaaccttatttcacgctccacatcattttagaatgtattttcgaagaggaatagagccaatgttttattcactcgggctttttttcttccccctctttctttaaagaactgatcaatattcaatctgttgtgaagaacctgattagcactctgtagtgcttacagaaacaaagagactctaatattgacactcttacacttactgcatgtaaacagattacaaacacgtattgcccacacgcattcaactctgtcccattcatagacacgctaacgcagaacactggcctatgatcatgcaagactgtcagtgccaaccaagacaatactaaccgcacatcgcacagtgtattgccccgccttccacacatgcacacatgtacagccacattgcgcgattnntaatgagcgcaccacgacctccacccagcacccttcctatatgccacaaacacgctcgccgtccgctcacctccagtaccacgcgcctcgccgcgcgcatcagcgctcccctggtacctcccctccgccgataccgccgcacatacgcgccatactccccgccccgccccacgcccgttgagttgtctttgcccgcgtatggcgcccgcatgttccccacccccatctcattccccccttccgcccccttatactcccgtccgcgcctatccccgcctctcgccccctcccccattcactgttactcgccatacctcgcacaattagttctcgccccgacggcctcacggcgccaatcccatcccactgcaccccccgcgcgctgcgcttctcgccgctccctcctctcgcgcgtctccctccccc

SEQ ID NO: 708147 - DNA, 681 bp, Homo sapiens
gcaacgcggctgcggaaacagcagactcaagggcgcacgggacagcgcttcgagccacacaaaaaactcaatcacgtaggcgccgacgccggccacaacagcggcgcattgaacacctggccccagaacgcacgcaggcgaaaaccgccatcgagttgcggcaaacggtccacgcccaatttgaaacacagctggccaatcacatcgaggacgatggaaaacgccagtaacaacaccacggtcagggtcacgggaacagttcctcaaacaggtcgatcaaggcttcattggttgccgcattacgctgcaagtcttgcgggctccagcgctccggtggcggctggtcggacttggcttcccagcgcttgaacgcgttgctgaatgccggcgtagcgaactcaccgcagacgtcgatgccaatgatgcgtttacccgccgccaacgcccgcagggcctggagcacatgggtcaggcgcatgccgccctggtcccagttggtggcggcgtcttcactggcgagcacatctttgtcgatggtgatccagatcgcctcggtgggcaggctggcaatcatctggtcgaggaaggcgcccaatccaggtcgccaggttggccagtgcagtggtttcctgttgctggtggcgggccgaccccaccgacccagactggacgggatgcgca

SEQ ID NO: 708148 - DNA, 370 bp, Homo sapiens
aacgatggtcctcagctcatcaactctgcctcccgggttcaagtgattctcctgcctcagtctctcgagtagctgggattacaggcagtgtgccatcacgcgcggctaattttgtgtttttgtatttttttgaagtagaaaggggggtttcgccgtgttgggggagaccgggcttgaacttgtgagttcgggggatctgcccgtctgggtctcccaaagtacggggtattatcataatcgatttggagacaggatctcacttggtggcccaggctaaggggcgaggggcacaaacacagctcatggcagcctcgacctcccgggcgcaagggatcctccttgcgcagtcccctggagtagctgggcctac

SEQ ID NO: 708149 - DNA, 259 bp, Homo sapiens
gggggctgcatgcacaggtaattagatcagaaccaaaacaggacagggattttcacagtgcttttctatacgtaatgtctgtaatctatagataacataaccgagtaggtcagggatcgatctttaactaccaggcccagggtgtggcgcggggctgtctgcctgtggatttcatttctgccttttagattttacttcttctttctttggaggcagaaattgggcataagacaatatgaggggaggtctccctttgagc

SEQ ID NO: 708150 - DNA, 122 bp, Homo sapiens
gctgtttctgcttgctgatccggactgcagcagcagaggaactgcaccatggagtttggactgaggtggattctccttgtaggaatattaaaagggagtgcatccgccccaacccttttccc

SEQ ID NO: 708151 - DNA, 845 bp, Homo sapiens
cgactcatcttgtttaaagagcctctgtatttcagaatgatatgagtctgtttcttttctccatgtctccatgtctcttccatgattcccttctctttttttttgggttttttttttggtttctctgtgaagaacgggagttttggcctctgtgttcgcccgaggctgtggaggtgtacatgggccacgactctcggcctcacgcgaaaccttccgccttcccgaggtttcagagcaacttctccgtgcctacagcttccccagatagcggggattatagggcattattgccaccagtgccgggcatagtttggatatggttttttctaagtagaaaggggggtttctccaggtatagtcaggcgtggtctcgaactccacaacctcgagggtgatccaccgtggcctgcggcctcccaaaggtgcggggcattacgggctactgagccaccagcgcgggccaatctcccttcttagagtcacagaagggaactcaggaaagcagctctaagggaacgagaacacccataacgtaccgtgcctccgccgcgctgcggcgtcacaactccctcaacgtccttctcaaacagcaccctactctctacacccacgcggcccccacacctgaccaccttcacccctgtgacctcaccccccttccaccctgcctgaaacgctgaacacgccgtgacgacactcaacctcgaccggtccacagaccctgggagcccagacagctcaccgggataccacacaactcgtggcactctccccaatgcgagacccgccgcgcaccaccccacgacaacccccaccgcgcacaaaccccacagaccacgcacacc

SEQ ID NO: 708152 - DNA, 1029 bp, Homo sapiens
  misc_feature (396)..(396): n is a, c, g, or t
  misc_feature (419)..(420): n is a, c, g, or t
  misc_feature (423)..(423): n is a, c, g, or t
  misc_feature (452)..(452): n is a, c, g, or t
  misc_feature (457)..(458): n is a, c, g, or t
  misc_feature (488)..(488): n is a, c, g, or t
  misc_feature (501)..(501): n is a, c, g, or t
  misc_feature (507)..(507): n is a, c, g, or t
  misc_feature (539)..(540): n is a, c, g, or t
  misc_feature (622)..(622): n is a, c, g, or t
  misc_feature (624)..(624): n is a, c, g, or t
  misc_feature (686)..(687): n is a, c, g, or t
  misc_feature (800)..(800): n is a, c, g, or t
  misc_feature (813)..(813): n is a, c, g, or t
  misc_feature (832)..(832): n is a, c, g, or t
  misc_feature (844)..(844): n is a, c, g, or t
  misc_feature (906)..(907): n is a, c, g, or t
  misc_feature (909)..(909): n is a, c, g, or t
tttgtgatgtgggttgggtgaggtggtgaaatggtattgtgagtgggggtctcaggggtgttatgttgtgttgagagggttgtggtgtgaagtgtggttagtagtggtgagtgttttgggatttgtgagatgttagttgaagctgttcggtacaaggttggagtggaagtcgtgtggatgatgtgggtgggttttgtgttggtgagtaggtgtagatagtagactcgtgtcgggtgtataggtcgcgtgttattgtgaagggcttgtaggaggttttttggctcatgaatctagcatatgatttgtgggaagcggggtgatcctgcaatggttttgatctcttgggcaacatcttttggcccaagtttgggcaacattggcccaagtttgggcatntttggcagtagctgtatgggagnnaanagagtaagaggaaatattcccacagccangaagnntgaaagggcaccttggcctagactagggcngcctggtcagtcncaggangaggccaagggctttctggccatctcaggganngggccaccaggttcctcccctcaccccatattccatcaccttcctcctctgctctgggtggtaagggaagccctcctggttncncacaggactatgatgctgcatggcagaggcaggtataacacagcactacatattggaaattnntatatttttctaaataccaatgcagttttgctacggttacaattttgaaatattaactgagcctcaaaatcaccctttctgtcaagcatatcttggcctctcccatgtctcantgttgcctgcatntctcccaggacttgggggnggggtgaaaagngtacagagaagatactgaaaagggctcctggggtacacaagcccagcaggtcctgagtgaanncngtgggccctccaaatgctcgttttatagcaacctctctctaccctagttctccaaattcacattctgccttcctcaggtttgatatctggcaggttaatcatccagaggaaattaaatat

SEQ ID NO: 708153 - DNA, 103 bp, Homo sapiens
agcacccaagattcagcgtcttgttactacacgtgtcctgtcagcacaaacggcggcgtattgctctcacggaggagcctacccaggagactaaacgaccgcg

SEQ ID NO: 708154 - DNA, 551 bp, Homo sapiens
cactacatctctaaatgtggttcactgcagtggtcacagatggctggcactgctttttccttgagagatgctgtctatgtcccctgcccttgagctcggccggctcctgcgaaattgtcactgctgagtattggggttattgactgaaggacatgccgggcttgagtttgcaggctcagctcctaagagatcatagcttcctctcccacctcttggaacacttgcttttggaagccacaaggagacccatggaaaagactgggcccttcaagctaaactgagctctcaggacagcagccggacctgcatctcctgagggcctccatcctggccctgcaccctccagctccagtgaccaggcctggcttgcgatgagccaccccggacagaagctctctgggtttcagatctgcagacaaaataaatgattggacttttgtgaagccactaagttttggctaagatttgtgatacagcagtacatagttggaacattaagtgttggatgtttttctaacaaaggaatcgtatacaccaatattttattttac

SEQ ID NO: 708155 - DNA, 1068 bp, Homo sapiens
  misc_feature (788)..(788): n is a, c, g, or t
  misc_feature (1005)..(1005): n is a, c, g, or t
gcgagcgcggacagcacgccatgtaaggactcgggacaagttacgagagtacaaggtagtgggtcgtagcctgactacccgcaaatgccacaagccgaaccctcgtatcgcatgcgaatctatgcagccctgacatcatggtacgatcagcggcatagtcccagttgcctgggtaactgtggtgatctccagttagacgaaagatgcaaggacatgtcttccaggggcagagtagtaccggtactagtgtggcagcgtagtgacgtacgaagactcgtcactgaatggtcgagaaacattatcggagaatcctggaatgctgcatcattgaatcccacaggaagccagagaagaagctctacacaacatggtaacccagagggacatacctggagatgctagagcaactcggtcgcaccgacgacttgtatatccgcaagatggttatcgtggagcatcattgtgtgtggccactgggacaagcaagtgtccaccgaatgcgcagaaatcagaggtcccatgaaagtcattgacaagggtgtgacgactggtagcaatacacgctggtctacaagagcagacgatcgacgccgagcctggacccggtgcttagctccgaaggaccaaggggaacgccaagccggaacaattccacaaaaggcaatccaacaggtgtacctcgacttggaagctcgcacaaccgggaagatccattggggagacacagttaccatgtcaaacacacgaaccaaacgaggagcgtttaaccaacgcccaacgaccaaaancggagacggcggcccccacaggacacacagacaacggattttcgatcatagcataacgagaattgggcaaaaggggggccccgatcaagaccacccagggcggtaatgagtttgggacacgcggaaaagagagtgtacagaacgatcccaggtgacaacagcggagccgacccaaatacataagctaacgcacaaagcacaaacgacacacaacagnacgcgaaagaacgacagtagcccaacgagagaaaaagcgaacagcaacacaaaggacaggcag

SEQ ID NO: 708156 - DNA, 918 bp, Homo sapiens
agcggaggatcctcagaagaaggaattgcgcgttcgtgcgtcctagattcgcagtgcagcgtggagggttgaaggcagcgtgttctgattcttgagcgggacggtgaggcgcatacgtggcttggcgccgccgggggctatcgcaggccttgagatggccgagctaggtcggtgctttgtttgacctcgagctgctacgaagctttcatggtccagtgccgggtgctgggcagcccgtgaccctctgcgtcgcatccactcgactgtatgagtgcgtagtcttggaacacggtcttcgtgggttaacgcccgatctttagacgcgattctaaaactgatgaaggaacaccttcacacgtatggttcgactacgctttactggaaatgaacttggaacaactccatgaagacaaggcatagacatatacactagtaaataggcgtatagaagcacttgtacgaaggaaattgtcagcggatcacaaggcatgagaagcagtttagcgcaagcgattcacaatgcttctggattgtgaagtgggcaaagaagtacaataaagggcgatgcgtggagattaaaacaggtgtccttagaacgtaactattaagttgaaaacactgaacgcctccgatgaatcgccgctggtggcagggttaagttggaattgcttaagaccattaagggaaggaggttcagtcaaaacgagataccaagcctgaaaattccttccagttaataattcaccactaggttcgctgtttgttttaattggaaacttaattgaggaagcggaattccggtttcacaaacttgggagtgggattaaatcccctgggggttagaaaccacgttgaaaatgggcaggctaatgtagtctggggacttggctcaccagcctggtctccgatactccatgg

SEQ ID NO: 708157 - DNA, 994 bp, Homo sapiens
agccgcaggtcctgtaggcagccatggcgcccagccggaatggcatggtcttgaagccccacttccacaatggactggcagcggcgcgtggccacgtggttcaaccatgcctggccctgtaagatcctgcagactgtaatggccctggcaatgccaatggctgctgcctgcatctgcccctgcgcccctgcgtcgggtcccatcctggcccatctgtgctgctgccccactggttcggtaccacactgaatggtgcgctgcctggcctgcggcttcagctctggatggatgctcagtggtgtgcctggcattcacaagaatggtggccctggaccatcggcatttcttgtggatccgaggaggcggaacaatgtccactggatgtccctgcatggccaacgtgcagcggctgaacggagtacctgctccaaactcatcctcttccccaggaagccctcggcccccaagaagggagacagttctgctgaagaactgaaactggccacccagctgaccggaccggtcatgcccgtccggaacgtctatcagacaggcgaaagctcgagtcatcactgaggaagagaagactttcaaatgccttcgctagtctccgtatggcccgtgccaacgcccggctcttcggcatacgggcaaaaagagccaaggaagccgcagaaccaggatgttgcaccctgaaccccctaaagccctcctggggacttgggaactcagtcggcagtcatgctgggtctccacgtggtgtgttcgtggggacaattgggcctgggatggggcttcactgctgtgacttccctctgcaggggatttggggggcctttcttgtaacggacggcccaggcccttgaacactcaatatgtctatatcaataaacaactccggcgcgcactaacaacgcccggcacaacagtgctttacacgcgccctggacacaggatatctcacccaacttttgcaacgtggaccaacggggac

SEQ ID NO: 708158 - DNA, 330 bp, Homo sapiens
tcattccagcattactcatccagtccgtgtggtcacactagtctcattgcagtatccatctacatctagttacggttgaaactactatggcacagttctacctgactgataatattctccacctgtgatgctgggagattgaactagttgtgtgcctaccctctagagttgaggtggacgcattggctcatggctgtgatctccgcactttgagcatactgactgcaagagtcctggagcatcctggctaacacggtgaaaccccgtctctactaagaataaaaaaataaaaacattagccaggcgtggtggcgagtgaaattacggcca

SEQ ID NO: 708159 - DNA, 232 bp, Homo sapiens
cctagagacacacgtttcccgggctagtccacatagaccagatgagcgcttgggccgccgatgctgggcaagcaccgctaaggcatccgccttacctccatgcatattgagatagaccgggagcagcaaagacagaaaactgacgccagaacctcctcttcacgatcccaaaacatgggcaccatcatcccatgataagagacttgccccatcaatgccgccaatgctccgg

SEQ ID NO: 708160 - DNA, 1056 bp, Homo sapiens
  misc_feature (237)..(237): n is a, c, g, or t
  misc_feature (720)..(720): n is a, c, g, or t
  misc_feature (733)..(733): n is a, c, g, or t
ggctaggtagcgaggctgggtttgaatcggccgagggctctctggtgtggcgctgcggcagctggggcctgactggggcagctgcttatccgcttcgttcgactccttcaatgaggccgccatggttctggtctcctgtgatcatgctggtcacgcccctgctgggcctcactgtgcctgtgtggctggcgaagatcgcggagatggaggatgtgggtttactcttgcccgcctggnaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgancggtcctgtacgncctcaatgtagaaggtgacgctctggggggggggcccaaaaaaaaagggggggggaaaaaaaaaacctttccccccctttccccaaaaaattacggtggaccgtacggagtcgagaagcacagagcctgagttgatacaagtgaagagtgagctgccctggatccgcttgcatccccactgaggaaggaaacccctcctcaaacactatccggggggccgcagggatgccacggtcgctctgagaaggatcagtcatgtaaacccccggggaggggggaaccccttttttttttcccccccccctttttttttttggtccccc

SEQ ID NO: 708161 - DNA, 1001 bp, Homo sapiens
  misc_feature (237)..(237): n is a, c, g, or t
  misc_feature (720)..(720): n is a, c, g, or t
  misc_feature (733)..(733): n is a, c, g, or t
ggctaggtagcgaggctgggtttgaatcggccgagggctctctggtgtggcgctgcggcagctggggcctgactggggcagctgcttatccgcttcgttcgactccttcaatgaggccgccatggttctggtctcctgtgatcatgctggtcacgcccctgctgggcctcactgtgcctgtgtggctggcgaagatcgcggagatggaggatgtgggtttactcttgcccgcctggnaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgancggtcctgtacgncctcaatgtagaaggtgacgctctggggggaaaaattacggtggaccgtacggagtcgagaagcacagagcctgagttgatacaagtgaagagtgagctgccctggatccgcttgcatccccactgaggaaggaaacccctcctcaaacactatccggggggccgcagggatgccacggtcgctctgagaaggatcagtcatgtaaacccccggggaggggggaaccccttttttttttcccccccccctttttttttttggtccccc

SEQ ID NO: 708162 - DNA, 417 bp, Homo sapiens
aagcggttccattgcgggcacccatgtctggacaggagaatgcggtggcacccggaagcttggggacaccaagaaccacacagagccccaaacagggtgtcacagctctggctcggggagctcctaggtctgggcttcctgaagggctgcagctcttctcttcttgtcacccacaatgtggaaagcggggcagggcatttcagccttatttgtgttacacctctttcagtcccaccattcggtgggtcccgagttcttgtcctgcggccaggaagaatgaggtatgcagacagctggagggtgagcaaaaaggagaggagctttattgggcaacagaacagttcagaggagacccatggtgggtagctcttcctgcaggcaggtcatcctgacgagtatccagctctcagcagagag

SEQ ID NO: 708163 - DNA, 149 bp, Homo sapiens
aagaccctcggtttgtttaccctggtgtttacatttattcgacatgacattgccaccggacttctactttgaggaatatctgtaacagtgagtatgaagcagagtgaagtgacatgaggtatgtctgtagctgttgcagtgtgcttccg

SEQ ID NO: 708164 - DNA, 782 bp, Homo sapiens
gggcagcggtgtgttacctgccgccagcatgatgcgaggcaaggtccagccgttccgcccggcatacgagcttatggagcagccccctttgaaggtctccaagtggacttcacagagatgccaaagtgtggagggtattcagaacaatattataggaggggtgtacaccctctgcgatattgagagtcatatcatcctctttcgctctggatattaggaacaatatcacagggttttgtaccccacctgcgatattgggagtcatatcatcctctctccctgtggatattaggaagagtatcacaggggtgtggaaaccccctgcggtcctgggagtaatatcagcctctctccctctgaaaataggaagattttcacaggggtgtgttaaccccctgcgatattgggagtaagatcatcctctccagccaggaaaagactaacaaggtcacggggggtgaccttgtaaatcccagcactttggaaggccgaggctagtggatcacaaggtcacaagatcgagaccagcctggccaatatgtcaaaaccccatctctactactaatacaaaaacttagccgggtgtggtggtgtgcgcctatagttccagctactcgggaggctgaggcaggagaatcgctgaagctgggaagcagaggtagaggtcagcaagatcgtgccactgcactcaagctgggtgacaaagcacgagtccgtctcacaagatacacaacaaaaaaacaaaacaacaaccgcacgacaaaaacgcacgcgagcgcaaa

SEQ ID NO: 708165 - DNA, 1357 bp, Homo sapiens
gcgacgagaacactgactagacgattcggtgcgcggcgcgggacaagaaggtaacataacctgatcatgatgctgtagccatagtgagagtgtcatgtgatcaatgatgtaggggcttggacattcatcatacaataagacaagtgcgcggagggaagcggttggatacaagaatcaaaatctgagagtggagatggtgagtgatcatggtattgtgattatatgagagatggaagtcgaaggcgagatatgatagtcacggatgtacgtgccccggagccgaaaggagagagagaaaggagagagagaagaggagagagaaaaaacagaagcaaaagaggagaaaaaaggaagagaaaagaaaaaagagggaaagagaagaaaagagagaaggagggagagagagggggaaggaggaaaaagagaggaaggaggacagaagaaagagagaagaggagagaagagagaagaggaggagcaccaaataaagaaagaaacacaaggagaaacgaggaagaagaagaagaaaggcgagacaacagacaagcgcagaaagacgggagaggaggagaagaagaaagggaggagaaaaacgaaagaacagaagcaggcgaagaagaaaagacgaaggagagggagaaagagccaggagggaaagagaaagatagaaaaaagaaaaacaaagagaaagagaggagcaacaggaagagaacaaaaaaagaagaaaacacagacgaaagagagaccagacaagcagaccaagaaaacagaacacagaagaagaagcagacagcgagacaaacgagacgagcaacaagaaagaaaaacggacgaagcaacgaagcaggagacaacagacaaagagagcaaggaaggagagaaaagaaagagacagagaaggaggaaggaaagaagagcggaaagaacggaaaacagacaccagcaggaagaaccagagcaagaagaagacaagagagacagagaagagcaaaagccaaagaggcggagcgcagcgacagaagagaaaacgaacaggcaagaaagaagcacagacagagaagcgcgagagaaacagggcgacgcgaaacggacatgaagaacggaacagagcaagagaagaaaggaaaggacaacgaaaagacaaacaaaaaaggagaagaaagcaggaacaaggaacagaggcgaacacaaaaggaagagaacagagtcaaagaaggaacagaaaacacgaaagagaaagagagcagagagaaacaacaggaagagaagaagaagaagaaaaaagaagaacaggaaaggaaagcgaaaaacaaaagaagaaaaggcaagagaacacgaagagaagaaagaaagaaga

SEQ ID NO: 708166 - DNA, 942 bp, Homo sapiens
  misc_feature (130)..(130): n is a, c, g, or t
  misc_feature (418)..(418): n is a, c, g, or t
cgtgtctcctatgtgttgagagaaattttaatatttatgtggaaatgtgttggaaaagtgggttttttgggacgccacgagtgaggaatttttgggtttatatggttataaaaggagccccacatctgcntttcttttagcccttaattagaaggacaaccccagcggtgtgattttaatgggctccaaaaatgtggggccccgcgcgattgattttggggagaatttagaatgttgaaggtaaaaggtgagccccatcccgtgattgttagattggggaaaaataatctctaagccccccattaaatctcgagtttaggaatatttccgctaatgaataacctcttccacacccaaatttcccccccatatagctgcccttcaagccataatgggatagttttaaatttctcttgcnctcgtttataaacccagataattctaaatacccccacgaaattatcctcgagtggtgtaaaattgagaagttgtggtaaactctgtgagaatgttttataaccacaaggtgtttaaaatagattaatgttaaattcttaaagatccactttaaaagagacttaatgttggccacctcgggtggcacaccccatgggctttcttcccacctataggcacaccacgagagagtgaccccacacaataatatattaaagacgcacaaatttgttcactcttctatattacacacttctgcctttttagaaaccactctttagttcactattctattattttttctaaacccacgtaactccctcttgttgaggggtaattattagtaagttaaagtttttaaatggagaatataaaatcactgtaatgcttattctttgctgtaaaatccaatgaatataaattgagggaaactttaaattgttgtaggatgactagtagtaaacatcatcttaatttttaaccata

SEQ ID NO: 708167 - DNA, 277 bp, Homo sapiens
catgtgtgttcacggagactgttggggggtcaggagactgcggggtccagagatgtgggggtcggagatgtgcgggtctaggagatgtgcagagcaagcgcacatgatgagctgatcggagatgcccaggtccggggatccaacggggtccggagacgcgcgggtccggagatgcgttgggttccttgcagacttcgctccgcccgggacattctccggaacctgcacatctcccatccacatattttcagacttgcacatctttggacccggacat

SEQ ID NO: 708168 - DNA, 886 bp, Homo sapiens
ggcgggtaggcgtctgcgctcggttgagggctcggcgcggggtttcctgttccttcttctgcgcggtgccagtcgggacttcggcctgacccagcccccatggcttcagaagagctacagaaagatctagaagaggtacaaggtgtgctggaaaaaggctactaggaaagggagtacgtgatgcccttacagctgaaaaatccaagattgagacagacactcaggaccaagatgcacagaaactcacagaagacagcaggaacttcttgatttatgaaaacccagctgcttgtggtgtgctcccatgaacaaccgggctatacggtgaaacatcagtaacttatggatgggatcagtcagataacgtttgtgaaaatctacattaccttactgaagtcctcaagttcccacctgagaaatgtgcaggtgcattccacggaggaaggtctttgatccttttggtaaagaattctaaatgggaggagttactccatgattgtgacaatctcttgaaacccatctctgtggaaggcagtcacaacacagtcaggactgataccgtgcttatattgtggcggaacggacaagtggaaaccccaaggtggattacctgacccagttgaaaggactgcaagaacaaagaggagcctcctatgagtgaacaggatcccagggaggatggtcgatgtccaacggcacttttgcgcatgcgacgaggctagaagcggccctacaaagccgcggagcaacagaagcagcccgggggcggatgcggcactcagtcgcggaccgcggggggcacacgggcacaggaagcgcggtaaaggagacagaaaccagcaggagacctggggggaaagtgaccgcgggggcgcgtgaggggaga

SEQ ID NO: 708169 - DNA, 231 bp, Homo sapiens
cgagctcggtaccccccgtgttgcgctcccgcccggtgttgcgcttccgcggacgctaccccgcgacgaataagagggccgctgcggtgagccttgaaacctaaggcgccggccccggtggaaccgccgcaagtgcagatcttggtggtagtagcaaatattctaaccaaaacttctaaagccgaagtggagaagggttccatgtgaacagcagatgaacatgggtcaatc

SEQ ID NO: 708170 - DNA, 305 bp, Homo sapiens
tataacgcgtcagggtctgcaactccactatccctttcagcttggtcttctgccataagttcaattagtcacaacactcacactagatgtgagtgtccagataatccttatgctaaaagcttctgcgaaatgtgtccacatttattgtttggaaatcgcaactcccagctccaaaggggttaatgtctgaacagcattctactgcgactcaagattctcattttcaccaagctgtgtaaggtttccttctgtacctttgtcatcttcccaacttgcagccaactgtgtcgactgttcagcatcac

SEQ ID NO: 708171 - DNA, 811 bp, Homo sapiens
  misc_feature (52)..(52): n is a, c, g, or t
  misc_feature (71)..(71): n is a, c, g, or t
  misc_feature (77)..(77): n is a, c, g, or t
  misc_feature (84)..(84): n is a, c, g, or t
  misc_feature (86)..(86): n is a, c, g, or t
  misc_feature (92)..(92): n is a, c, g, or t
  misc_feature (99)..(99): n is a, c, g, or t
  misc_feature (113)..(113): n is a, c, g, or t
  misc_feature (115)..(115): n is a, c, g, or t
  misc_feature (123)..(123): n is a, c, g, or t
  misc_feature (135)..(135): n is a, c, g, or t
  misc_feature (145)..(145): n is a, c, g, or t
  misc_feature (155)..(155): n is a, c, g, or t
  misc_feature (158)..(158): n is a, c, g, or t
  misc_feature (160)..(161): n is a, c, g, or t
  misc_feature (164)..(164): n is a, c, g, or t
  misc_feature (213)..(213): n is a, c, g, or t
  misc_feature (215)..(215): n is a, c, g, or t
  misc_feature (226)..(226): n is a, c, g, or t
  misc_feature (235)..(235): n is a, c, g, or t
  misc_feature (239)..(239): n is a, c, g, or t
  misc_feature (248)..(248): n is a, c, g, or t
  misc_feature (251)..(251): n is a, c, g, or t
  misc_feature (266)..(266): n is a, c, g, or t
  misc_feature (269)..(269): n is a, c, g, or t
  misc_feature (274)..(274): n is a, c, g, or t
  misc_feature (282)..(282): n is a, c, g, or t
  misc_feature (285)..(285): n is a, c, g, or t
  misc_feature (293)..(293): n is a, c, g, or t
  misc_feature (304)..(304): n is a, c, g, or t
  misc_feature (316)..(316): n is a, c, g, or t
  misc_feature (322)..(322): n is a, c, g, or t
  misc_feature (385)..(385): n is a, c, g, or t
  misc_feature (418)..(418): n is a, c, g, or t
  misc_feature (425)..(425): n is a, c, g, or t
  misc_feature (446)..(446): n is a, c, g, or t
  misc_feature (454)..(455): n is a, c, g, or t
  misc_feature (469)..(469): n is a, c, g, or t
  misc_feature (477)..(477): n is a, c, g, or t
  misc_feature (484)..(484): n is a, c, g, or t
  misc_feature (494)..(494): n is a, c, g, or t
  misc_feature (509)..(509): n is a, c, g, or t
  misc_feature (513)..(513): n is a, c, g, or t
  misc_feature (556)..(556): n is a, c, g, or t
  misc_feature (574)..(574): n is a, c, g, or t
  misc_feature (593)..(593): n is a, c, g, or t
  misc_feature (719)..(719): n is a, c, g, or t
  misc_feature (803)..(803): n is a, c, g, or t
tcgcagaaatgcaaagacgcctgagtgatacaacttgcaattattattttcnagacagaagtgccaacggnggtgcnttccagngnatcagnggttgcnacattctccttctngncttcgggnttcatggcaggnaacagaagtncttccttgangtngnnggngtccgtgagaaacatggcgactcgatcaatgcccatgccccagccagcngnggggggcagcncatatgccngggnagtacagangtnttcatctatgaacanggnctcancatcaccngcngccttggncttggcctgtncttcaaaaagcngccgcngccgcatgggatcattcagctcagtatacgcattgcatatctctttcttcatgacaaacagcncaaagcgctcagtcagaccctctttagagcggngccattnagccaaagggctcatgtgtcngtgggtgnncacagatgaatgtnggattgangcaagtnacttccaggnactccccaacaagcntgtnaaggagcctggctgtggtccgaggtggagggcattcaacagcntttgccacacgagatatnatcaagaattttgcgagtntcttcagtttcaaagaggttcgtttctggcagcttcatccccagggctttctcaagctcttctaccatgttgattcgccggaagggtggggtgaagtcaacatcgtaggcttggccctctgggcantctggggtggtaggtgaccttgtaactgcctgtaatatgcttcaccatccctgaaaccatcttctccgtgatttccatgagatngtgatagt

SEQ ID NO: 708172 - DNA, 219 bp, Homo sapiens
  misc_feature (38)..(38): n is a, c, g, or t
  misc_feature (96)..(96): n is a, c, g, or t
  misc_feature (102)..(102): n is a, c, g, or t
  misc_feature (115)..(115): n is a, c, g, or t
  misc_feature (180)..(180): n is a, c, g, or t
ggcacgaggtgaagtctactagtaggaatagacctcanttgatcctcaaagatggtgagtattgagagagtgtttatctctaacttagcctttgtntttctnttcacagaatttnttcaggttgaattacctagaagtttgtcactgacttgtgttcctgaactatgacacatgaatatntgggctaagaaatagttcctcttgataaataaacaatta

SEQ ID NO: 708173 - DNA, 1944 bp, Homo sapiens
ggagaactgaagactattctcagccatcagactgtcgacattccatgaaatagtagtcgagcattgactctgcagaggtggacgcacaggtgtatcgagcaagggcccgcaggaggcaatcgcctgcggagtggactttcgaaatcaagcagtcagatgtaggagacatcgatgctcttgcgttgcgtaaagatacaatacagaatacgaggctcctgggattgacaaaatggtggaggtaaactgaaatggaactctggagtgaccgttctcggagcatactgtatgatatggtccatgttagcatgaccagtgagtcaatagggatgttatagaatataggtggcgttcacgacttgaacaatgagtgaaaggtcgtggtgggtacgtgcggtcaagctttttcgcgcaggtaacatagcgaatttggttttatatacgcaaagggacagaagatcgaggggtactactattgctccttgaagacattgcgcggaaaaagtgtctccctattggggctatgcaatacacaatttatacattccggagcaaggggggtactccggggacatagaagtgaccaccagagcgatttagtcagacttcgcggtaagacaggagaaatatacctacgaaacggccccgccatgggaacacaaggacgtagagaaagcggaaagggtgccccctacggtacaaagggaaaaaagcagatgaaaccccacattaatggaaagcgcacccaagagattgcgggcgaaacgacactattcaacccacccgacgtgaccgtgatgagaaaaccacattccaaagtacgacatatggcacacagagccacaaaggaatgaggaatatatcaaaataacgcacacacgcggaagctcactgtccaagcaggtaaaaccaacacgggtgcacggcaagaagactgggggacaaccttcagtgaaaatatgggctacagtaccttcgcacacgacaaccacaacggcggtcaccaagccgtctggacacacacaaagagggcgcgaagcagggatcgtcgtagacgatagcacaccacatcagcagagaaaaactccactaaacatagcgagcaagcacggactacaccccaaaggggaggagtacagcgagacacaagcatgggaccacgcgacaacgtagatccacagccaacatggacaccaccaactcagacaaggaaagcacacactacacctctatgcacagcggacatcaacaacaactaggacgaacgagcatcggtcaccaaataacacacagaatgaaaccccgtgagactgaggagacaccctggggaaaagacagaacccacagaccagagaacaagacaccaagccgaacagcacagacgaacaccagacaaaaaccgcagagctggcacacaggacaaccacagaacgcagcgcaccagcacaacaccaggaacacccccacgagaccacaaacacgaggcgtcaccacacgcacacccagcagcaccacacgcgatgcgactcagaacacaaaccacggagacacaaacacaccaagagaaacggaagcaaactatcccacaagagaacacacagagtgcgcaagacacaaactcacctgaaaacagcacaacgcatagaccccagcacaacacatgtgagccgcgacagagaagagcgggcaaggacaaccacgccgaacagcaacgcagacaggtcaacgccagagaccagacgcgaaagccaaaagacgacgaaaagaaaggcgaaacacacggagagaacgaccgcaaacaaggaagctaacagcgaagagaagcaacccaggaggaacagacacaacgcagacgaaagagaagtggaaacaaacagcaaaccggagacaaaacagaacgacatacccaggagacagaacgagagacaaccagacataacaaaacaa

SEQ ID NO: 708174 - DNA, 200 bp, Homo sapiens
gttccagctgcttctctcagaggctgtgagccgcgcagctaaggcagccggagctcggtccctgacgagcccagagagcctgagccgggacctggaggtaccagaggttcaggagagctacaggcagcagctccggtctgatatacaatatcgacagtgggaagaccctgctacagtccccagcgctccccctcatcggc

SEQ ID NO: 708175 - DNA, 118 bp, Homo sapiens
taactggctaggcaattgcgagggaaactgggtgctactagagcttctcatattagatggcccttagaataccttctagttactagttcctaattatggaaccagacttcttgatccc

SEQ ID NO: 708176 - DNA, 572 bp, Homo sapiens
  misc_feature (26)..(26): n is a, c, g, or t
  misc_feature (34)..(35): n is a, c, g, or t
  misc_feature (54)..(56): n is a, c, g, or t
  misc_feature (226)..(226): n is a, c, g, or t
gatacccggcacgctatcggttcaanggtggatnntgtaatcctagcactttgnnnggtcaaggcaggtgtactgtttgagcccaggagtttgagaccagcctgagcaacatagtgagaccccatctctaaaaaaatacaaaaaaattagctgggtgtggtgactcatgcctgtactcccagctacttgggaggctgaggcaggagaattgcttgaacccaggagncagaggttgcagtgagccgagatcgtaccattgcactctagcctgggtgacaagagcgagactctgtctcaaacaaacaaaaaaagagcagctggaggctgggcatgagccaccacgcttgatcggaagtctccatttgtaagggttgtcttcctttctgtaccaggaaaagcaggatgattctaaatcactaggaactcatcagtagagatggctctggcttaaatctgtgcagcaaacctcagtcttgtttactctgcttttcctggcggctccctcattatcagccttctccgcagccttctttctctgtccagcaaatgatagtattgaaccggatagcttg

SEQ ID NO: 708177 - DNA, 930 bp, Homo sapiens
cacggtggctcacgcctggaattccagcactttgggagagcccagagcaggcagatcatgaggtcggtaagtacatagaacagcctgatcaatcgggaaaaacccctctctctactaaaaaaaacacaaaacttaggctcgggcggtggttggctgatgctgcctgataaatcccagcctactcaggaggctggaggcaggagaactcgcttggaaacccaccagagagcgggagagtgttgccaaggtgtagacttgcagagtactgctagccccactgtcgatcatctccacgaccctgtgggcgcacacgaagagacgactcctactcgtcatcaaaaataaagtaaagtaaagaaagaatgaaattaataggcctgagatgtgccttctaggtttgggattcgcatccatgactgttagcatgggcccaggcggcccgtcctcgatggaaccacgagcagcaataggaaccaacagctccaaaaagtggcaacaagaggtgtctatcaaatacgcccaagttcatcagtagagataatattctgaaaacaggggccagtgtgactcgagaattcattgccgagatgacatcctgtctagtatcggaaaggctgaagtggtggagtctgccctaagcccattgagggtgtagtaaaaccaagcattgagcttctcccagggtggtatgccattccctgccagtgtttaaacatttgggccgggtcttgtgtgacacgctgggggacgtacttgtgaggcctactgagctaaagcggttgggtgcaccggtgcgcttaggtgcccctgcccgatacaatttcttagctgtcccattataagccagggcttgatttgatgttatatggggggcatcggccatctgtatcccacctgtcgcgggggttccctagaagtgaatccccccgg

SEQ ID NO: 708178 - DNA, 196 bp, Homo sapiens
gacagtaaacggggggagggagagaaaaaaactgttgggtactgggcttagtacctgtgtgacaaaataatctgtacaacaaacccccgggacatgagttcacctatataacaaacctgcacatgtaccacagaacctaaaataaaagtttaaaaaaaaaaaacgttactagagatgcacctgaggtgtaatagag

SEQ ID NO: 708179 - DNA, 152 bp, Homo sapiens
tagaatgagcctggtcctggcttttgcgcggctctttgggttgcccctagtggggctcttggggtggctctttgtgtggctcttcgggtggctcgtcgcgggatctcagtctttgtgcgccgcaggtcatccccgtgcttccccaccaagcg

SEQ ID NO: 708180 - DNA, 702 bp, Homo sapiens
atcaagctgaacggatgccagagcaaatcaggctgaaagttggtggtgtggacccaaagcaggtggctgtttacgaagagtgtagcttgcaatgtctccttggctgtcttacctacaaatgacgttaagtcagcccacgggatttttagcccaggccgatgaagcaagcttgggcagacagagtgatgtagctcagatttatgataagtgttttacagaactggagcgacatctacatgccatcccaccaaatattggccatgaaccctcaagctcaggctcttcgaagtctcttggaggttgtagtattaatctcgaaatgtctcgggatgccatagcgtgctcgttggattgctccgaaaaggctgtagagggcttactagatgccacaagtggtgctgatgctgaccttctgctgcgctacagggaatgccacctcttggtcctaaaagctctgcaggatggccgggcatatgggtctccatggtgcaagaaaagatcagcaaggtgccgtaattgaagtgtcgagatgaatataaatataatgtggaggctagtggagctgctagttccgcaagcatttggttaatatgcagcagtatgatcttcacctagggcagtcgaagggaggaatggttgtgctacgtggcctgtggcattgttatgcagttagtataaatcctgctggtggatgaaaggagt

SEQ ID NO: 708181 - DNA, 913 bp, Homo sapiens
ccacgcgtcgctcttctggaatcgcttgaacccaggaggcggaggttgcagtaagccaaggtcatgccactgcactctagcctgggtgacagagcgagactccatctcaaaaaaaaaaaaaaaaaaaaaattaattctgtaccatcacaatttttcacaacgatggcaagccttatgtttggggaccctgtttggctaggcaaagttacaagtgacctatggggacgctcaaatgtgtgtgtgtctctctgtgtgttggtgtgtgtgtgtgcactcaagacctcttaacagcctcgaagccgggggtggcatcccggccttgccattagcatgcctcatgcatcatcagatgacaaggacaaccctcatgacgaagcaacatgaattagggggcctctgggccttggcccaaaatggtcatcagaattgaccttagggactccagagcagcggggactgtctgtcaaaagactctgtatatcttcggggggtgagtttggttgagagaccgagagccctttgtccctggcaccagggctctccatgacacgggagacttcctgggcgggtgccagacgtggcatttctcctctcctcttgctgctcagacgagcctggattgcgcccgaggttgagacagaaaagccggaggagaaagatgtccaagacccactaatcatttttttgcaatcttcccagggtcctgggcgtcccgttggcactgggcacctttctcggatccgcctcttcctggtgccagctcctggaagtgccgctgggtggtgggtctccgccgccacgtcctattgcgttgccagccgtggaaccaccagccggggcggcggggggcgtcccgggaggacctcgcgggtgtctcgccctcaaacacaaggcgctctccgcccctttgtgg

SEQ ID NO: 708182 - DNA, 800 bp, Homo sapiens
  misc_feature (24)..(24): n is a, c, g, or t
ggggccgctaattctaaagttttnctttcttaatcaaggaaagtgaagtacaagtccttgcttgtggcaacttgtatggtttgttacatgagtaggcatctaaaacaagcttgcacattgcaagccacccagtgaagggtcattgaattgctattttaggactaactataccaaaaatgtttactcttttgagtcttgatttctagtctcctggactaaataggttccctgttttcctcccggttcagtttccagacacatcgcagaattataagaatattaaaagctcaggcttatacctacacaggattttctataaccctctttctgctttgagctcctaaagctatttcatagaaaaatgaccttatttttaaatagagggggcagttgaaaatcagtgaatgggcctaccccctaatgatttttttctcagacctaattataataattagccttatgaagtgctgattatctttgggcccagaggagctgcacaccacagacagaggtccgcattaagtaaagtggatttcactttcttcagttgtgagatttctcttttttcttctttggaatgatgcaaagatatatcttccaccaagctctcatttaaaagcttttttcagttaaggaaactatctcttggccatccacagccaggttgcatatttaaattatggatattccaagaaattgtctttcctttggaaagtggcaaaactttttgtgaaatgtttgttttatagttccaggccagtccctagaatctgggtagaattaaatgcttcacttttcat

SEQ ID NO: 708183 - DNA, 134 bp, Homo sapiens
  misc_feature (50)..(50): n is a, c, g, or t
  misc_feature (95)..(95): n is a, c, g, or t
caccgcgccacgtcgacacacgtgctgactcgcacgaatgcgcggcccgntcaggcgactgcgtcgacgatgccgttcagcgttgcgctcgggcntggcctggctcgtcaggtcgacgttcggacggaagtagc

SEQ ID NO: 708184 - DNA, 190 bp, Homo sapiens
tggttacccacctccccaagctcctttaaccaggacagcttccctcccagagtgagctacgtttgaggagagattgaagcaggaaggtggcagtaggctagagttagctcagatcggctacagatgaaggcccagagagtcaaagacatttagctcaccacacactgagtctaggaacggcactagtgca

SEQ ID NO: 708185 - DNA, 295 bp, Homo sapiens
ccgggggttttttcccttttgccggtaaatggttaaataaaggagcccgcccctttttggtgggccgggtatttccaaggggtttttgccccctctcccatttttagggaaattttatggggaaatggggggtttttttcccccggggggaccaagaaaacccgtttagtggtgcccctttggctgggggttgttttgtttaagccgctgggcccccaattttcccttttttttttaaaaaggtttagcctttaaatttggttttttttggctgtgggattaaaacctggattga

SEQ ID NO: 708186 - DNA, 142 bp, Homo sapiens
caggatctatagtaatattatcttattctaacttgttttgtatagaaatgcaacttattttggtaaactgatattatagtgaaataaatagtagctaaatactcctatcttaactaattctattatttctatttatatatga

SEQ ID NO: 708187 - DNA, 374 bp, Homo sapiens
atatcgaatcctcgtggacttcaaagaagcagtgtctatcatattgggtttagatgattcccgaggattataagtgagtgtggatcgcttttactcagcgtgtttgccttcggatgtttgtgtttccaccttgagtgtaagagtgtcttccaaagccgtgtagaccctgtgtcaacttgggtttgataagtacacaggaattctgcaatgccacaggtagtgtggccaatacctccggattctttcttataagatcgcaccagttgtctgtggtacgcacacatatgccacacgtgttaaagagagaaataaaagacgcataagagtagagatttatatcgcgggggcgcgaggcccctctcaagatgtcagag

SEQ ID NO: 708188 - DNA, 1130 bp, Homo sapiens
atagttacgctattgaagttgatcctgtacttactgtagaagagaagtacccttatatggtggaattggtatactaaatcacatggtttgtttgtcaggcaagacttataccataagactgtagctttacaaagaacattagtcggctaagcaattctgacggattgatgctcataaaggaaggatatgagaaattatcgttttagaataatgcatccagactaagcatagcgatcccgcgtgattcaatatcttcttcggcctggcaatcgtgcgaagtgttactatgaggaagttattcgtcaagacttgaggtgttctatcagtctccacatgctcagacagtgtgctgtccgaaattcttgtattggcagtgtcttgcagtggacaacctggggggtgcgtccaaacagtgatcttcaacagggcaggaacctaacttccactgctacttttacacgagagaccatgcactggcttgcctgtgtagcgtaaagtaacaacgcagataatctcttcgagacttctacatcgtcagagacatggatccatagttatgctacaaccaatctatacctttcctattcctaggcgtacgcacatgcgccgccaaagggcaggacctttaacagcaaaatctggtcaaggaattggcaagttgagccccaacttgtgttgaaagcaacaaacttgcgtgtaaaaaatctgggaagtaatctttatacagcgtgaattaagcatgcacgtgtcactgcacgccgctctgttgtagcgaaaaaaaatgaataacctattggggaacagtcctttatctcgaattacctatgtcttatctgaaacggctaacgcacaagcagtgcaaaagtccaagtttgggaaacgctaagctcacaagccgttcctagttatttcacaaggacaaggatgtttcctattataaatgatacgggcaattttcttcctagatgaattggaaaggctgtcctccttccctggttggggggtgccataggttagaaaacctggtttacattcccggtgtccctctgtgtgcctggacgaagtacttctcatccttaataaactaagttctctgctttacactccttcgaaacggaggttgcccccat

SEQ ID NO: 708189 - DNA, 111 bp, Homo sapiens
gaagcgaaagacctgcccttggacaccagcgagtccagctcggacacagagagcttctacggcgcagtctagcggcctgtgaatctcagcctttccccgtacgccttgctg

SEQ ID NO: 708190 - DNA, 781 bp, Homo sapiens
agcggggtttggatactgagctgcatttgcctttactgtggagttatgttgccggttctgctccctaatcttccttttctgacgtgcctgacgcatgtccacattgagaatctgtgacataccgtacctgaataaaggttatatagttgtcatgagactgccaagcagtccggacactacggggtgcacagtaatcactgaaggggacaagatcacagaatagactatgggctttctacggcacattaaagaatgattttttacaaaatgacaagagacaagttggaccagtggtactgaggtccgactcttatttcttggggaaagaaagccactgcataatagtctcatgaactatatcataggtaccagctgggcttgtacccatcgttcatgcaatcatccaatcaacttattgagggacctcacgagcagccaatggccaagggcaacagatgacgccgaattacatctgtcgcagccacctacatggccatccgaggaatggctaaacatatgttatcagagctggagtgagaccagagaaatcgcttgcttctcagatgaactcattgatagtagtgaaccagctgcaagtaagacatatgatgcaagtgatagaaccccagtttcaacgagacgacagttgtcattgctccctaaagagttggcactctatgtgctttcattcctggaacccaaaagacctgctacaagcagctcagacatgtcgctactggagaaatttgggtgcagacaagcttctctggagcagagacat

SEQ ID NO: 708191 - DNA, 221 bp, Homo sapiens
cggatatagagcagagagatgaagaaagggatgtgggaacagatgaagaagaagaaacagcaaaggaatctacagctgaaaaagatgaatggtaaattatactctcaccattgggatccggtgtggagagggaatgtgaaatttacatcatttcttttggggagagactggtttgggatgccccctaatccccgttctccccggcctctagtgtcagtttt

SEQ ID NO: 708192 - DNA, 149 bp, Homo sapiens
gtcctacggccgctgatacggcggcggcttctgcgattgctacgcggattgagcaccggtgagtacacccgctcgctgttccagtgtggtgaccatcgcgctggtggtgtcatggatcgcggcggtgctgttcatcccgtacctgggcg

SEQ ID NO: 708193 - DNA, 341 bp, Homo sapiens
tcatgcatgatagtgaggcctctccagaccatatggaactgtaagtccaattaaacctctttctttcgtaaataggtcagtcttgggtatgtcttaatcagcagcatgaaaatgaccaatacgtcccccacaacattaacactaacatatgcaggtcagttaggaaaactacattgccctctagtactttattcatctttgtaagttgaaatgatattaattcccatcttattctttaagaatgctgtgacagaataatcaatgctttgcatagaatcatttttcattaattaaaaatccttcattcatgatgactgacacatataaaaattctcaagctc

SEQ ID NO: 708194 - DNA, 104 bp, Homo sapiens
ggagacggagttttgctcatcacccaggatggagtgtggaggttgcagtgagccgagatctagtcactgcactccagcctgggtaacggcaagacttcctctca

SEQ ID NO: 708195 - DNA, 791 bp, Homo sapiens
gcttaatcataatcgattcagcagccagagaacataatcatatattatatctatcttgcgaagaccacactttatccccgaccttgtgctatcatcatccgatgaggcaagcagccagaacgcctgagcgcaggcacatacttcctattctacaccctagttaggctcccttcggcctactcatcgcacgaatttacactgcatcaacgaccctaggctcagtaaacattctacatacttcgacgtctcactggccgcaaggaactagtcaaacgtcctgagccaacaagcttaaatagtgagctacgcttagcacagatagcttttcatagtagagagagtaccttctcttacggtacatcgcacgttatgacatccctagagagaccgccagtgtttcggataggtccactcgctatactgtcgtgggaggtgcagagtaggttaacattcgcacgactagttatcatgcgtatcacaaatatcattaggagtcggcgtcatcaatggcgtaatgacaattaccgggcgctacgaacaagactcaatgtgcgttcaaactcccgcacatgaatcgaataaccaatcaattacgtcccttagctccacttatcccatatgctatcttaattccactaatgcagagcaataaattgatgagagcttaagctctcattcttgccatacgaacaaaggtagacgcatgagaagatcagttgcgattgcagtactctctcgaatgcgagtcacataggccctcagtagttaacagccgattactcaatccaaga

SEQ ID NO: 708196 - DNA, 158 bp, Homo sapiens
tccaggcaaagagggttttttttcctccccccaaaggatgtcccccccatcccctttgaaagcacttgcaggaaggggggtccccgtggtccccgtttgtgaacaaaattcctcaaaaaattttttgttaaaaaatggccttcatgtaaactgtttca

SEQ ID NO: 708197 - DNA, 308 bp, Homo sapiens
  misc_feature (2)..(2): n is a, c, g, or t
  misc_feature (13)..(13): n is a, c, g, or t
  misc_feature (43)..(43): n is a, c, g, or t
  misc_feature (71)..(71): n is a, c, g, or t
  misc_feature (77)..(77): n is a, c, g, or t
  misc_feature (80)..(80): n is a, c, g, or t
  misc_feature (83)..(83): n is a, c, g, or t
  misc_feature (88)..(88): n is a, c, g, or t
  misc_feature (99)..(99): n is a, c, g, or t
  misc_feature (117)..(117): n is a, c, g, or t
  misc_feature (119)..(119): n is a, c, g, or t
  misc_feature (128)..(128): n is a, c, g, or t
  misc_feature (134)..(134): n is a, c, g, or t
  misc_feature (145)..(145): n is a, c, g, or t
  misc_feature (178)..(178): n is a, c, g, or t
  misc_feature (181)..(181): n is a, c, g, or t
  misc_feature (200)..(200): n is a, c, g, or t
  misc_feature (206)..(207): n is a, c, g, or t
  misc_feature (225)..(225): n is a, c, g, or t
  misc_feature (244)..(244): n is a, c, g, or t
  misc_feature (246)..(246): n is a, c, g, or t
  misc_feature (284)..(284): n is a, c, g, or t
  misc_feature (305)..(306): n is a, c, g, or t
cnactgaactcanagcctgagcgacagagtagagactctgtcnaaaaaaaaaaaaaggctctacaaagtgncatgtncancanaaaangggaatagagnacagggtgaccccaagangntcatttgtnacactnaaactctccanatatttatcccacgtgggtctgatgcgggactnagnactaaattaactgtatgtngaaagnntcaatatacagagccttnatgtatcgatgaggcttcngncacttatccatacttagcccccttgcctcttccttggnagcatgctttctattcctatnnaa

SEQ ID NO: 708198 - DNA, 145 bp, Homo sapiens
ccctgagaggcaggttcccacgaggcaggtcccactccttgcccatgcccagattggaacagcttcgtcttgaggaggccatctggctgagaagatggagtcagactgtcaggagtgtgccaagggtgagacccctgtctccaca

SEQ ID NO: 708199 - DNA, 370 bp, Homo sapiens
ggtgggcatgatggcaagggacaaagctacaacttggcctgtgcctttggaagctgaggcaggaggaccatctgagcccaggagcctgagaccagcctgggcaacatagagaatccgtctcaaaaaaaataaaaaaattagctgggtgtggcagtgctcacctgtagtcccaggtgctgttcgggagactgaggcaggaagatagcttgagcccaggaagttgaggcttcagggagccatgatcacactactgcactccagcctgggcgaaagagccagactctgtctaataaagcaaacaactcagactcaaggttgcttgttgctggctctcagttaaaaaaacagcgtgtagagacgattaaagttc

SEQ ID NO: 708200 - DNA, 352 bp, Homo sapiens
gagcttaacggctgttacccaccactgagattatctccaactccggaaaatccgcttcactgcgccgccacgtcataacgcaacggcggaatgtcccggttctccttgggcgacacccctccagaatcgcaatccgcgcatgcactggtaaaacttggtgcaaccggcgttcttcaccgtcccgacgaagtcacacaactcggcataactgtcccgaccattgatgccgatacggtgcttcaccgtcaccggaatcgacaccgcatcgcgcaatgtgccttcacacagtccgccacaagggcagggtgcgccatgaaggatctgcgccgaatcattgttgttcctgcaccag

SEQ ID NO: 708201 - DNA, 172 bp, Homo sapiens
cagagagaacgtttctatggctgctgcttctaggagtctctcgctcatagaaaaggcacacactgaaagaggaagcagatcccattgctgtggaagtcccattgttaggaagctctgcttttctggagttcaaattcgcattcatgatgctttaaaccgtcaagctgggtgg

SEQ ID NO: 708202 - DNA, 159 bp, Homo sapiens
tcggtaccgccactatctatgctaattggttataatcaatgacaaaataaacttttcacatcttcatgacaggaggtagttttgcaacttgacaccaggtgcctgctgaaggtagactctcagtctcctactacaatggttgaatagggctacatgcat

SEQ ID NO: 708203 - DNA, 257 bp, Homo sapiens
aagagtgtcactatctaacagagcctgtattctgacacgggggccagatgctggcctgcagcagtgtgctttggatattaacgtttagtttacagaaaagctctgacactattgttatgtctcaaaatcggcccttacaatctcacgtgcccacctcttcagcaatagtccccagggctagagggattgaatagttttaatttctggtcctgtgtctcataaaagcagtttattgtgattgttggtaaagaccgtcg

SEQ ID NO: 708204 - DNA, 271 bp, Homo sapiens
agagtttaatgatcaacctggtaacatagcaagactctgcctctaaaaaaaaagtggcttggccgggcgcagtggctcatgcctgtaatcccagcactttgggaggcggaggcgggtggattacctgaggtcaggagttcgagatcagcctgggcaacacggtgaaaccccgtctctactaaaaatacaaaattagccggacgtggtgacacatgcctgtaatcccagccattcaggaggctgaggcaggagaatcgcttgaacccgggag

SEQ ID NO: 708205 - DNA, 590 bp, Homo sapiens
gttctgcggagaccaagagaaggcgtgtgagcaacccacccactggaagatcacctactgaggaggatcctccaggaccgtccccggaccgacaggcgcgggtggatgcaggttctgtcgcctgtggagtcaccgtctactgccagccggggagctgggcggacaggaccgtccctcgcagggtccatgtgcccaggaagatggccccacggcctctagagctgggctccggtcctcggcgttgccagcctgccattggcctgactgaagaggctccgcatgctctcggggcgcggcggtctgttttcagcgcacgcgtctgtgaacccacaatgctctgggttgccatgcatgtgccccgcagttgttgtacccagaacgcagggagatgtatgtcacagctcccgctctggcctttccagccacctttcatgtcttcatattttaagctgcattgaggatagatgcaagcggatgagctgccctccgtcaggtggacacgggctgacattaccctgggagcttggtgcaagggagaagccgtcattttaaactgtctgcagagcgaccaggaggctcactgaaatccc

SEQ ID NO: 708206 - DNA, 902 bp, Homo sapiens
ggtgctcgttctcttcgcgaccgctgcgcgcgacccgtgtccccacggcggcagcagcgtgggggcgggctgaacgcggagggggcggagggagcccgggggcggcagcagctacagcgaaatggcggacgaacgtgttgacaccgggggttgatcaccaagccgaagaacctgaaatgacgctaaggacccccccagcactttcctcgaagatcgatgtgagcaaccccgcaaaacggtgtggggggcttcgcgcggggcccgttttccaccatattcacgaaacattcggggctcagggcaacttcttccctaatttcaaggctgaaagcactctacgttgtagacagaagggatacgggtgactttgaaatgcctgcgcagggtgatttaagaacggagaagagccaggggtcgttgttcccccagctcctgggaaaagcgtttgtggcgtcagctcccttttaggaggagagactggtggaattattggagtgcaccacttttttgggggaaagggacaacgaggggtgtggacgcaggtttataacaaggggcggggtcatccttgtggcagaaagaaggttgtctccccttggtttttacagggtgcatatggataagaggtatacgtccattaaaataagacttgctgaaattgggcagcaggggcaaaccgggcttcttatgttggatcggcccgtgacagagtctacctttaggatgtgacagaatgtatactgctcgtattatacccatgtccagttgttgtgcaggcaaagtattgtggaacccatccgcttaaaagcttcgcgtaggggcgatcccaccgttccggcgggggaaagggggtttcccggtggtgttaaaattccttgtgcttggcctctaaggccaggtgc

SEQ ID NO: 708207 - DNA, 109 bp, Homo sapiens
tttcctccccgtgacttaaggaggatccaaaggaaggagaaagaggttgatggtctgttgacttcagagcccattgggtctccgtctctccaagacagagtccgtattc

SEQ ID NO: 708208 - DNA, 174 bp, Homo sapiens
ggggggggaaaagggggggggaaaggggggggggtataaaagttccggttggaaaacccttttaaaaaaagtgggcctccacaaactttaagtctccaaggaaaagggttaagaggctcaacccctctttcagcttcaatgtggtgttgaaggtgctggtatcgtgttccccca

SEQ ID NO: 708209 - DNA, 793 bp, Homo sapiens
agcggattagtcaaacactttacagaggcagacagctgatttttaccacttcattccagactgggtcggtcaagtttccttgctttccaagtaagtaggggcttgtgaacccaactttgacttacgtgagagaccgctaactccgcctaagttgacctctaatcccaatgccatccttcgagcctgagatacctcgaaccacatcatccctaatggttcgtgccaactcagatgctgatcgtcgtcttttcctttggctttggaggctgagtggctttctatcaggtatcgtcccattgcggggactttggccagaaaacgatgtattaccatggacacccaatcatcttacccaagtattagccttctgaggtcggcggagtctttcgtcaactattgatcccttccactggattgccatgaagcgatgttcacaggcaaagcggcgtgcccaaatccaggacctccatagcggaaggttcttgtgatcatggctgcaagattagataatttcatgggttgctgtcatttgagggatgtgatcgcctcagaggatatatatttcttgaacacggaaggcatttgcctcctttagggatcatgtcaaccagttgaaccaaacaaaatgttctgtaatctaatacttgcgaagtaatggtcgaattcacgtgatcactcccaatatctgcatgctcatgtcaatgctgtggcacaggggacagaacggatcagacaggcttgctagatctgttacatctcacattgtgcgagaatggacgggaaatcaagcact

SEQ ID NO: 708210 - DNA, 433 bp, Homo sapiens
ttccaactctaaatctctgtctcatttcacctctttgtaaataatcattgctattatgttaaatatcacaactactgtcatttcttgtttacccactacattctaagcttggtgctgacatctttgtatttattatataaaattctcaaaattactctgcccgttaggctttcttatcacttattccaaatgcaaaaataaggtccagggaagataattatgtaacttgttcatgattggagagctaataagtgtcagagatgaattgaaccaaagttggtgtgacaaagcctctgttttaagcaaaagggaaaaaaattctcattaactccaaggattatcatcaggagtccaacagggttcccaatttgggaactactatatcattatcatatggcaaatggtccactatgttagatgagaggacaaaaaa

SEQ ID NO: 708211 - DNA, 341 bp, Homo sapiens
catatgggtaaggagatttgggcacccttttgcaggctgatgaaattttggagcctaaattgtaaagttactgggcctccctgctgggtaaaattcttttggaatttttgagcggcaaaagagttggttgcaggagccccacttgggtagtaaaaggtcacctgagggggattgggggctagggaaggaaaaaccttaaaaaaaaacaccaaagtaaaactagggttggtgggtgcaccaaacccccatggcacgtgtgtacctatgtaacaaacctgcatgttctgcacatgtaccccaaaacttcaagtataataaaaagagaaaatttaaaaaaaaaa

SEQ ID NO: 708212 - DNA, 359 bp, Homo sapiens
  misc_feature (78)..(79): n is a, c, g, or t
  misc_feature (83)..(83): n is a, c, g, or t
  misc_feature (121)..(121): n is a, c, g, or t
  misc_feature (125)..(125): n is a, c, g, or t
  misc_feature (129)..(129): n is a, c, g, or t
  misc_feature (133)..(133): n is a, c, g, or t
  misc_feature (178)..(178): n is a, c, g, or t
ttgcctcagccaagaattgccaggcttgatcgttttatcgttcttcagcacatcacttttgcccccacgctgtgacgnngcgnaggagcactagtcccgacacggcttaagcagagcaagngccncccnggtnccccgctgcctgttccatgaggactggtcccttccttttgttaangtgatgtgccactatatttacacgtatctcttggtatgcatcttttatagacgtcttttctaagtggcgtgtgcaaggtcctgccctgcccctcgggggctgtggtggctccccctctgtttggggtccagtgcattttgtttctgtatatgattctctgtggttttttttgaatccaaat

SEQ ID NO: 708213 - DNA, 415 bp, Homo sapiens
  misc_feature (134)..(135): n is a, c, g, or t
  misc_feature (139)..(139): n is a, c, g, or t
  misc_feature (177)..(177): n is a, c, g, or t
  misc_feature (181)..(181): n is a, c, g, or t
  misc_feature (185)..(185): n is a, c, g, or t
  misc_feature (189)..(189): n is a, c, g, or t
  misc_feature (234)..(234): n is a, c, g, or t
cacgcgtccgctaaacttgtactttatttttctgatagaaatggtgtgtggcgcgtttgaccctttaggggaaggggaaaaatcgtagtagcggtcttcacacatcacctcttggctcgcgagtgctgtgacgnngcgnaggagcactagtcccgacacggcttaagcagagcaagngccncccnggtnccccgctgcctgttccatgaggactggtcccttccttttgttaangtgatgtgccactatatttacacgtatctcttggtatgcatcttttatagacgtcttttctaagtggcgtgtgcaaggtcctgccctgcccctcgggggctgtggtggctccccctctgtttggggtccagtgcattttgtttctgtatatgattctctgtggttttttttgaatccaaat

SEQ ID NO: 708214 - DNA, 399 bp, Homo sapiens
actgtccctactgtatcctagagtttaaaaaaattcgatgcatgttgataagtggcttctactgtatggctgtccacagtaactctgaggaagatgttacggaaacatgacatgtgccaggagccagtggaaatcgagaatcttggcttctgtttctggctttccttttgatttgtgtgatcagttacattctcttttcaggccagatgccattatgataaactacaaggggtatatagtattttgttctgaggttttgccattgtgctcaaaataaataggttatcagctaaggcttaaaaatatcttttggaattacagagatctggggtttttcctgtaaggagcttgacttaaattttttttctgtagctctgttgtttttgcctgtgtacctct

SEQ ID NO: 708215 - DNA, 167 bp, Homo sapiens
catctataaaaaatcataaatggtgtttacaattcagtattaatgcatagcatattttgcatgtatatttatattgtttgtcaaattctttacatattaatgaattgtctttatctttcattattaaatatcttgtgtcaaggtagtatgaaaaacaagttatgttt

SEQ ID NO: 708216 - DNA, 1398 bp, Homo sapiens
ggaagtacggagatctcgctggtcttaacgttcagcctcggtgtctggagcatcctccgctcttacctcgtcctacgcgacgtagacccagtggtctacgaagttcatccattgtctagtactcaagatcctatgcctagtggcagagtcttgtgactcttcgcgtgagaaatcccatctgcttgtagagattgagtcctctttcacactcgaaagaggtactgcttcgagaagtcgtagtctgatagcccagctcgtgtgtcgttcaacattgggtactctattgcagggcctctgagaagactaccgggtgaagcaagaatgtattacacgactcggcttattattgaggagacagggtgttccgtcaaaggggcgtgatatcgacgcaactaatcaaagtatagaagcgtagtgtgccaagccttagcaccagttgtggttacagacaaggtagaaagcgtgaaatctggtctacgattgagagcaacgacggacggcgactttgaccataccagcattgagtggagtcggtacgattaggagtcggaaacacacggcaaatctacaaccgtacgaaagtccttacagagttttctcgcacctaggccggacaaacgggcacaagatatacttagggaaagcagcattgtatcccctcgatattgtggaccggatcattgaacagaaaaagcttgcgtgagaatggacccatgtaatagttagagaatataggcgcggatggcatacaccctcctccgttgagctataccgcctggggccagaacagacttccgggcatttggtaaccatatatagcaggacattcggtgtagacaaagcgcgtctccgtagtcaaagcggcactcctaattcgccattggcacccatatattgcaccctcagtaggcaggttacaccacaagagtgggatcagaaatccacagatttgggcacaagggcctattcgttccactttggtcacttggggacaccacaccaaaaagggacattgagaggcagcaaacatacacacaagaagcaaggctatacaaaatgtgaacgatccccataccccctaatgtagtcaggcgagacgtccaggaacaaacagaactaatacagaggtggacaaaggcccaacatagcacaggccaggtatggggacagccacagggaagaagggatccaatcgcgcaaaaaatacagccacctatggaaatcgcaccactgggcaccgatccacaagggagacagcacacagagctacttcgggagcaaacaagtaccgggtcccaacccacacactggaggcagcagccaccttgcacacggcacgggacttagaccacaccacaaaccgactaccggggacacacaagatagaagcacatgagg

SEQ ID NO: 708217 - DNA, 212 bp, Homo sapiens
tagcagcggtgactaacgtgtgcagacaacagggctactctgtgtttccagcgcgggcaaaaaccacagcgttcaccatggaggttcctccactgtggtgcgtctggattcagcgatcgattctatttttccatccgcaacgcatttttctcaatatgtatcgtatacaactctagttttctcacctcaaatccatacttgctgatttatac

SEQ ID NO: 708218 - DNA, 482 bp, Homo sapiens
  misc_feature (100)..(100): n is a, c, g, or t
gacctgtctcatcgtactcggttattaaatggcctagctcagcaaatgatcagccttgctaataatcacagattagctgtaattttaaccaatcagatgncaacaaagattgatagaaatcaggccttgcttgttcctgcattaggggaaagttggggacatgctgctacaatccggcataatctttcattgggctcgaaatacaaaggttggcatcattgtacaagtcacccagccagaaggaatgctcagtaatgtttccaatcaaacctcagggatttagagattctgttgttacttatgcatgttcattgcaaacaaaaggttccttgagcacccggaaacggtctctagacccagagtaagaattatatacccagaaactaatctcaaagtggtcaaatttattgatgttgtgaaatcaatgtgtacaagtggacttgttaccttaaagtataaataaaccctctatggcatgaatg

SEQ ID NO: 708219 - DNA, 148 bp, Homo sapiens
gtctgactctagagtatcccagcggattgaccgacacctgtcaggcggattgaccgcacattgtaaggcggattgaaccgccactgtcagcggattgaacgccactgtcagcggattgcaacgccactgtcaaggcggattgcaacgc

SEQ ID NO: 708220 - DNA, 1116 bp, Homo sapiens
  misc_feature (326)..(326): n is a, c, g, or t
  misc_feature (627)..(627): n is a, c, g, or t
atgacccaccatatcacatgactatcagtatagtaaaagccagagccatgagcccgtaacaggggccctctcagcccgtcgcataactggacctccggcgctagaccactgtggagttgtcatctgttccattccgagtaacggctcgctcaatagcataggagcctacctacatctgatagacatctaggactcatatacccaaatgaagtggcagcgactgtgacaacgagcaagagcgacgatgatcgcataggcacatccagaagaaccgatctagtcacgatgacatgggcgttcgaatacgggactaaatcctaatttanttacctatcaagaagctatttgtttatcctatccgtgagcgagttggtgcttggcgccatatgtataaccggaatccacgacacatgggacaacttcctagcacacgcacaatacttcacggacggggacaagcctaagggacaacgcactctataccatgtgccttgcgaaactcttcagccacaaagatctcactccgtgataaaaaaatgccctccgtcatgcccttgaaaagctacgatacccaggtaattgaacatacaggcgattctacggaagttattctatagtccactccangactgtctgctactccagttaggatccggtatatgatgaccaagggaaatctgaccaacctagggagtgacttgaacggcaaaggccaccatgctgctgtcactctaaacaacaggtaaattcaatcttggcggtggtacctaccttaatataggggtacaccccttcgcgtatcgcaagaccccgtgcagggacgatcaccctgggtcaatacggttacattcacgcttataacaggcagagttggctccgcagaatgggactacttcttaacagaagtatttcgcaaccaatttatgtaaaggggtcatggcccccaccaagaggctttgacccaggctggggggcacttgggcatcgggtatcgcactctgaatttgtggtggggtcccaaaacccttttgcccttccagcctaattgacatggcgctatacattccagtgccaaaacatacaagtaactttttcaacgttcaaagagatacacac

SEQ ID NO: 708221 - DNA, 104 bp, Homo sapiens
catcatctggtgagacttctgccctctccctctgccacgtcaaatccagttccctcatctgcaccattctgagcagcttcccaaactactagctttgtcccaca

SEQ ID NO: 708222 - DNA, 4525 bp, Homo sapiens
  misc_feature (2702)..(2702): n is a, c, g, or t
  misc_feature (2723)..(2723): n is a, c, g, or t
atgggggcggccgaggtcggaggcggcccgaaaagacgaagcgccgacggggaccggtggagtgacacccccgcaggtggccctggctgtccgggaccattcgagctgtttctcacactgacgttaccaagaaagatttgaaggtttgtgtggagtttgatggagagtcttggagaaagagaagatggatagatgtctacagccttctaagaagagcatttttagtagaacataacctggttctggcagaacgaaaatcacctgagattcctgagcaagttattcagtggcctgcaagaatgtacaaatctctactagacaaagctggcttgggatccataacttctgttcgcttccttggagatcagcaaagtgtatttgtttccaaagaccttttgaaacctatacaggatgtaaacagtcttcggctttcccttactgataatcagacggtcagtaaagagtttcaagctttgattgtaaaacatttggatgaaagccatcttttacaaggtgacaagaaccttgttggttcagaagtaagaatttatagcttggatccatctactcagtggttttcagcaactgttgtacatggaaacccctcatccaaaactcttcaagtcaactgtgaggagattccagcgctgaaaattgttgatccagcactgattcacgttgaagttgtacacgataattttgtaacgtgtggtaattctacaagaattggagctgtgaaacgcaagtcttctgagaataatggaagttcagtttctaaacaagcaaaatcttgctctgaggtctctcccagtatgtgtcctgtacagtctgttcccacaacagtgtgtaaggagatcctgcttggctgtactgcagcaaccccatctagcaacagacagcagaacactccccaggcagccaattctccacctaacattggagcaaaacttcctcaaggatgtcacaagcagagtttaccagaagaaatttcttcctgtctaaatacaaaatctgaagtactgagaacaaaaccagatgtttgcaaagcaggattactttcttcaaaatcttctcaggttggagctggagacttgaaaattctgagtgagcccaaaggtagctgtatccagcctaaaacaaacactgatcaggagagcagactggagtctactccacaaccagtcactggccttacaaaggagtgcttggttacaaagacttcctctaaggcagaactggacaatgccactgctcctgaactgcagaagcgtctagagcacacagcttccacacccgatggtctttcagacaagccagaagtggaagcaggtgtcactaggcttaatagctgttcagaaaagaaggttggaccttcagatttaggttcgcagtcacagaatttaaaggaaacttcagtaaaagtcgatcatgacagctgttgtacaagaagcagtaataaaacccagactcccccagcccggaagtcagttttgacagacccagataaactcaagaagctacagcagagtggagaggcctttgttcaggatgactcctgtgttaacatcgtggcacagctgcccaagtgtcgggagtgtcgattagacagcctgcgcaaggataaggaccagcagaaagactcgccagtgttctgtcgcttttttcacttcaggaggttacaattcaacaaacatggtgttctgcgggtagaaggcttcttaacaccaaacaagtacgacagtgaagcgattggcttgtggctgcctttgaccaaaaatgttgtggggaccgatttggacacagcaaagtatatcctggccaatattggagaccacttctgtcaaatggtgatttctgagaaggaggctatgtcaactattgagccacacaggcaggttgcttggaaacgagctgtcaaaggagttagagaaatgtgtgatgtgtgtgacacaaccattttcaacctgcactgggtgtgccctcggtgtgggtttggagtgtgtgtagattgctaccggctgaagaggaagaattgccaacagggggctgcctacaagactttctcttggataaggtgtgtgaagagtcaaatacatgagcctgagaacctgatgcccacgcagattattcctggcaaagccctctacgatgttggagacattgtgcattctgtcagagcaaaatggggtataaaggccaattgtccctgctccaacaggcagttcaagctcttctcgaagccagccttaaaggaagacctgaagcaggcatccttgtctggagaaaaaccaagtctcggcaccatggtacagcaaagctcccctgtgttggagccagcagccgtgtgtggggaagcaccctccaagccagccagcaatgtgaagcccatctgtccagccaacacatcccctttaaactggctggctgacctgaccagtggcaatgtcaacaaggaaaacaaggaaaaacagctgactatgccaattttaaagaacgaaatcaaatgccttccacccttgcctcctctgaacaagtccagcactgtcctccatacttttaacagcacaattttgacacccgtgagcaacaataattctggttttcttcgaaatcttttgaattcatccacaggaaagacagaaaatggactaaaaaacacacccaaaatccttgatgatatctttgcctctttggtgcaaaanaagacgacttctgacttatcnaagaggcctcaaggactaaccatcaagcccagcattctgggttttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagcagtgaatccagttttggcaaaccttaatctccctgcacattggaaatgaattacaggcagctgttcaaactcttcaggcaggattcctgtggactttgagattcatgttacctcatcttcttttttaaactgtaccccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataataaaaaaaaaaaa

SEQ ID NO: 708223 - DNA, 446 bp, Homo sapiens
gcttacatctatggtgagcgggcttacacttaactatgaaacctaaaaatacacacgtagattcacagtatttaacgaattacaaataacaattcaggggagaattaaggaagaagactatgttgtatatcttctctatttcatttcatttagctgttattttttcttttaatatagcctataattcgtatgctcaacatatacagaattaatgctttattaaaagatgattcaaaggaaaaaaagggggagatgtaaaaactgcagttcatattaaagatggttgaaaatagcaacatggagtggtaaaaatattaataaatagaaaacaattcaagcacacatttaaaagcagcagtgggagaaatggctgacaaggcaagtgggaatcagatttgaggcattcacatgctaggcttaaaaaaggtagatttctgaagaaagtg

SEQ ID NO: 708224 - DNA, 134 bp, Homo sapiens
ggtgtacctgctctctgcagcccctttctcacccctgggtcccactggcccctggctctctcccctctgctagcatctcgctgcagggattggtggggagtggggtggtcacgcacctgggtggcgatctaggt

SEQ ID NO: 708225 - DNA, 361 bp, Homo sapiens
ccgcctggaaaaggggagctacagggaagggtgaaaaagccccgattacatctcagctcctaaaactggaattcgatttacatgtatagtcatgggacgatgtttttgatatcttattaagtggaaaaagaagatgaaaaaaggagtgtacataggcatccaccctgcgaacatttgtgtgagtgcgaagagacagagaaggtgggagaaggacaaacacccagaccccgaaggtcaggggcgggcgttcgcatttcacgacaccctctggtgtttgacttattttttagggttggaatatccttgatatgtcatgtctatgaggcatccaagtctgacaataaacttggcagttctctat

SEQ ID NO: 708226 - DNA, 106 bp, Homo sapiens
aggctccagcttaacgatatttggaggtcagcacggtgctccacgtgtctgacgtgaacttgtaccagggaggcatgccaccgcaatggtaaatacacgtcgacca

SEQ ID NO: 708227 - DNA, 865 bp, Homo sapiens
tcccagcaagactgtcacgcagtacagcaagtaagcctgtggcctttcttctatgtgactgaccacataccccactctccaggacccatggagtccttcagactcaaagagactggcactgtaatgcagataagaacgctactgagataatcatggcgcgtatctgctctgtggactcatctcttcttataatgagacaagcagctgacgtgcatagatgagctctaccgtgtgtccaaggtaggtacatcggcgacgagcgcgcgcctccatggcccggacgcgcgttgatcccacgtgtagcctgcatcgaagaggtgtgcccatccaaggtgcgcgtgtgcttggctccgaccaattggctccttttggcctcctagttgaacgctcggccctggtcgtacccgctttcgccagtaagactgcggcccgggtgccatgcacgcgcacttagctttgctgaggtagacttacactcgttctaggctgctgtttctggctggcctgctgaccgagtgccgggatgtgctgctagagttggtggaacaccacctcacgcccaagtcacatggccgcatccgccacgtgtttgatcacttctctgacccaggtctgctcacggccctctatgggcctgacttcactcagcaccttggcaagatctgtgacggactcaggaagctgctagacgaagggaagctctgagagccctgagcctagcacattccaccttgacaaaatggttgactgagaaaacacagactatgggcttcctaaccctgtcaccttggcactaaacacttttcaatcttcaaggcttcattccttcccaagagtgctttttgactctgagaccagtccaccc

SEQ ID NO: 708228 - DNA, 1137 bp, Homo sapiens
ggtgtgaaccgccgccaggtcgctgttggtccacgccgcccgtcgcgccgaccgacccggtcagtcgtccgtctggcgacatgggacgtgcatggtggaaaccatcttccccagtgagactgggcagcaaccttccctcaatgcgctggccagacctgcgtggtgcactacaccgtggatgcttgatgatggactagaactttgattcctccgcggggacaagaaacaaagccctttagagtttatgctaggcaatgctaggatggttgatcctgaggcttgggacatgagaggggttggcccagatggacgtgtgggtcagagagccaaactggacttatatctccagattagtgcctaattggtgccacatgggcaacccaggtattcaatcccaacaaatgccagtctcagatcttcgactgtgcgcagcttctaataactggaagtgaccaggaatgggctcctcccttagaatcccttgattcttggaatctgccgggtggagggatctggtgcctccagacatgtgcacatgaatccatatggagcttctcctgatgttccacatccacttgtgtatagaccatcttgcctgactgaaatgtgttctgtcgactcagctttgcgttccgaaagcatctgtgatccatcttccccgtttctcctcgtatgtgtagtttacctaaactatattgccataaaactcaagttacctcatttgatatgtaacatttgcgggtgaagattcagaattccaggcatttaggagtataggggttcccatcaggtaccatggtcaagtattaacaggacacagtggacgttaacatagaattggatggggtacgaaagggagtaataaagaaattaatagaaaaaatgagagacagacagcgacaatatcgcactagtgaggggaccgggagcccaatgactataagagagagaggagaaagagaaaccaaagagaaacatgcaggaaaatagagagacaaaaaaggaggagaggagacgcagagaaaaagcagcaatagacaaacgtagaaaaatagagagagaacaaggaagagcaaacgatgataatactagaagaagacataactgatttgtcttctcctctttctttcataggag

SEQ ID NO: 708229 - DNA, 613 bp, Homo sapiens
actcacaaaaaagtcaaacattttattaccatatattaaggaccaaagctaaaatgtaaactcctaaaaaacgcgagtgcgaaataacctgggtgcccccggccctaagggccgaaatcccggcgccctacccaggggggccccccccccaaaaaaaaaaacatgctcgtccaaaattcgaaccctggcccaaaaaagggcaaagcctcctcccggggaaacaattggccccctcccaattgctaaagccctttagattttccgcgcccgcggcccaaccaaaacaccccatgaaaatccccccgggaaaacccgggtaaatcccttcccgggggtcctgctcaataaaaccctacccgactttccgttatgcccccccccccggcaggaaaagctaaaacaccctcgaacttcctataatggccccccaaatagccttggcgcaataatccgtcataacacggtcccctgcggaaaaattttaccccgctcccaaatccccacaaacaaactagctccagcaccatatggtcaacccccggggcctcccacagaggaaggccctccccacctaaatggccgtgggccaccaccgcccactcttacaaagacg

SEQ ID NO: 708230 - DNA, 406 bp, Homo sapiens
  misc_feature (3)..(3): n is a, c, g, or t
  misc_feature (23)..(23): n is a, c, g, or t
  misc_feature (41)..(41): n is a, c, g, or t
  misc_feature (55)..(55): n is a, c, g, or t
  misc_feature (150)..(150): n is a, c, g, or t
aanggtaaatccccacgagttgncctttatccttccttatncccctgtttataancctagcaacctgcaatcctgcattcctattgtccatcacctgcacctgaaccttacctccttacctaaaatcacctaaggaggcctgggtgtggntgcttacgctggtaatccccagcactttgggaggctgaggtgggcggatcacaaggtcaggagttcccagacccagtctggccaatatggtgaaacatctccaccaaaaaaatacaaaaaaattagccgggtgtggtggcgtatgcctgtaattccacctactggggaggctgaggcaggagaattgcttgaacccgggaggctgaggttgcagcgagcagagatcacgacactgcattccagcctgggcgacaga

SEQ ID NO: 708231 - DNA, 941 bp, Homo sapiens
  misc_feature (1)..(1): n is a, c, g, or t
  misc_feature (202)..(202): n is a, c, g, or t
  misc_feature (223)..(223): n is a, c, g, or t
  misc_feature (352)..(352): n is a, c, g, or t
  misc_feature (384)..(387): n is a, c, g, or t
  misc_feature (424)..(424): n is a, c, g, or t
  misc_feature (432)..(432): n is a, c, g, or t
  misc_feature (527)..(527): n is a, c, g, or t
  misc_feature (541)..(541): n is a, c, g, or t
  misc_feature (596)..(596): n is a, c, g, or t
  misc_feature (598)..(599): n is a, c, g, or t
  misc_feature (605)..(605): n is a, c, g, or t
  misc_feature (610)..(610): n is a, c, g, or t
  misc_feature (613)..(616): n is a, c, g, or t
  misc_feature (621)..(621): n is a, c, g, or t
  misc_feature (627)..(627): n is a, c, g, or t
  misc_feature (648)..(648): n is a, c, g, or t
  misc_feature (660)..(660): n is a, c, g, or t
  misc_feature (675)..(675): n is a, c, g, or t
  misc_feature (708)..(708): n is a, c, g, or t
  misc_feature (752)..(752): n is a, c, g, or t
  misc_feature (842)..(842): n is a, c, g, or t
  misc_feature (844)..(844): n is a, c, g, or t
  misc_feature (855)..(855): n is a, c, g, or t
  misc_feature (866)..(866): n is a, c, g, or t
  misc_feature (880)..(880): n is a, c, g, or t
  misc_feature (900)..(900): n is a, c, g, or t
ngggaaacttacacaccccccctcaaccgcacgaccaagtccagattggactctttctggatgttgtctttagacagggtccgtccatctcccacctgtttcccacctaagatcaacctctcctgaccaggaggcatcccttccttatcttggatctttgcctttacattttcgatggtgtcactcgcctccacctcgaggnttatggtctcaccattcaggntcttcacgaagatttccatcccacccctcatacggagccccatgtccagggtggactctttctggatttcttttttatccaggtttcttccatttcccacccttctcccatccaatatcaacctcttcntttcatgaggtattccttccttttttttcctnnnnccctttacattttcaatggtgtcactcggctccaccncgagagtnacggtctcaccagtcagggtcttcacgaagatctgcatcccacctctaagacggagcaccaggtgcagggtggactctttctggatgtcgtagtnagacagggtgcgtncatcttccagctgtgtcccagcaaagatcaacctctgctggtcaggagggatgcntnncttgtnttggntcnnnnccttnacattntcaatggtgttactgggctcnacctcgagagtnacggtcttaccagtnagggtcttcacgaagatctgcatcccacctctnagacggagcaccaggtgcaaggtggactctttctggatgtcgtngttagacagggtacgaccatcttccagctgttttccggcaaagatcaacctctgccggtcaggagggatgcgttccttgttttggatctntnccttgacattntcaatggtgtnactgggctccaccncgagagtgaagggcttacanttagggtctcacgagatcttcatccactctgagaggagtca

SEQ ID NO: 708232 - DNA, 124 bp, Homo sapiens
ttgccacaatgatgacgcatacttgctctggtcagtgacacgtacagacgcctgggtcattaaaaagccattgcatggtgctcgttgggccggacaaagggaaggatgatgaagtccttctcgc

SEQ ID NO: 708233 - DNA, 781 bp, Homo sapiens
  misc_feature (24)..(24): n is a, c, g, or t
gaccaggtgagtaatccagaggangagagcctacccgtagtccagagagtcttgcccacactatgactacgtaggggacgactcaccagaaccctacttaggggcggggagccactatgaggcctctgctgagtaccctgatcattgtagggccctactcgcttacctactgtgtcgggctgattatagacacgtatgtttaacatctctgtgcctgcacccgcactcatacatacacttctagaaatacatattatttatatatgctgcatagacttctatcattaccatatcttttctgtatatgtgcattgttgagaggatctgacctgctgatcaacaggtacttcactggatgtccattccatctgagaacacgctgctgtagcttgaagcacacactttcaaccttctagaaacaaggagaacatgagagactataggacgatctgtctatatctctctgggcgtgggcgagtgctctctgctgcacctggagtacgaggacaaggcatgccacaccacttaactatatatgtggatcaccggcactatcactcttgtcgctgtagatctctagcccactacaacagctcgtgagatccagaaccgtaacatttattattacactgaccctgatcgtaagatttatctgcttattcagttgatgtgctttgaggggttgccctactagctgaataactcccacttccagggcaggatttgaggcataatagagcaagggggcgtagactcctcatcctgttggccagatgccccc

SEQ ID NO: 708234 - DNA, 85 bp, Homo sapiens
  misc_feature (6)..(6): n is a, c, g, or t
  misc_feature (36)..(36): n is a, c, g, or t
gctcgnaattcaaagcttctaaccgatgtacggggnacatgtgataattcaatttgtacaataaattatgaacctggaaaaaaaa

SEQ ID NO: 708235 - DNA, 140 bp, Homo sapiens
cctggtatccaccccttggtgagttgagatgacagccgtttctccctcacccagactgcggcatgaatgtgcaccataaatgccgggagaaggtggccaactctgcggcatcaaccagaagcttttggctgagcgcttga

SEQ ID NO: 708236 - DNA, 613 bp, Homo sapiens
cctttgagccattcaaaagcaaggagttaaaagatagcagatctagggaagtctccatggccctttcagtaattctcccattagcatgaactgtggaatcatagtcagtgcctgttaaagacagctgtatgagcacatctgcataggattaataacctatagtcatgtgtgctctaatttcacagccagtgcaagtagtatcacatgttactcacctgtcatatctcccaacagagtagttgtagtgcactatcgggttcttgttgtctaagagtgtaacgagcgtagctaatgcatataggcttgccgccggcgaatgtttaatgtggtaggtgtagagtcagtcaatcggtcagcatgcacatgcgctctcagtgtacactatcctcattcatatgcaagtaagttcgtaacatatcctgcagttaatagcagtggcagatcctggttcactagcttctcataacgccgcgctctacaagcatcgttcatcagtgaggttcagacttcacatagtcaggtcacactggcagccacctgtcattctaactctggtccagtcagagggcacaggtcccagcgatgctgagcaatgtggcctgggcggcacgag

SEQ ID NO: 708237 - DNA, 283 bp, Homo sapiens
agcccttccacttctcacttcatacaaagaagtctccttactgtccagcctctcttattatgatctcaacctaaatgaggtgcttttccacctaagttcctcttataagttatacattagttctgcttatttatcttttccttatgtatcttatacactagttctgcttatttatcttttcctggctctatattatctcccttttcctttaggctccagttcaaattccatttcctacatgttacccttaacagcttttttttttttgtgagacagagttagg

SEQ ID NO: 708238 - DNA, 733 bp, Homo sapiens
  misc_feature (342)..(343): n is a, c, g, or t
  misc_feature (346)..(347): n is a, c, g, or t
actggcgcgggttgagttccctgttgcccttggtctcggggtcgctgtcggcgctgaggctgcagctatcatggtgaacttacttcagattgtgcgggaccactgggttcatgttcttgtccctatgggatttgtcattggatgttatttagacagaaagagtgatgaacggcttaactgccttccggaaacaaaagaagttattgtttattttaaaaaagggggaatttgccaaccccaagtgaagaagtttacttggaagtaaagactggctagattatcggatgtttacattttaaagttttggaggaataaaaacctgagaattttaaaaaaaaaaannaannaaaaaaaaaacatgttgggccgtttggcccaatcaatttttgatttagaaaggtttttcttgcggcccgaaatttgggctaattgggccaatttccctttaaaggggggcgatatacaaatactgggccggggttttaacaacggggaatggaaaaaacccgggggttacccaaatataaaagcgttggagaaaaaacccctttttcccaaatgggggaaaaaagaaaaaagccccccccagattgcccttttcacaatttggggccccctatagggggaaagggaaaattagggcgcttatttttttttgaaaaacgcggaaaatattttgtaaaaaacaatttttttatacacaaaggggcgagagggggaactcttttaaata

SEQ ID NO: 708239 - DNA, 151 bp, Homo sapiens
cggatcataagatcacagtctggttagaagctcgtagtattatcttatctctcatctctcgggtttgctctacatcagtcagttaatcattagttagtgggatacagtagtagcatttatctagttgataatatgtcagtcttccttttga

SEQ ID NO: 708240 - DNA, 182 bp, Homo sapiens
  misc_feature (45)..(45): n is a, c, g, or t
  misc_feature (135)..(135): n is a, c, g, or t
  misc_feature (151)..(151): n is a, c, g, or t
ctgctgcccccaccccagtattagcctagctttctaagctgtggnttagaggatagttggcttcttgcttctctcctttaaaatagcaagtttgggaaatcttggggtgagtggagtcaccccactcccagttgntggcagagactgagantaaagcatcacttaataaaccccccaagccc

SEQ ID NO: 708241 - DNA, 140 bp, Homo sapiens
gagcgggactctggcagggccagaaacgcgcgcagcgggggcgggaggtcggtaagctccccgccctgccgagacccgccggccgcccgcttttcgcctcccctccgcagtacggccccgcctcggcgagttatgtgacc

SEQ ID NO: 708242 - DNA, 100 bp, Homo sapiens
ctggaaggcgctgttgatccccccttcagcccatgcaggtcctagggggcaaggccttgaacactgccggcacagcactgccctgtcgggctagtcgggg

SEQ ID NO: 708243 - DNA, 156 bp, Homo sapiens
gactgtctcagtaaacaggtacacgtatctcgatgagaaccggaagtgtaatcataaatcttctaacatacaaaaaagaacaatctctacccaagtatagcttcactggagagatctaccaaacattgatcaacatacaataaataaatacataac

SEQ ID NO: 708244 - DNA, 285 bp, Homo sapiens
tttccccccagggacccccgcccctccctgtatttgggcagcagcttgtgtggctggaagccctgtcgataagcttcccgccctggcttgccagtttttcagctttaggacttgtagctttaaccaaacggtgtggcatgggttgagtgtggccccctccaggatgtgcagggctccctcaaaagctggctggggactttagcctttgtgttcataaaacccttaaaaaggggatggatgttgttccttttttgaagttgtctttaaagtgggggccccccccca

SEQ ID NO: 708245 - DNA, 876 bp, Homo sapiens
gcgaggcccgcctgcgccgcgagtacctgtaccgcaaggcccgggaggaggcgcaggctcagcccaggagaggaaggagcggtgcggcgcgcgctggaaaaaaccgcctgattcccactgagttacgccgagaggctctggccttacaggggtccctggagtttgatgatgctggaggtgaaggtgtgaccagccacgtggatgatgaatcccgattgggcaggagtcgaggatcccaaggtttatgatcacttacctcccgagaccccagtttcccgcctcaagattgtttgcaaaaggagctgacagctggtgttcccgggcgcccagcggaattgaagccgaggtcgacattgaagttgggggcgcactgttgcgagcctgcaagggccaagggggtcaccgaatctgctggtcgtcacgagcctcggggccacaccttgtgggggctcatcgtcagccacctgccctttggtcctactgcctacttcacgcttggtgcattgtggtcagtgcggcttgacttcccagacctgggcaccttgtcggaggccagccccaccttcatcgacacgcgggtttctcctcccgcctggggcaaagggggtctctgacatcctccgatacttattcccgtgccccaagatgacagccaccgggttcatcaccttcgcaacccaggacggagtaccttttcatttccggcccatgtgtttggaagacaggccaccgcacgttggagcccactgaggtcgggcccgctttgagctgaagtgtacattatccggtctgggccccctggacggaggccccgcgacgtgagggggctggccctttaccattccggggcaaaaagtttctggccggtgggcctcc

SEQ ID NO: 708246 - DNA, 202 bp, Homo sapiens
atctgtcatcgatggcactttgttgcgcttggtggtgctggtggacggaggggaggtgatggaccgccgccccaggctcacctggttgatgttgtgtagctgggactctccaggtccgccagggacgaagttgggccctgagtgctgttgcaacatggagtctgtgatactctcaccagtctccgtcacattccagtacccc

SEQ ID NO: 708247 - DNA, 405 bp, Homo sapiens
gaatacatgtattacaaaccaggaaacgcatcccattgtgtgatgtgtcacgatgcatctagcaccaagttaggtatttctgtacaacaggactcatctgtcagagtgcagatgacaaatcaggcagggaatcgaaacgacagcgctggaggagactcagtgaagcagaggcgtccctgccgactgcccttgacccgtgcaggcagatcatgacccttactgacagcctcttggtgctctgagtaatgagggatgaccagtcttgtcctgagaaatgttatctctttagtctttgaacttcaaagactaacctgtagcaatcagactttccaaaagggggttctccattttttgtagttttgtctaaatttttactgaccatttcctggaatcagtttattatac

SEQ ID NO: 708248 - DNA, 390 bp, Homo sapiens
gtgcaaaagatgtggcttcacagaaatagagcgggcaggcactggtggtcacgccggtcataccaacagttcgggaggcgaggcaggcagataactagaggtcaggaattcgagaccagccgggccaacagagagaaaccctctctctactaaaaatacaaaaattaggccaggagtgatggctcatgcctgtgatcccagcactttgagaggccgaggcgggtagatcacctgaggtcaggagttcgagaccagcctaaccaacatagggaaaccccgtctctactaaaactacaacattagccgggtgtggtggcacatgcctgtatcccagctactcgggaggctgaggcaggagaatcccttgaacccaaaaggcaaagattgtgg

SEQ ID NO: 708249 - DNA, 274 bp, Homo sapiens
  misc_feature (170)..(170): n is a, c, g, or t
ggatcttctctctctgtatgtttgcgcgtgtgtcttctgcgatcctataaagttgctggtctataatttgtatatgtgtaatacacgtgctctgtgagctgcttactagctgtgataacaatgttgtccaacaataacaggaattttattttgactcgagttgttctaanaataaaaaaaagttcacatgaaaccctctctctactaacaatacaaattagccgggtgtcatgggcgcctatattccagctacctggagactgatgcacgagat

SEQ ID NO: 708250 - DNA, 1074 bp, Homo sapiens
  misc_feature (587)..(587): n is a, c, g, or t
cgtctcctcgcacagaaaagaacacagcgcaaagagagcacgagcgaccacgacgaagagggtcttcaattaaacgcggtgcacacagctccgccgcccacgcgcacacaaattgcggccgtcgatcaagtgacttctcaccaaccggggggggccccccggcacccacccgggccccaagaccttggaccagatttccagccccaccaagacgccgctggtacacagggttttcttttcacgccaccgggagccgcttgcctggggtgagcccgaggcgagcaccgtttgtgcccttggctgatgccggaccaagcaagatgtccccttccccgactttttggccttcttggaacgactaacaccattgtctggcgcctggaccttgcgttcccgagacaacccagcctggtgggccaacggggcccccagactgctgtccccggggcttgttcgaccttatgggcccccccccccccggggatccttgagctttctggccgggccggctgggacacgttctctgtacgccagagcttctgccagcgtggcttgaccggccccgccgaagcggccttctccaggancctggagccaagaaaggcgagagctcccaagggtggcacccggctagccgggccgccgggcctataaactccgctgcacaccacagaccacagcgtcacagccacaagtctcccggtggctcacaccggccggccaaggcccacagtggctcccacagtttctgcacccacctggcaatggatggcggccactgagtattctgggaatgtgaagagcttggagtcacgccctgaaggacctccagagtcacaatgacccgtgaggaatatgttgccctcaatcctagctgtctggggacaaccgcgggagaaggggtcacgggaggggctaaatggttgctttgctggaatagttttctggggtacccatacgagattcccctaggggctgctccctccaaaagggaggggaccagatggggagacttttcttacctatttcacaggcatacctgccctttttctttaaagctttccaacttaattg

SEQ ID NO: 708251 - DNA, 165 bp, Homo sapiens
tgtttcgcagcctgctgagttacatatggactcttattcttatttatggtggtagcggtgacctgtgatattgcccccccgttttaaaatttcgacagtctcacgctgattccttttcaattacaaaaaaagccccccaattccagggattctcgtggctaaatt

SEQ ID NO: 708252 - DNA, 198 bp, Homo sapiens
tactagccgcgatacaccactgcacctccagtctgcgcacacagtgagacttagtctacacacaaccactaaaagaccaaacgaaatcatacctttatggtgttcagggtattgtgtataacccatatctccagctcctggctcatcttgggaacgtggtcccagagaaaggttgaggattgcctaggctgggtctcc

SEQ ID NO: 708253 - DNA, 334 bp, Homo sapiens
ggatgaccttgagcccagaaggagccccagattccttccctcttcagccgaagatcttggtttgctctttgatgctcttgatcaggccgttgaaatccaagaggtcactctggggaagttatatgaagcctcccgtaaagtctgtcgccaacagccggtggcggctgtggacccgtcagagtgtttgtcactttcagggctcttggaagccaacggggccttttaggattaaagagaaaccaggagaacccctttgaccaaggtgtttttccagattgaagagaaagaaatagaacctgctctgaaagataaagctttaattggaaatatctta

SEQ ID NO: 708254 - DNA, 510 bp, Homo sapiens
cccccgaggtttaccactttgggcccccgctggaaccctaatcctctttccggcaattcttgttctatagccctaatcaccatgtgcactgagataatctgttccgaacctcgtagtccccagtcaccacatgggggggaacatttggcgctggaatacacgcattcaattctcaagtgctttcatggcaggtgcacccccattcccgattgttccaatgtatgtcagacgctacaattgcgatcattcgctccactttccttcaagagctcacaagtagtgagtacggcgcaatataaaccatgtctgaccctgatgaacgtccttgataaccctcacatgtgaatctaatacgcgtaaaggtaaaaacattccaatgtggggtctaccccgatacagctttggataccatcgtcctctgggagagcgcgcttttcacatatccctgtgccccccccgggcccctgaaaacatactggttctctttggcccaccccgcattcatgtcag

SEQ ID NO: 708255 - DNA, 879 bp, Homo sapiens
gatttccggtgcaggtggggaaaatggcggtgtctacagtgtactcgagttcgtcgctgatgcttgcctctgtcagggcacagccctattgtctcctttgctcagtgtgacatcattcagacgcttctacagaggtgacagcccaagagattcccaaaaggacttgattgaaatccctttgcctccatgggcaggagagaactgatgaatccatagaaaccaaagtgagcccgcctgctctatgagaaggcagaaaagaggggaaatgttggaaacagtgcagtcttctaagtcttttggctaagagaacatctggagcaccatgacagaaaagcagttgaagctctatgaccgctgattaacggaggcctaagtaaatgactgggatattaaacctactgggccaccagggtgactgggggtaccctggataattgtgatcgactatcttctgagtgttctatgaaggatgtgactggatgaacttggaattttacctttgtgtaaactgacgtaaagcagtctggtcccactaaccgcggttggggccttccactgttactctagctcaacggcttttgacttccactcaacgtacgcctttaccgcttctcggccacgtggactgcgcaatctttctgcctggttagcccttccctactggggaccacaggtttctatcctggcttcagaattcgctggcgaaccgtggcctctctgagtctcaaggctgggttggctgtgctctcgcacttcttcggtctctacggtctcagcgctggcctctttcgccccctgcccccgcccttgcgcgcgctgcgccacccccctgcatctggatcgccgcccattgcggggccaccctttctcgcgggcggc

SEQ ID NO: 708256 - DNA, 100 bp, Homo sapiens
agtgatggtgactagagaaggtatatagtggtggtataactactattcatttcatggaaaggggtgaaagactttgtaaatacatatctatataagtgga

SEQ ID NO: 708257 - DNA, 410 bp, Homo sapiens
  misc_feature (1)..(1): n is a, c, g, or t
  misc_feature (304)..(304): n is a, c, g, or t
nggtcttatacaaacacttgactctccagaactctgcaaggtcttgtcttcaaagcaccagttctatatacagccagcatttcccccagagaaagcaatgttctacaagcccagtacatgatatgtgtcacaacctagacccatgttgctatcgtcagctcgagtgcatagcagagacttagggttatctgaggtaaacaagcaatggaggagagacttacagagaatggcctcatggtcttaactgcttctcggtaccagttccgtcatctattttaaaacccaggtttgaggctgggtgcangcgctcaagcctgtaatcccaacactttgcggggctgagactagaggatcatatgatgccaggagattgagaccagcctgggcaacatagtgagaccccgtctctt

SEQ ID NO: 708258 - DNA, 190 bp, Homo sapiens
caaaaactgtccattcccccccctttgttttgccatttgcaaaagtttggaattgtcaggtctcagcttcgaaaagtcctggttcccctgacaggacccattctttagtgggaattaagccccccaaagtttagtttgtatgtaggtataaagggaattttttaaataaattgaaaagctgtgaccacca

SEQ ID NO: 708259 - DNA, 528 bp, Homo sapiens
  misc_feature (471)..(471): n is a, c, g, or t
gtgctgcccaaaggatgccctcgccctgctgcagccacaatgtccacacctttgatctgaagctggtgtgggtggatcctgggcaggacgggtgcacgtttcacctcctcacgcccgaagaagagttctccttttgtgccaaggactcccagggccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggcaagggaaccctgaaatggccggatgggcggaatcacgtggggaatttctgccagggcctggagcatggcttcggcatccgcctgctgccccaggcctctgaggacaagttcgactgtnacaagtgtcactggcgagaaggcagcatgtgtggctacggcatcctttgtggcagca

SEQ ID NO: 708260 - DNA, 491 bp, Homo sapiens
  misc_feature (485)..(485): n is a, c, g, or t
cagctgatctgcttagcgcaaaaaaaaaaaaaaaaaaaaggccaatattacccccaaagggtgctttgagccacttacagttttttcccccttctgcctctttcttctttctgacccttagttttctgtaaaacagtgagcagcccataactgacttaatttctgaaatgggttaaaagcaattttctgaagcttgccttttaaaaatagattttgtttttttcaatttagttcttgtgggcagaatgtgttttaaaattaattaattagcagcttgcgacccaagtgatggtaaaagctcatattgggtgatctcatgagaagttcttctcgaacccaaattccgaacatttaaaaagggggcgaagaggggagaaatctcacttgtgcaaattattttctgtgcataggttatgagaataggttacttatacccgttaaaagtggtaggaaagattccccccttccccccacctttaagcggnatcagg

SEQ ID NO: 708261 - DNA, 670 bp, Homo sapiens
agagaaggaagaggatgatggccttcggaaatccctggatagattctatgaaatgtttggccatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcataatgtaatgaaagacctgtaactggtgccgggtggtgtgcagggtagtaatggaagtgctgtgccatgaccatcagtgttggtggccacccaaatcccctagggtctttggccaattctgagtgcccaattccaaattaagtgctttgaggttaaaaggctggcacccttgtggaccttggtattggatcccagtcagtcctcttatggataagaccgtcaagggtctggcaggtttttccgcaactcttgtgccaagggccgttttactgtactggggcttaccaagtacaaaaagtcccaagcttacctttggccttaaaggaaaggtaca

SEQ ID NO: 708262 - DNA, 156 bp, Homo sapiens
cggacaggcaccaaatgctgacagatgaaggactttcagataaggagctcatggtatcttctcaggccctaagagaacttaacgcagaaacgcccttttgaagtctgaaaattctttggcagcctctttctaacctcctccttagtcctaccattg

SEQ ID NO: 708263 - DNA, 451 bp, Homo sapiens
ctgcactccagcctgggcgacagagcaagactccgtgtcgagaaaataaaaaacaaaaacaagtaggtgaaaattccttataaatccaggattggttctgaaagaacgggtgtaagattcaggaaggaaacaaaaaattcagaatcctacaaggtttggatgacaattagggccaaaatttaggaggagatgtaggatgcaggaggaacaataaaagtgttttctttatatcagaggaggaaatagtaaaggtcaagtgaaggtctggggtagggaaacattcagactggccattgccatggctgtgcgagtgagactgcccttaagcctgggtcaagacttcctgggccataaaatggggcatccgtgatgctaggtaactgtgggaacaacaatgacagttagagcacgcatgggtgatgttaggcggtaaaacacactacacgcgtta

SEQ ID NO: 708264 - DNA, 212 bp, Homo sapiens
gccgcgctctccaagacggccgtggctccgatcgagcggagtcaggctgttgctgcaggtccagcacgccagcaagcagatcgccgcctactagcagtacaaggtgcatcgtggactgtattgtcctgcatccccgaggtagcagggcgtgctgtccttctgagaggggcaaccttgtgcaacgttcattcgttagcttccccactcaagac

SEQ ID NO: 708265 - DNA, 300 bp, Homo sapiens
tttttttttttgggggaccataattttttatggggcgggtcaggagaagagccgggggtaaggggtcccttccttcccatccctctacccagaagacaccctcaaagggacagcagaagcccaagagccggttgcctcagaggacctggggggcagacaattggtggtagtgatcttctggtccctcgagcaggcggcggtaggtggcaattctcgggctccagccggcgattggattgtccattgagccggtgggtactccttggatctgccgctcacatatcagatccggagaaatat

SEQ ID NO: 708266 - DNA, 175 bp, Homo sapiens
cacaactgactgtcttcgttcggtttgacctcaggacggctggggacgctgagacgacctcagagtttgaggtttccggtctcgatcttgacagacgtgaccggccttgcgaaaacgtcactttggcgctcatggctgcgggcagattgatgcgctgccatccacccgaggacga

SEQ ID NO: 708267 - DNA, 832 bp, Homo sapiens
  misc_feature (160)..(160): n is a, c, g, or t
  misc_feature (205)..(205): n is a, c, g, or t
  misc_feature (358)..(358): n is a, c, g, or t
  misc_feature (365)..(365): n is a, c, g, or t
  misc_feature (367)..(368): n is a, c, g, or t
  misc_feature (373)..(376): n is a, c, g, or t
  misc_feature (383)..(383): n is a, c, g, or t
  misc_feature (385)..(385): n is a, c, g, or t
  misc_feature (391)..(391): n is a, c, g, or t
  misc_feature (398)..(399): n is a, c, g, or t
  misc_feature (403)..(404): n is a, c, g, or t
  misc_feature (408)..(410): n is a, c, g, or t
  misc_feature (418)..(418): n is a, c, g, or t
  misc_feature (427)..(427): n is a, c, g, or t
  misc_feature (429)..(429): n is a, c, g, or t
  misc_feature (436)..(436): n is a, c, g, or t
  misc_feature (441)..(441): n is a, c, g, or t
  misc_feature (443)..(444): n is a, c, g, or t
  misc_feature (446)..(448): n is a, c, g, or t
  misc_feature (451)..(455): n is a, c, g, or t
  misc_feature (457)..(459): n is a, c, g, or t
  misc_feature (461)..(463): n is a, c, g, or t
  misc_feature (466)..(466): n is a, c, g, or t
  misc_feature (468)..(470): n is a, c, g, or t
  misc_feature (472)..(475): n is a, c, g, or t
  misc_feature (480)..(481): n is a, c, g, or t
  misc_feature (483)..(483): n is a, c, g, or t
  misc_feature (485)..(485): n is a, c, g, or t
  misc_feature (487)..(488): n is a, c, g, or t
  misc_feature (490)..(491): n is a, c, g, or t
  misc_feature (494)..(494): n is a, c, g, or t
  misc_feature (496)..(497): n is a, c, g, or t
  misc_feature (499)..(499): n is a, c, g, or t
  misc_feature (502)..(502): n is a, c, g, or t
  misc_feature (506)..(512): n is a, c, g, or t
  misc_feature (514)..(514): n is a, c, g, or t
  misc_feature (516)..(521): n is a, c, g, or t
  misc_feature (523)..(524): n is a, c, g, or t
  misc_feature (526)..(526): n is a, c, g, or t
  misc_feature (528)..(528): n is a, c, g, or t
  misc_feature (530)..(530): n is a, c, g, or t
  misc_feature (532)..(535): n is a, c, g, or t
  misc_feature (537)..(538): n is a, c, g, or t
  misc_feature (540)..(542): n is a, c, g, or t
  misc_feature (544)..(546): n is a, c, g, or t
  misc_feature (550)..(550): n is a, c, g, or t
  misc_feature (554)..(559): n is a, c, g, or t
  misc_feature (562)..(563): n is a, c, g, or t
  misc_feature (565)..(566): n is a, c, g, or t
  misc_feature (568)..(572): n is a, c, g, or t
  misc_feature (574)..(576): n is a, c, g, or t
  misc_feature (578)..(578): n is a, c, g, or t
  misc_feature (580)..(581): n is a, c, g, or t
  misc_feature (583)..(584): n is a, c, g, or t
  misc_feature (586)..(589): n is a, c, g, or t
  misc_feature (592)..(593): n is a, c, g, or t
  misc_feature (595)..(599): n is a, c, g, or t
  misc_feature (603)..(603): n is a, c, g, or t
  misc_feature (606)..(607): n is a, c, g, or t
  misc_feature (609)..(611): n is a, c, g, or t
  misc_feature (613)..(614): n is a, c, g, or t
  misc_feature (616)..(616): n is a, c, g, or t
  misc_feature (620)..(620): n is a, c, g, or t
  misc_feature (622)..(622): n is a, c, g, or t
  misc_feature (625)..(626): n is a, c, g, or t
  misc_feature (629)..(629): n is a, c, g, or t
  misc_feature (631)..(632): n is a, c, g, or t
  misc_feature (634)..(636): n is a, c, g, or t
  misc_feature (665)..(665): n is a, c, g, or t
  misc_feature (740)..(740): n is a, c, g, or t
  misc_feature (749)..(749): n is a, c, g, or t
  misc_feature (753)..(753): n is a, c, g, or t
  misc_feature (763)..(763): n is a, c, g, or t
  misc_feature (810)..(810): n is a, c, g, or t
cgatggcggcacggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctngagccggaccccggcacgcccgggagtgagcggacagaagccttntactacacagatgacacagccatggccagggccctggtgcagtccctgctagccaaggaggcctttgacgaggtggacatggctcacagatttgctcaggagtacaagaaagagggtgagagggggtatggtggtggagtagtgagtgtgttnaagaagntnntgaannnnaaatgtngngatgtntttgagnntggnngggnnnagtttaangggaaaggntnctatggnaatgnanntnnnatnnnnntnnntnnnatntnnntnnnntatannantntnnannatntnnanaantttnnnnnnntntnnnnnnanntnananannnntnntnnntnnnttanaatnnnnnnatnntnnannnnntnnntntnnanntnnnnttnnannnnnagtnttnnannnannantttntnaannaantnntnnnggagatggaggatgtggagggtgatgggnagtgggtgttggatgggagggagttggggatggaggagggtggatagtggaggggggtgaagaagattggagagnttgtagagnaggnatgggtgagnagggaggaagtggtgtgtgaggtagggaatgggattggtgggttttnagtgggtaggcagggagatgta

SEQ ID NO: 708268 - DNA, 313 bp, Homo sapiens
acaccaattcagtgcagccagcagtggtcagggaagttaacccttaagcaggacttgtaaagcaaataagattggcagaccaagcgggttttttcacgaggggaggagttccagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctc

SEQ ID NO: 708269 - DNA, 117 bp, Homo sapiens
ccagctggcaggcgcgcgtaccgtattgaaccccattcgtaatggggcatcggcaaattgcacattcattcccccatgcagacgatgcattcccagtaagtagcgggtcataagctt

SEQ ID NO: 708270 - DNA, 432 bp, Homo sapiens
gacctctcagcagggcagagcttcttggagcaaccctcccgcactggccagtgagctcacacctgctcctcagcacccagctcagtgtctggtgggcatgcaccaaacgtcctctgaatgagttagcaggaagttagttctccaccatcaggccccccaagtcctccccggatcataagagctgcagaccccagccccctgccccaggcccaggcgtgaggtcctgtgtgtagctcctggcacctgtgtgcagcctgtgtggtgatgggcaggagcctgtgccccagacacagcccagcagagcccatacccagggctgccctcgggcctcacttgcccggcctgtgggcccctgcccagtatcacctcaggggttgcaggctcctgtccactccatgctggtccctgaggcccagctaccccaccccatgc

SEQ ID NO: 708271 - DNA, 848 bp, Homo sapiens
  misc_feature (554)..(554): n is a, c, g, or t
  misc_feature (711)..(711): n is a, c, g, or t
  misc_feature (715)..(715): n is a, c, g, or t
  misc_feature (723)..(723): n is a, c, g, or t
ggctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaaggggccagaagatcgtgtccctgccgcgatctgcaagggcgaccactggaccacccgctgnccctacaaggatacgctggggcccatgcagaaggagctggccgaggcagctgggcctgtctactggcgagaaggagaagctggcgggagagctagagccggtgcaggccacgcgacacgacagggagtatgtgccgcgagcctggcgacgggccagncgcnggggggtncatggggccaccgggagcggaaaaggcccccggggcccattttgaggcggggaaccaccgggggctccggctggcccccggaaccggggggaaaagggccggggtccacccccggagagggccgg

SEQ ID NO: 708272 - DNA, 479 bp, Homo sapiens
  misc_feature (132)..(132): n is a, c, g, or t
  misc_feature (144)..(144): n is a, c, g, or t
  misc_feature (166)..(166): n is a, c, g, or t
  misc_feature (324)..(324): n is a, c, g, or t
cacccctcaggggcgctgccaggacatgggcggccttcacgtggacagtggttttgtgctttccaccagcacaaggtccacggcggcggctgctgcgggctccccagcagatggcagcaaagcgcctaccanccccagcgtctngtcccggccacctgtctcactnctgctttctgactaaagtggggacagcaggctgtgtcccatctgggaggcgccacctcaccccctggaggggaaaccggcccagtaggcaggggcgggggatggggggtgctagcgtcatctcaacaacccatgccccgacacaagatgctggccccnaaactcctctccccagagatttctcatccccaggacggcggttgcaggcagaagggtttggaaacattaaacgtgaattattccaattggtaaaaaacaaaacaaaacgaaacaactagatcctggttactttataatatataataatcaaagga

SEQ ID NO: 708273 - DNA, 322 bp, Homo sapiens
tcgattggcgggcacttcaaccttactgcttctctcttcttcttcttcttcttcttcttcttcttcttcttcttcttctccttctccttctccttctccttctccttctccttcttttctttcgacagggtctcactgctgtcatccaggctaaagtgcagtggcaccatcacagctcactgccgtctttatctcccgggcaccaatgaccttcctagctcaggcccctcaagtagctaggactacaggtgtgcaacaacatgccctgataattttggtgatctttgtagagatgaggtctcactaagttgcccgacaatcg

SEQ ID NO: 708274 - DNA, 240 bp, Homo sapiens
  misc_feature (211)..(211): n is a, c, g, or t
  misc_feature (216)..(216): n is a, c, g, or t
  misc_feature (233)..(233): n is a, c, g, or t
aacagccatggcaaacacgaacagccacggcaaacacaggccacagcaaacacgagccacggcaaacacgggccacggcaaacacgaacagccacagcaaacacgggccacggcaaacacgggccatggcaaacacgaacagccatgcctgaacgggcccggttgcatctgattgcggaggctaagcagggttgggcctggttagtacttngatgngagaccaactgggtgtntcaggtg

SEQ ID NO: 708275 - DNA, 101 bp, Homo sapiens
ttatcgaggacctggaagctacttatcttgtcggtgacgtcggtgccgtcggtattaaaagccctagtcaggccgttacatgtcaacgcgaaggacgggcg

SEQ ID NO: 708276 - DNA, 87 bp, Homo sapiens
ctagaagattcagcaaagtacttttgtgctcttggggaactagtttatgtctgttcctactggagggatacgaccgataaactcact

SEQ ID NO: 708277 - DNA, 135 bp, Homo sapiens
ttgagacctggaaaacatcatcgccactgtataacaggctgctgagttctcagagctgcaggctgtttccgggaggagctcatgtactccttcaccaggtgcaggtgcaaggcctccatgagctcctcccggaaa

SEQ ID NO: 708278 - DNA, 172 bp, Homo sapiens
  misc_feature (41)..(41): n is a, c, g, or t
gcctctctctgggcaagttcatggcttctgtgagccctttnactgacctccagacactgttaggctggagcctcggtagccgttcctcctgcccactggaccttccaacaggccctcctcccctccttgaaccggcccttcctggcctttgaatagagtctaagcgaacgac

SEQ ID NO: 708279 - DNA, 474 bp, Homo sapiens
  misc_feature (1)..(1): n is a, c, g, or t
  misc_feature (411)..(411): n is a, c, g, or t
  misc_feature (439)..(439): n is a, c, g, or t
  misc_feature (444)..(444): n is a, c, g, or t
  misc_feature (464)..(464): n is a, c, g, or t
natagctaaaggaaatacccacacttaaataagttaacatcacagacttaattcatttttcttgacattttaaggagaattagttcatttagactagtgtttattgaacatacttttcatgatatctatattaaggaaagcgatggttgggggagataaagaatagtagaattttagaattggaatgaacatcattttaaaatgaggaaactgaaagccaaagagtttactagaaatttcaagttacaattagaacccaagttttatagtgcttattttttactttcctaatttccttctaatgtattttacctagatttggctagaattagtagataccggttgtttattatttcaggcaattggactatctaaatagaactctatcctgtaggtttacctttgtggganttttggaagtaataatagacatatagcnaaagncaaccgactatttgtaatgnttaatttatt

SEQ ID NO: 708280 - DNA, 326 bp, Homo sapiens
cgggcagatcacctgaggtcaggaggttgagaccagcctgaccaacatggtgaaaccccatctctactaaaaatgcaaaaattagaaaggtgtggtggtacgcacctgtaatcccacctactaaaggaggccgaggcaggagaattgcttgaacctgggagtcggaggttgcagtgagccaagattgcgccactgcactccagcctgggtgacagaatgagactctgtctcaaaaaaacaaaaacaacaaaaaacaaaagcctgtgcttcaatctgactcttcaggctatggttctccccgtactgtcactgggtcttaggacctt

SEQ ID NO: 708281 - DNA, 222 bp, Homo sapiens
  misc_feature (217)..(217): n is a, c, g, or t
ttttatttttttttaagtttaaaagaaggaattaaacccaaattttgggattgtttccggggcggggtttttaaatttttttcccccagttttccccaagaaaatgtttcaaaaactgaatttgtttaaccattgaaagcctttgttaaaggcccaattaatccccttggttggtctttgaaaacaaacttttttaaaaaaaaaataaccctttttnaccca

SEQ ID NO: 708282 - DNA, 195 bp, Homo sapiens
attcagttttttaattgacttttttctggctgtttcactttggacatatctccacactcagcctcctttttcttgtgctcaattggagagaattgaaatagatcatctttcataccctttcaaatataatatttcaaaactctgatattcacttgtacaagcgtccttcaggctatgtaatgattctttcttgca

SEQ ID NO: 708283 - DNA, 528 bp, Homo sapiens
  misc_feature (465)..(465): n is a, c, g, or t
aattcagtgtgtcttccatttctctacggcagggaccatattctgtctcccgcttggactcggaggagaagttctgggtatctgtgctctgagactcgtagtcaactttgtagcgctggctgtctttagcatgccctttcttgatgatgattatctttgaatggagggcccccccctcgggcccccacaccgcgcgcgtccctggacacgccccgcccctctcccccactgccgccgctccggtcttcctccgactcactagcatttcctggagctggcggcgctggcagcaggtaggcgcgcaggcggctgacggcactagcgttgacgcagagcccgcggccgtccagcagcgcctgcagcggtcgcgcctcgtcgggcgacggctggcagcgaaggccggagccacagcgctcggtgtagatgccgcacggctggccctcgctcagtgcgcacgtcaggcancctaaacatccgtacaagattcgtcacaaccgcacgcccccccccactcttccgcaccaccct

SEQ ID NO: 708284 - DNA, 117 bp, Homo sapiens
aattcgcggccgcgtcgacgtgcttaggcaaattaagtatgatcaagtcttctttattgtgtgctgtaaaaatggagtggcggcaagaatgtaatacagggcatctgactgctgagc

SEQ ID NO: 708285 - DNA, 142 bp, Homo sapiens
ccttgctaggtcgatctctacacggatccccccctcgaaacccatgtcacggaaccagtgttttgattgtaagctaggactgtaggagcatagccagtcaagtcagctatcttcgatggtgcaagcatatgatcacagagct

SEQ ID NO: 708286 - DNA, 332 bp, Homo sapiens
  misc_feature (133)..(133): n is a, c, g, or t
gactgagtctcaccctgttgcccaggctagagtgccatgtcgtgatctgggctcactgcaacctccacctcccaagttcaagcaattctcctgccccagcctcccgagtagctgggattacaggcgcacgcanccacacccggccaatttttgtatcttttgatagagacagggtttcaccatattggccaggctggtctcaaactcctgagctcaagtgctccgcccaccacggcctcccaaagtgctgagattacgggaaaccacacccaggcctgatttattttttggaaaagtagtttgattatggaggttccattaggttaaggaag

SEQ ID NO: 708287 - DNA, 1783 bp, Homo sapiens
  misc_feature (150)..(150): n is a, c, g, or t
  misc_feature (398)..(398): n is a, c, g, or t
  misc_feature (836)..(836): n is a, c, g, or t
tggggcataaacaacaaattttttgggggcccccagcatcaagtttctctttctcgcgtggcaacagttctgggtccccgcggaagaacgttccagtccgcgggcgggacagacaagtgagaaccacatttgtggcggcccagcgagggngacatctcgtggcggagtgggtgggagggctatgccagatggtccgtgggtggtgtggccaacctctcacaaagagggatgtgcctccaagaggattctcgatgtggcacacacacccgcgtatactctcgtgtggcccagaagaagttctcctctcttgtgtgccttataatattgtgtgttgggtataccgccgcgtgaccacagccttctacagaagagtgtggtttgtggctcaacattcgtgngcgcaacactctctcacagagacacaccacaacacgcacaaaacacacacgagggctctctgtgtgtgtgcgctagtgagagagagagaaatcacccctcttctctttgtgagagcgcccgagagaggggggacaacgctttctcacacaggggggggtctctatatctggtgggagctcccatcagcaggggggtagagggtaggggacaagaaaaaagacgggcgcggtgcgcaataataaagatcatcactcctgtgaagagtagcccccggagcggcgcaccaaagcgtgtgtcgcgcacgagaggggtctctcctcacaagaggggtgttattctcatcacttcatcacaggaagggggcgaggaagacacacacacgagatagtcgtgggtgtcaccccatagaaagcttctcttcctaaaagatatcccgngcgagaagagcgggaccgcgatgatctcctaagagaagaagataaatccccctcgtcaccgagaggggggtgggcccccccaagaaggtcttataaagcgggctgataaacccgcgaggtgtttatcctcgtgttgacaaccacagaggggggtggcgcccccctaaataagaggggggacggtcgcgacaataataaaaaaaggaccaaagaggccaatctgggtggcccggatgtctgttttttaacacaaagcgtgttcggtgcacgcctgtggggacaacaacgtggttgtttaacgctgcgaggaacaccctttgtgtgtgggcagaggggaaaccccatttatattatcgtgggggggtgtgttgaaccattaatgtcttggggaccaacaattaacccatacagggaagagattttaaaaaggaggctcctaacgagggggaaaatttcatacaacacatttttcacaaggcggggcactacacacgcgtggcggtgttcaacactcaactacgacgggcgcaacatatatgaccagtcggcggcgctactgaggaaaacaacctggggcgcctccaccggagacgatagtgattctttcttgcaatacatttgtacagggagcgaccacgagtatcatactacatcatacatcagaatcccggcgacccgaaggatcagacggcaggacagccagcagccagggccagacacaaccgagagagtgagaggagacaggaacgacgagcgacggcgaggcacggaggcaagatgaacgccagacgcaacgaacaacacacaccaccacgagaacaacagaacgacaccccacgacccgcagacttcacgacgcccggacggcgcaagcgagtgacagaccgcagacgaagacaacaaccgacaggacagcgaaagatgcgacgaccgacggaacacggagt

SEQ ID NO: 708288 - DNA, 825 bp, Homo sapiens
  misc_feature (15)..(15): n is a, c, g, or t
  misc_feature (193)..(193): n is a, c, g, or t
  misc_feature (222)..(222): n is a, c, g, or t
  misc_feature (229)..(229): n is a, c, g, or t
  misc_feature (250)..(250): n is a, c, g, or t
  misc_feature (269)..(269): n is a, c, g, or t
  misc_feature (285)..(285): n is a, c, g, or t
  misc_feature (343)..(343): n is a, c, g, or t
  misc_feature (353)..(353): n is a, c, g, or t
  misc_feature (366)..(366): n is a, c, g, or t
  misc_feature (453)..(453): n is a, c, g, or t
  misc_feature (463)..(463): n is a, c, g, or t
  misc_feature (553)..(553): n is a, c, g, or t
  misc_feature (578)..(578): n is a, c, g, or t
  misc_feature (612)..(612): n is a, c, g, or t
  misc_feature (794)..(794): n is a, c, g, or t
ggctcagccccggcngcagcgcgcgccccgctgccagcccattttccggacgccacccgcgggcactgccgacgcccccggggctgccgaggggaggccgggggggcgcacggacgcgcggtcccgcgcactgagccccgcggcgccccgggaacttggcggcgacccgagcccggcgagccggggcgcgccntccccgccgcgcgccgtcctgcatgccgngccccanctccgggcgccggccggagcncccccccgccgcccccganccccccgcgccccgcnccgcgccgcctacctttccatgcaccgctttattggggtcaacagcaccgccgccgcnttcccctgcnaccccaatttctncttcacttgtctcaattcaaacactcttttttccataacatggagatcacggagctggagtttgttcaaatcatcatcatcgtggtngtgatgatgntgatggtggtggtgatcacgtgccttctgagccactacaagctgtctgcacggtccttcatcagccggcacagccaggggcggaggaganaatatgctctttcctcaaaaagatnccttttgccctcggagagcacagtgtcaggcaanggaatcccagagccgcaggtctacgccccgcctcggcccaccgaccgcctggccgtgccgcccttcgcccagcgggagcgcttccaccgcttccagcccacctatccgtacctgcagcacgagatcgacctgccgcccaccatctcgctgtcagacggggaggagccccaccctaccagggnccctgcaccctccagcttcgggacccgagca

SEQ ID NO: 708289 - DNA, 455 bp, Homo sapiens
aatcatctgatcctttggcaaatgtggaatgtagcattcacacaaaatgactgtaacagcagtctgaaggcactgaagcaggaccagaagggagtctctcaggagaactgacttctgcagctgggtctcctactattactcattcagcataacacataagaacaggaacagacaaagcaggacacacagactcgaatgcctcaccagcagactagtcaatcatgggccagattcataagcaaaatgagctgccagcaaatagcaagccacatgttatttcaaatagacaatgttttaattttaaacagcaatacaaatcaagggtccaaactatttaattcaatcacaagcgcatagtgacgaatgcatgtaatcaagggacttaatctctgtgccattcttaaaggcttagataagcattaaataaacaaatcaaatgtaagcagggaccaggt

SEQ ID NO: 708290 - DNA, 777 bp, Homo sapiens
  misc_feature (14)..(14): n is a, c, g, or t
  misc_feature (625)..(625): n is a, c, g, or t
gccattatggccgngtgcagtggctcacacctgtgatcctagcattttgggaggccgattcagaccaatcacttgagctcatgagttcaagaccagtttgggcaacatggtgaaaccctgtctctacaaaacacacacacacacacacacacacacacacacacacacacaaagcagggtttggtggcaagtgcctgtagtcccagctactggggagactgaggtgggagaatcacttgagcctgggaggcagaggttgcagtgagccgagatggcaccactgcactccagcctgagcaacagagcaagactctgcctccaaaaataaaaatttgatttcttaagtaaatttcaaatatagaatgtatatgctagcgataacacaattaacactgtttatgcaagtctgcaataggtagatgtgaagttgataggtgcaataagcataggcaaacacataggaacatttgacctggttttttggtgattttacaacattgaataattgcgaagctcttacatctcttaattcgagcaactagatgcctgtatttatctccttatattaacaaactattataattatctttccacatatcaaactccaactgctcttctccatttntctttatacttaggcgagaatcaggatttgatcgatcttccatttttgcgactactatgatcagcctcgcctccgcttcccttctgattaggatctggagggctttcatacggaatgtaccggtttccaactagaatcccgggtgcttcccg

SEQ ID NO: 708291 - DNA, 448 bp, Homo sapiens
ggtgggtcatatggtaggtgtattagtccattcttgcactgctataaagaaataccaaagactagataatttataaagaaaagaggtttaattggctcacagttctgcaggttttataggaagcatgattttggcacctgctcagcttctgaagaggcctcaggaaacttaaaatcatggcagaaggcgaagggggagccagcacttcacatggccagagcaggaggaagagagagacgggggaggtgccgcacacttttaaacgtccagatctcaggaacaccaccaggagagcagcactagagggatggtgctaaaccattagaaaccaccctcatgattcagtcacctcccaccaggctgcagcattggggcttacatttcaacatgagatttgggtggagaaacagatttaaaccatgtcagtaggtgcatgtttacctttgta

SEQ ID NO: 708292 - DNA, 121 bp, Homo sapiens
  misc_feature (98)..(98): n is a, c, g, or t
  misc_feature (112)..(112): n is a, c, g, or t
gtgttaccaatctgaagtcgggaagtggccatagattgaccgcatttccatgacctaacttgtatttcacccccttttccttccctactggttcttgncccaccccaagatnagttgaaac

SEQ ID NO: 708293 - DNA, 363 bp, Homo sapiens
atttttatttggttaaaggtcgggggctttccaccccctcttctaatctttaaagggattggttggcaatttggggggaagactttttttatggggactttttctttgaggttttagggggcaatttgcctttttaatgaacatgtgaagttatacggggggtaggcaccggctttcccctacgggggttttactttgggttagggccaaaacagcccccgggaggtttacttttccccctttgggtggccccttttgtttcccccaggtcccatttttgttttaagggcctttggttttaccggttccctttttccgggggtttttactggggtttttttttaaaaaggcctaaaatcctta

SEQ ID NO: 708294 - DNA, 116 bp, Homo sapiens
gggagtggagagagaacgggtgtaaatacaatggggcaggtgacatttgatacctttcccaagagtagagataggatttcataaatggacctgtgtgggccagacgggttggacat

SEQ ID NO: 708295 - DNA, 346 bp, Homo sapiens
catatggtgttacagatcgtgaaatgtagatgaattctctaaaaatactagatctaaagataggaataatggactagaacacagcggctcacaggctgtagtcctaaacactttgggaggccgagggcggatcacgaggtcaggagtttgagacctgcctggccaatatggctgaaaccccgtctctactaaaaatacaaaaatagccaggcatggtggtacatgcccatagtcccagctactcaggaggcagaggatagcagaattgcttaaactcaggaggcagaggttgcagtgagctgagatcccatcacgcacttcagcctgcacacacataatggaggga

SEQ ID NO: 708296 - DNA, 529 bp, Homo sapiens
  misc_feature (25)..(25): n is a, c, g, or t
  misc_feature (45)..(46): n is a, c, g, or t
  misc_feature (58)..(58): n is a, c, g, or t
  misc_feature (73)..(74): n is a, c, g, or t
  misc_feature (97)..(97): n is a, c, g, or t
  misc_feature (138)..(138): n is a, c, g, or t
  misc_feature (229)..(229): n is a, c, g, or t
cctgaataacggaatccacagcccnaaacaccagagcaagctctnntgaccaagtganatctgctcccatcgnngatgtggatctcccagtcctgtntgccctcaggaagtcctcctttgcttaagagagaccctgtnaactccgtcaacactccagaaaagccacactgcctcaaaaaagactgactaacaatgccagtgctcaggaaacattccatgtcagtgacanggcaaacactgcccagccacggagagtacaactccaccaggataaagacaacaacaagaaagatgaagaagctgagaaaccacccccagttaaaccaacaggagaactcacctaaagcagtcaacaatgaaacagatctctgcagttttgacagacctggacttcaaaagagaaccagtgaagatactgaaggaattaagagaagatatgaacagtaattcagacaccctcagaaaggaactagaacatataaggcggagcccagaaaaactagaccattcatttgcgtacttaggggtt

SEQ ID NO: 708297 - DNA, 256 bp, Homo sapiens
ctcggtaccgtatccataccacgtacgtctctaccattatccggtttagtcatccaacaagaagaaacaaatctgaaattccagcagtaagaaatgaacaaaatgagttcccatcgtggctcagcggttaacgagcccaactagtatccacgaggatgcgggttcgattcctggactcactcagtgggttaaggatgtgatgttgctgtcagctacggtataggtcagcagctacagcttctattcaacccccagc

SEQ ID NO: 708298 - DNA, 1631 bp, Homo sapiens
cgacgtgttactgactccgtgtcctgtgtgtgttgactgatcaaccacctcgtgctgttagacatcactcgcctccaacggttgcctcttttttctcacgggtgacggacaatattgatcaaccctcttcgtggggggtccctcccttccctcccccccctcttgttggttgtggcccccgcatatttcacggtgaactattatatgtcgtgtttacttcctggctcgtcgctggaccacactgggtccaagttcgttcgctggagtcttgtcgtgtggagccgccggccccccctcatgtgcgggtccgcctgcctgcccttcgcctccccctctcatagtggcggcttccacgggagggggccgccccaactgactctaatggaccacacgtcctcgtgttgctttgcttccacccgggcgggtgggttctctctgtaaccacaacgcggtttgctgtgtctcttggagaataacgtcctttttttagcacccacgtgtgttgacacccagccgttgttgtggcgaaaccaacgtgtcgataaataaagtttatatatatggccgggtgggcccaccccgttgtacacccaaaatgtggttgttgggggacgccataatatacctggtgttgaaaccccccccccacggccctcctatacctcccgaacgcccgtttgggaggaatatttcgcggaacaacaagtgtccccacgagggcggcccgtgtatggcccctccccccaacaggcgacccaccccgaggggcccccctgggggccccccggccccacaccgggcctttcgtccccactcattttctcgctcatccagggcggaacagagttttggtagaacccacgcggtggacaaataggagaccccgcggggggggccttaacaattgttgtcccttcgtccctcggccacgggacacactcttgttctcggtagatctatgtggagagaaagaacggggagaaataaattgccgccttgccaccgtgttcacggccacaatgcccgcgagatattttttcgttgttttgaaccacaggaattgttccgtgttctgtcccctatggtggtgttgaacctcaccaccccgtttggtggcctgctccgttttcacagagagcggccccaccccctctcacgagatcacagaatggggaaacacacaccacacccccgctggaataaatggtgtgtcacattgggtcacgagattttctggtggcttgagattcttataagaacatggagaatctgttgggtaattctttccctctttctgttcttataatggtaatccgttaaacactgttttgccctcgtgtcacgcgtgcgtgttaccacaaactatggtgccgcttgagcgggcacccgcgtggtcccacagtcttttagagaccctctgttatgccacgagccgagggtcgtcctggtcacccgtttcacccactcacatcgctttgaatgttcccctcgtctttccctcttctgctttcaagaggccaaagggtaaatttaaggagccaaagatgaagtccctgtaaactaatctgtccttgtttttaccttccttttctttttccagtgccagaaagtttaaagtaagtataaagcca

SEQ ID NO: 708299 - DNA, 354 bp, Homo sapiens
gcggccgcctactactactaaattcgcggccgcgtcgacgggcaaacggtctctacaaggagagctacaaaacactgttgaacaaaatcatagattacactaacaaatgaaaaaacagttcatgcttatggattaaaacaatcaatatcattaaaatggctagactgcccaaagctatctacagattcaatgctattcctatcaaactaccaatgtcatttttcacagaataaggaaaaactattctaaaattcgtttgaaaccaaagaagagcccaagtagccaaagcaatacagaagccagaaataaagccacacacctatagccatctgatcttcaacaaaggtcgacgcg

SEQ ID NO: 708300 - DNA, 237 bp, Homo sapiens
tcggacgttcattcctgcagctccatcgggatgtctgatccaacatctagctcgtacaccctattgttgatatggactctagtaataggattgcgctgttatccctagggtgaagggtgtcccgttagatcaagttattgagatcaattagagtatagtagttcgctttgacttggtgaagtcttagcatgtactgctcggaggttgggttctgctccgagcagcagggaacagaca

SEQ ID NO: 708301 - DNA, 123 bp, Homo sapiens
ctcgcacgagaccctcatcaatagatagagacgtacagaaatattctaaccacatctacaaaatgctctgtatcaagcggcggcttctaaaccaaagtggtgtttggatgtagcgtgacatat

SEQ ID NO: 708302 - DNA, 826 bp, Homo sapiens
  misc_feature (112)..(112): n is a, c, g, or t
  misc_feature (149)..(149): n is a, c, g, or t
  misc_feature (171)..(171): n is a, c, g, or t
  misc_feature (212)..(212): n is a, c, g, or t
  misc_feature (215)..(215): n is a, c, g, or t
  misc_feature (233)..(233): n is a, c, g, or t
  misc_feature (240)..(240): n is a, c, g, or t
  misc_feature (259)..(259): n is a, c, g, or t
  misc_feature (317)..(317): n is a, c, g, or t
  misc_feature (337)..(337): n is a, c, g, or t
  misc_feature (355)..(355): n is a, c, g, or t
  misc_feature (410)..(410): n is a, c, g, or t
  misc_feature (412)..(412): n is a, c, g, or t
ggctcgccgcgccgtgtcgccgcacctcctctgatctacgaaagtcatgtacccaacaccgggaggctggcaggatgtacagtttttatcacaggtgcaagccgtgcattgnaaagctattgcattgaaagcagcaaaggatggagcanatattgttattgctgcaaagancgcccagccacatccaaaattctaggcacaatctatactgntgntgaagaaatgaagcagtntggaggnaaggccttgccatgtatgntgatgtgagagatgaccagcagatcagtgctgcagtggagaaagccatcaagaaattnggaggaatggatatctggtnaataatgccagtgccatntagtttgtgaccaatacatttgacacacctaccaagagatgggatctgatgatgnancgtgaacaccagaggcacctaccttgcatctaaaagcatgtatccttatttgacaacaagcacgcaaagttgctcatatcctcaatatcagtccaccactgaacctaaatccagttggttcaaacaagcactgtgcttataccaattgctaaaggtaattgggattgtccaatggtaattgtgccttgcgactggcccgacacacattcaacggttcacctcgcccgtcaaggcattatgggcctaaaacaagcctacacaatggatgcactggatatgctgggaggacctggatctgcagcccgtgtcacaaagttgcttcatgcccctgcggctattcattccaaagcaaaatttcctggcactctgactgcccaatctcacacacgattaacttgcttgctaccacacctg

SEQ ID NO: 708303 - DNA, 890 bp, Homo sapiens
ctgcaagggaggatggagccttacttggacatgccatttcctgatctctgtagcacctcttattgatatttcatactcaacccttgattccatctagccttttttctttccactggttcctgctaatgcaagccttgacttttcattcctattatgcattcttcaatagtgggctgtgtcatggattgagagcgcctggcggagccctggatacatggcagtttttcaataagcagttgtcggcgggcagccctgagagtgtgaattatgagtactagcaaaaggcaaggttcatttgcataattataagctgaagaacggcagaggaaatgaggtactgaactgctttggaattgttctggctgctccagtatagttcacattaacaaattttatcgttaaaatttaaatattccaaaatgtaaatattccaagtggaaatttctggaagagaagtgatatgtgtcgtgtggaaggggttacaataacatcccaaaaaccccagccagtctgcaaaatcccagcaaatgcaatttaaagagtgctaggaaaaacgttctaaggtacatcccagtttggattaaaccatgtctgataccattatactgagggtcttaactttagaattaagaaagtcctgtgggcttaaccttttagcgggtttgttgaaactcccagggcgttcgccatacattccctatcctcaacactttgttctgggcaccctgggtactccaacagggcgttacaccggttgtccaactcctgaccgcggggttctgagacaatacgagggaaggagtgcggtcgctcccaaaaccgtgtattactgggggccaaaataaataacccagacaaaagtacctgggcgaacataacgaccacacctg

SEQ ID NO: 708304 - DNA, 86 bp, Homo sapiens
gccttcctcggctggatttaagacggcgctttgtcatgggacctgtgcggttgggaatatgcttttcctttttctgtcgtgccgtg

SEQ ID NO: 708305 - DNA, 238 bp, Homo sapiens
gccccgtatatggcgtttcccgtataactacagtaagcgttctgactcttacctccctctctcctacgtccgtgctcgcatctgctacagtggagggcggagcaggagacaggttgaacagtctatcctcccttaggagggaactactcccaccctgtgagcctccgtagacctaagcatcttctcgttgcacctagcatcgtgtctcctctatcttaagggcaagcggccgcaaggt

SEQ ID NO: 708306 - DNA, 903 bp, Homo sapiens
gaaaaaaagccaccctagcggccggggccggagctaggagccgccgctagccgccgccgccgcggccgtactaggagctacccccgcgcggacgatagcctagccgtagcccgcctaggggctacggggcggtagaggcccggggctgcggggtaagctaatatgctgacgtgcaagctgctgtgccctgctggctgcctgcctagacagtgtagtagggccccgtgcgtgcggctgtgctgtaggagctagcatagtaacgccacagggggtggcacagggtatacggcctgtagccctaccgacagcgcaggcccgcgagaagttaggcgctagtacgtatatatagagtaacctagctagcacatacgtgtagcccatgaagtacagcccgagacctatacctagtactagagataccgatagggagaacgaacatacacgctagggggagccccctaggggtatacctagcactacctaggtaggtagcgtactatactagggcacctagtaactagcgacggctgcctagacaggaacgcgaggcctagcgagcactaccggcgagggcccaaggccctataccaggactaataagtagctagcagtccgtcccccagatccccgtaaatagggggagtataggccccaggtagacacaataggccgccacggctacccataggcgtgcttgatctaaactataccacggcgggccccccacacaccatacatcccaccacctacatccaccacatcatcctccatacctccaactaccctctgcctcccacacaccaccaccaccctcactactacctcatccccccctccactcactcacaccacccctcacccacccactcaatctcccctcacccaaacctaccacaccaccta

SEQ ID NO: 708307 - DNA, 533 bp, Homo sapiens
gggaaaaggcgggaaaaggccctaaattttttgagtttgggggagccgcccatggttataagggttccgggaaggcccaggggggttaaagcttttccaaccatccccccttggggtggttttcgggttgggaaattaaaccaaccggttgggggggggttttcaaaaccgggggcaaaaagggtggtgggggtgggcagggtccccagtttgccccgaaaggtccagagggttaaaggaatttttcccctaaacccgccccccccctttttaacaggggggggaggacgggttccaaaccgtttggttccattggcccctttaggtttggggggaaaagctgggttattaaaaccaaggcttggtaacccctcccaagggaaggggaatgttttgggggcccccttgggttttttttttgggggggggcggttttaggtttttggtttttaaaaccgggcttttttaggggaaccacttggcccaaaatttggccccgaatttttgggcccccttaaaaaggttaatgggga

SEQ ID NO: 708308 - DNA, 522 bp, Homo sapiens
ggaagacaggaaagactcagagagacgggagagagaagaagagtgggtttgaagggcggatctcagtccctggctgctttggcatttggggaactggtgactccctgtggggaggagagtgaaagctggaatgtcctggagggacagggtcccagtaaggaggggacagaggagctgagagagtgggggcatgtggcgttggtgcaggggtccctcgttatggcctcctgggggaatgggggctgcagctctgtctgagctgccccctcgtagcgctgtgtactctggtgctgcaactgagaggtgcagcagcatcacatcggaccatgacactgaccccgagagaacttggtggagctacaagggataaatcttccaagggaaaactttcgatgccagggcctcctttctggggcctggtgaatgcaggcgtggacgtctgtgtgctgtggggaagcggcagcagccccgctggattgtggagctgacgcagggttcctttatgaccccgtttctgccccc

SEQ ID NO: 708309 - DNA, 103 bp, Homo sapiens
cctcaccacacctgtcttctaacctccctgttcttatcaattcgaagcagtcgatacccccgagttccgctgcaaaccaggtaccgctgacaaaccatgtacc

SEQ ID NO: 708310 - DNA, 163 bp, Homo sapiens
cacgaggagaactattcaatcatatcacaggaacattatttcccattagaagatcgcacatgataattgattagcaactcgtgatgattcacaagaccacattgatttatcgaaagataatgctcacaacagacgagtattaactgaaagacaccttaaattt

SEQ ID NO: 708311 - DNA, 375 bp, Homo sapiens
cttggggagctgtaaaagaagggcgagtgatgagggcatggcggacgttgatagacggaatgtagtaacatacaaagagagaaacctcatcaggcagttgcattagagacaacctaacactcgggacatcagacagtgcaggagaagaatgtgatgcggaagatggggctgaacactacatccatacagaggtgtcatccattctttcgcttcagagaaaccttattacacagtctccattccttattccactaggactttcctatagcaaagaaacccatacatgtgtatggaatcaactgtctatagtctcttcacactgcagcgaagggaaaacttcattccttgattcgtgtttgtcttggccttcctggc

SEQ ID NO: 708312 - DNA, 585 bp, Homo sapiens
  misc_feature (49)..(49): n is a, c, g, or t
tcagtgactctaaggatcccagctcgatcaaacttcttccatcaggtangcgatgcacgggtcggagttgatcacgatctcgtaggccaggcccatctggccgcgactgtaggacttttcggtactgaggatctgcttgccgtaggaccagtggtgatagcccagcggcatgccgaccgaggcgtaggcgttcatcatctgctcggcagtgatgacctcgatctggttggggtaggtgtccagggcataacccgccgcgatacggctgatttcccggtcataggcctggatcagttcgaaggtccactcggagccagtggaaatgggttggcgcttgttctcttttttggcggtcatgttactaacctgcgctggaagagttcacggaagaccgggtagatatcgccggccgagaccagctgctgctgggcgaacgtgtcggcaaaggcttcgccgatgcgctcgtattcgaaccacagggcctggtgctcacggggggtgatttcgacgtaagtgtagtactgcacgaacggcatgatctggttgatcaaaatgtcccggcagattggggagtcgtcgttccag

SEQ ID NO: 708313 - DNA, 352 bp, Homo sapiens
gtacagcctggctatctattttaccctctggtacagcctggctatatatcttaatctctgatacagcctggctatctatcttaacctctggtacagcctggctatctatctaaacctctggtacagcctggctatctatcttaacctctgatacagtctggctatctattttaacctctggtacagcctggctatctatctaaacctctggtacagcctggctatctattttaacctctgatacagcctggctatatatcttaacctctgatacagcctggctatctatcttaacctctggtacagcctggctatatatcttaacctctgatacagcctggctagtcgacgc

SEQ ID NO: 708314 - DNA, 517 bp, Homo sapiens
gcactagcaacctgggtcattcatttaaagaactatctttaatatttactctcatgactaattgcccatgtgcatgtgccaaggcaaaacacaaaagtgactgtttccaaatgactgtcttctggttttaattcctacttgccttcagatctaacacaaggtccatcctgttctttcccaaaggattgatatcattgaggatcagggctgtgattatttaaatgccattggattcatggggggctatgcagttctgagtcaagacacaccccgactttcacaccaacgcggggtattaaattataaggtcaagggcaaacaggctaaactgttttttaacaacaaggtttaccacttccagaaagtgcttctaaggggaaacccggaaatttttccccgagaaaagggggaagagtaatacacaaataaaaaattttttattatcaaaattaacaggtataacattggaaaagtcccccatgccctgggaccggggaaaaaaggtgggggtgtaaaa

SEQ ID NO: 708315 - DNA, 817 bp, Homo sapiens
  misc_feature (345)..(345): n is a, c, g, or t
agcgggagagccggcgccggaggagacgcacgacagttgactttgctcttctgccgtctacgactcgtgacagatggtctccaggagccgttctctctccgtggtgcgaaaatggggaactcgttgaaggaacacaagctcataggacctagtctgcgggaaggaagtaggcataagcagatccatagacacactaaggatctactgatagctgtgaagtgtttggtaacaagtgaggctagtggactgctgtgcgtatctagtcagtacgtgggtaacagtctcatgtgctctgatgaacgttgcatctttgttggcactgatcccttggaaggactatacgcnttcaacaaggacgaaaaatgatcggagtcttgctagcagtggggaagcctctcattatcattcaagcacagcctgaagaattagtccggcacgcagtgaaacgaattgatctcctgctgtaaccgctcagaattcataagcatctgctacggtggtacacttgccaaggagatctcgtgcaggaacggaaggggacgaggtcgtggctccaatcgtggatgcatgagtgaaatgttcaattgtcgttcagagatttcattattcgctcatgagtcgtcaaagttagcagtcctgagtggcgatcatagagttgtggtttccaataccaggtggactacttcttacgttatgtgaccgtggaaactaagtggattacccgaaacaccgctgtgattggaagttggatgtaatctggatgctgctaggatatcgctaaccttaatgggtggaaaaaacttggcgattcatcccc

SEQ ID NO: 708316 - DNA, 367 bp, Homo sapiens
acagcgcgggctctagagctgggcttcgcagctccatactagcattggtcccctggacccatcttatgcactcttgtcttttctcattcctttgactccgccggacttcatagcccccacagtctagtgttgggtctgatcaccccaacagtcaggagttcgagaccagcctggccaacatggtgaaaccctgtctctactaagaaaaaatacaaaaattagtcaggggtggtggtgcatgcctgtaatcccagctacccaggaggctgaggcaggaggatctcttgaacctgggaggcggaggttgcagtgagctgagatcgtgccagtgcactccagcctgggaaacagagggagattccatctc

SEQ ID NO: 708317 - DNA, 130 bp, Homo sapiens
agtctggaggcgcactagaggatcccaccaacatggcctcgacccttaggtgtgttcgatgtagcgctgcatcgagcggttgatgtgtggaaacatgcgcgaattggcgtcatgcagggtattgtcgagg

SEQ ID NO: 708318 - DNA, 1377 bp, Homo sapiens
  misc_feature (1315)..(1315): n is a, c, g, or t
gtcctttttcgttattgttgggggggtaaaaaatttcccccatgtgattattgtgaacaccttgtgtttgtgggtcactgtgaacatttggggggtggggacagcggatggaaaagtaacaactagtgccacatgtgccctcggtggatctgtgcagcagcagctggtgcagcaatgtgatgacgtcttttgttgaatgcaaaaggtgtttactgagtactttaaaaataataatttagatgacgacctcactattttgggtgggtgcactctttttttttatagagcagctgcatctttaaaatgggtgggcgtggagatttcccacaacccaccccccaacaataataaacactaaagatgttacatatatttcagcgagtccctcctgtgtgtgggagcatcatataagatagcgcgattctcctctgtgtgtgggagcatcagtgggcgcacaaataaactgtgtggcgaaaactattgtatattctggggtgggagtaatcctctgtgagtgaggtgtgtgtggagagagtctctcatataggcgctggggagaagaagaatttctctcactcatatcactaattatttctcagtgagcgtgtaataaattaaaagaacagtgggaggggaatatatattgagagtgagtgagtgtatatgtggcggaaaattagcggtgttgttgcgccccctcaactatattctcctaacccaacataatattcgtcagtgagtcgcaggtgtgcgtggagacgcacacatacaatgggcgggggtgcgggagccaaaggtaacctaaacccaaagggtgtgcgagctaacatagcgggggatggcaggtagatttattacccccgggaagaattctttggattgtggggggagggccaaaaggatcgttcttactctataattaccacggaaaattaaaacccacctgtgtggggggtgtatttggtggaaaacaggttgaaacgataacaattggctgttggaaagaaaacacaattttggagggtcaatttcattttcaatttctgacgggaagtaaaaatattttctttcccacgcccttaattaagtgaagcttttgtaaacgttgggtcggcaactattgggggccctaaagatggatcgtcaaaatataggagtttgcaaaaaccctttctggtgggccacaccaacttatttctgtttgtatcccatcttgcgttgttgttgacccacccttggggtggttgtgtcgcacactttgtggcgagagaagaaaagagcaggtgttatcacccaaatcttcacggagtgaggnagatagatgggcggctaatgatctatgtcgaaccaggtgttgttggcccacactacgcaaac

SEQ ID NO: 708319 - DNA, 190 bp, Homo sapiens
  misc_feature (2)..(2): n is a, c, g, or t
  misc_feature (63)..(63): n is a, c, g, or t
  misc_feature (129)..(129): n is a, c, g, or t
  misc_feature (168)..(168): n is a, c, g, or t
  misc_feature (172)..(172): n is a, c, g, or t
cncccccccccaaataggggaactggagaaggtgttaaaagcccataaggtctcccttttccnctaagaatataaaaaccaaaaagaagaactgttttaaaaaaaataggagatgccattattttggantgaggttcataccataggccccagcagaccagaacaaanccanaaaaagtcactcatgcta

SEQ ID NO: 708320 - DNA, 290 bp, Homo sapiens
catggaatcatccagcaaagaactcagacgagaatgcctcccaacagagattgtcacactcctcatgtccagtacagaagccgtaagttacgctcaactattctgtagtcagtgaggtagccatatggtgtgtgcctcccaatccctggctccaggtatgtaggcggatacatgggagtaggagcccacctccctatccagcatggtgccgggatggaaggggggaaaggcgttgccgttcgggggctccttcggcgagtacagctagaatgactttgaggaacacccag

SEQ ID NO: 708321 - DNA, 214 bp, Homo sapiens
tattccccatcctgcccaatgtttacatgtcacccactttgttctcatcaaccttccctagtacaaatttatttacatcatcttactgcatagctactgactttactgaatctattccttgatttgatgttacctttcatacaaatcacagtcgaacaacgtatgaagttttttcaatacagccaagatgctggcttctcacctgtgcatatag

SEQ ID NO: 708322 - DNA, 968 bp, Homo sapiens
  misc_feature (23)..(29): n is a, c, g, or t
  misc_feature (36)..(36): n is a, c, g, or t
  misc_feature (38)..(44): n is a, c, g, or t
  misc_feature (58)..(58): n is a, c, g, or t
  misc_feature (60)..(60): n is a, c, g, or t
  misc_feature (68)..(68): n is a, c, g, or t
  misc_feature (74)..(74): n is a, c, g, or t
  misc_feature (77)..(82): n is a, c, g, or t
  misc_feature (115)..(115): n is a, c, g, or t
  misc_feature (188)..(188): n is a, c, g, or t
  misc_feature (194)..(194): n is a, c, g, or t
  misc_feature (197)..(197): n is a, c, g, or t
  misc_feature (386)..(386): n is a, c, g, or t
  misc_feature (496)..(496): n is a, c, g, or t
  misc_feature (522)..(522): n is a, c, g, or t
  misc_feature (539)..(539): n is a, c, g, or t
  misc_feature (564)..(564): n is a, c, g, or t
  misc_feature (580)..(580): n is a, c, g, or t
  misc_feature (655)..(655): n is a, c, g, or t
  misc_feature (896)..(896): n is a, c, g, or t
  misc_feature (968)..(968): n is a, c, g, or t
tccgccgccagctccagcctttnnnnnnnctccganannnnnnnccccggagcggagnancctagggnccctcntcnnnnnncccagcccagctacccgttcagaccagcagccncggggggcacccccccgccagcctgcctccctcccgctcagccctgccagggttccccagccatgaatctctnccgatnccngggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtaatgaaggtggtctacatagccntgctccttcaccacggtctggttgatttatagcaagttcaaagctacttacgatgggaaccatgacacgttcagagtggagttcctggtcgttcccacagccattctggngttcctggtcaatcatgacttcaccncctctggagatcctctnggaccttctccatctacctggagtnagtggcatcttgccgnagctgttcatgggtgagcaagaccggcgaggcggagaccatcaccagccactacttgtttggcgcaaggcgtgtnaccgcacgctctatctcttcaacgtggatctggcgctaccatttcgagggcttcttcgacctcatcgccattgtgggcaggcctggtccagacagtcctctactgcgatttcttctacctctatattaacaaagtcctaaaggggaagaagttgagtttgccggcatagccccggtcctctccatctctctcctcggcagcagcgggaggcagaggaaggcggcagaagatgaagagcttnccatccaggggtgacttttttaagaaccacctcttgtgctcccatcccgcctcctgccgggtttcagggggn

SEQ ID NO: 708323 - DNA, 203 bp, Homo sapiens
tggtcgacgacagcatgaagtcggaaatgcgcggcacgatttcggaacggaaccgcgaaccgttgaacacgccgtaatgaccgacgcccttctgcacgtaatgcacgcggcggtgatcaggaatcgacgtgcacagcgcatgcgtcgcttcggtttggccaagacccgagatgtcatccttctcgccttccaccgtcatcggc

SEQ ID NO: 708324 - DNA, 1325 bp, Homo sapiens
gatttctcccagacagtgcttgagcaatgggcgcacaggcacaacgatacatacttccccaacctcaaacccgatttgtggcaggacgacatggcatacagaatgaacatcgcctcgtgctcgcgataccagttaccgcaggctggaagcttggacgatgactattgaccgatattgtccgatctgctgagcacgcatggcgtcatgacttggcagcccaacgggcgaacgtgtccgttcatcaacgatcacagacactcaactgagctgcgcgattccagggcaccctgctaaatggccgattggacctagggacgatcagaaacgcctggcacctcttcaaccagaagcgcggcctgctcaatataggccaacaggaaagcctgcacaagaaaacaaaccaagcccttaacaacgattctcggagccacgcgaattgagaacccatgacatagctggcctgctatggcactgggccatgggacatcctcgccagcctaaacccttccaaaagccctctggcgccacaatcggttgtttacttacgaagagtaacacgaacgacttggaaaacaggaacgttcacatacaaacgaccccaacctgcattacaaattccccattaagggaccaaccccaccaaggccaacgactagtccaacacgcccgccattacatcattggaaggctcatgcggcccccaggagcaccaaggtaactcgaaaagccccatgtgagaagacaccacgacatagagcaacaagcaaacaaatagggcctcaccattagagtcgagtacgcacacttcctataacaaagcccaggacccgtacgacacggagttcccaaggtccttgcaaacccgagattcacttgggccccacactgtgcaaaaaggcgccctcttggcagccaacctctgcacaacgacgggcgaccctaacaactactggttaaacaccccccattacctaaagatttgcacctctttttccgcaaacactaccgggaaaaagccgccacccacaaaagaacacgcaacacaagcgccccaacggagggagattccaacaaatagcccgagggactatggagttttccgtttataagaccaaagagaccgcccggtacacaccgccaattggtacaactaggcaggccctaaacaacccccaatgacatccaacagggaccctatacccctatggcaaacctcgccacacaacgtaaacttagggaacagcgggcaacaacgaggcagaacaacggaaaaacagggagccaaggcggtaaaaacaggcgaacacataccgaacaataagcgc

SEQ ID NO: 708325 - DNA, 428 bp, Homo sapiens
gtacatgcagcagtgcatcatgaaattccacttttcgtgttttacagatcgtcttgactgcaaaatccctcgcggagctcactaaaatgctaattaggctaaaacaggaggtaaagaaatagccaatcatctattgcctgagagcacagggggagggacaatgattgggatataaacccaggcatttgagccggcaaaggcaaccccctttgggtcccctcctgttgtatgggagctctgttttcattctattaaatcttacaactgcatactctctggtccgtgtttgttctggttcgaactgagctttcgctcgccatctaccactgctgattgctgttgttgcagacaccaccactgacttccacccctccggatccagcagggtatctgctgcacttcagatccagtgaggcggggcccattgc

SEQ ID NO: 708326 - DNA, 172 bp, Homo sapiens
ggatcttactgcaagggacgtgacagaagaaaaagcacgtgcttttgatttctttcctctgcctgactagacaatgatgttactaaatgctacaaggctgaagaatctaaatgtcgtcttcgactcagagtaccgtatcatattattgttatgctatactttacttgtgtgt

SEQ ID NO: 708327 - DNA, 1023 bp, Homo sapiens
ggcgcacgtgtattccacaggtgggaggagtcggagaggcaggggctatgcgtttgcagccccagtagacaagcatgttgctacatgtgcctcaagccgccagagtggctcagcctgtccagatcctttgaggatatctaagggacaaagtgccgcaagtcttttctctaccttgggggaactcgtggaacttggaaccggcttctcctgtcctagctcttgatctgttctgggccaggtcccaggctttgagctgccatctgagatttgggctgtgcggatctctggagtgagctctgtttcggttgatccaggtcatggagatggaaacgggtgaggccccatgtggtctgttctgtgaagaagacagactctcctggcaatagggccccagcagtctccctcactgaaagccaggtggccgggtcctcggactctggttcatgttgcggtgagacctctgcccaggtgtgcagggttctcggcttgtgggctgcttgctgctcatctgacttttggtcccagtagtccctgcgttcttcattcaaccccttgctgggacttcagctctggagagcaccatcccgggggtcagggcctcgcaccacaggagccctgcagtgtggtagcgccatggctgtctcagaacaatgcagaggaacggccctgagagcttcacgctaaccatcctcgagcattgctggtggaaggcctccctggactgtgcccaacctttgcacccagtctccagatgcatgtttccaagacgaccttttaactctggctttggattgactctgctttggaccaggactccagacgtgggtgtaccgagaagaagcgtcggcaagaaggcactctaacccggatcctaggccgtgcctagggactggaattcccaaaaatgacgatacacgagaggcccgcgctattgaagggacccaaacccaccattacacctggttattcgaggttaaggtccacaactcttttgtgtgtcccctttttggtccacaccatacc

SEQ ID NO: 708328 - DNA, 144 bp, Homo sapiens
acattaaatttcctggctcctccatagtggtgctttggtctatttccttccttctgataactccctgaggtaaaggcttaggtcatgggtatagaccttcttttctaatacaatcacataagggggtatcctagggtaccgagc

SEQ ID NO: 708329 - DNA, 1041 bp, Homo sapiens
ccttgtctagacttttaccgtctcatgaaatgtttacgttgcttaaaggaaagcttttaatctctgaatgtctgtcctgtcccgatcccccgttacctgcagctttttcccattcatattggggttgaaatcttaactgtacaaaaggttctggccaccaaatactgccacattttctccggatggtcacattaataactactttgggacaaatagctggggggtgtctggaggttccagacctccttcacaggccagagttccatcggtcagatgatgcactggagtacctggtgtgtgaccttcttccagaagcacgggcacaggagcatgttaaaggccctgaaaagaccagtggcaaaagaaactcctttcatggttgtttaatccagagtttttcaagcttatttaactatagaacacttttctgtgggtttcgtagcctctttctagcacagtatagtgatgtgggaaaggccctgactgagagtcaaagattctgagcaggaaccatgatctcttcctgcctagtatgtgacttgagcaagacacttttcctctccccaggcctctgaggtctgcgagttttcctccaccctttcctctccctcagtttgcacatccgtattgacgtcagcctccaaactagcggtgggcctgtcaggacgctctgactctgcctcgagacagccagggaaacaaagcagcacaaccaggcagatgcagttagtgtccaagtcggggcactcacagcctagcaaggaaggcagcaagtcaaacctgtatagctctacacaagtgatgggtatcaactaaaaggctaagtgtcagggtaggcatgggagagatgaggttggcagagcgctttagcctagtctagcggcgagagccacaggtggcacaccaactgccagacggagagagacggcattcataagcatctgtggatgtcacctgagaattaaggagtgttggccggaccacggtggcttcatgcctgtaatcccaagcactttgggaggctgcttccaggcagattgc

SEQ ID NO: 708330 - DNA, 125 bp, Homo sapiens
caacgcgttgggagctctcatattgtcgactgcaggtcggcggaatacactagtgatatgtgagctgagatcgcatccggctataagacattttattaatggtttcagactattatcttaatgtg

SEQ ID NO: 708331 - DNA, 215 bp, Homo sapiens
tctctgatatgctgctcagagaaagctctaagaaaatctgctttaacaatctgttctcctaacctgtgtggtccatctgcaccatatgagcagcaggaaagaagcatcatgggcttgacagagacacagctgctgcttctctccaggcggagcaccacagggcaacctgaactaacatgtatgccatagaaagtaaggatttacaaaatatacac

SEQ ID NO: 708332 - DNA, 1089 bp, Homo sapiens
  misc_feature (658)..(658): n is a, c, g, or t
ctctggctaatcatgacgagcactgggtgcttgtacccgctccggtggactaactctcttaattgtacattattcagtcgaggacacagggcaggacgtttctccgaatcactttggccctcccatggaccacatgttccctgggaggacccttcgacgtcttggactagaaggcccgtggagtaaggatgacgcggtagcatgtcgaagacgagccacgggttacttaattcccttcaagcgaaaccaattgaaggccgtatgccatatatggggcagactaattatagctgaatgaggaggcacaccatgtgacgggacaccctggccaagtacgccccagggatatgtgtctggggcgcgcattctggatcgtattggcggagacatgagagagcgcacgacgatcacccgtgggggaacactggagagccgtcgtatcgcacacaatgtgtgtgcctgtggatatatcggggctaagctcgactgtggttggagtggtagagcgtacagatggcattccctgcaatttcttgtgcgacgtgttgaaaagccaagaggcggttcatcctcggggaactgtgcgtctaaaatctccctatcacaaattcagaggctaggcctgcatgatctcattacacgagatccctaggaaacncacaattactttggcccacaccaagctggtgtctgtagaaacacttggtctgctgagttcaacgagcctgttcatggagcaatacccgaacctcaagagagcgaagaattgccgaagagatgtgcgaccacaggacgtggttccttcggtgcaacactgttagagtcccaaaccttccagaacgaaggtcctactttgctgtgcgcttgggcaaggagtaccctggtccaatcagtacgtacaacttaagatttaacatccactagccagtggggacagtgatactgccttctaccaaagtcaatatatggcattgtgtgccaataacaagaataactagtcaaggaaattctaatacacttaactcgatatgaaactttggggtggctcattgaaccaggaccggagtaaggatgcaatataccccccag

SEQ ID NO: 708333 - DNA, 306 bp, Homo sapiens
taaaggatccccgagttatcctgcaaatgcaggaacgtgggtgcgtctcggaggactggaggtggagacaacagaaagagggtgcaagctcctgaatagtggtctaggggttaggatgtgcctatgctatgtgatgtcatgtggggcatctcgaggaacacagacttcatgacaggctgtaggggacacagtgagcaaggagctctagggcaatacacaatggcacaccagaacccggagcctgacaaagtgaatcaaaacagggagatggatatctacaagaggagcgaaggtgggtcccagacc

SEQ ID NO: 708334 - DNA, 138 bp, Homo sapiens
gcggcatgaagacccttgagttgctttccctgaagacgtacagtagcagggctcttgaacattccgccctacaagggcaagatgaagaggatcgccgtccaattccaaggcggacaacttggttcgcttcgggtggaa

SEQ ID NO: 708335 - DNA, 240 bp, Homo sapiens
  misc_feature (77)..(77): n is a, c, g, or t
  misc_feature (124)..(124): n is a, c, g, or t
  misc_feature (138)..(138): n is a, c, g, or t
  misc_feature (219)..(219): n is a, c, g, or t
tcgtcgcctaggaaggtctccaatttctgggctcaaagggatcctcacaaagtactgggattacaggtgtgagccancgcacccggacctaattttcgcatgtttagtagagatggggtttcancatgttggccaggntagtctcaaactcctgacctcaggtgattcgcccgtcttgggctcccaaagtgttgagattacaggcgtgagcaaccatgncaggcctcagaatggctctta

SEQ ID NO: 708336 - DNA, 1413 bp, Homo sapiens
  misc_feature (580)..(580): n is a, c, g, or t
  misc_feature (725)..(725): n is a, c, g, or t
  misc_feature (727)..(727): n is a, c, g, or t
  misc_feature (750)..(750): n is a, c, g, or t
  misc_feature (767)..(767): n is a, c, g, or t
  misc_feature (774)..(774): n is a, c, g, or t
  misc_feature (1056)..(1056): n is a, c, g, or t
aatcgggggcgggtagtctacaaagggtgtgtcggccctttaggaatgttggctctcccgcttctttggggcccagatgggtttgtcaagcgcggggtttggttcagatgcttacatgtggtgcccccggcgtttttttgttgctctgagattggcggcgtctgtgtgcgtacacgaaggggttgtcggggggccccccggcgtaatatttgggtcgtctgtttaataagtttgggtgcagttggttaatcccctcttccccacctggttgtatttcttctgcgtcggaagttgtgtgaatagttgtgtgtcgccaccagggggggtccccgcgggggggggccgctgttaaattttttgttttaacttttcgcacacccccgccgtttttatgttgtaccacccgggcgtcttcacaccacaagatgttagaataacacagttatcatcgccctggtaaatggggtatatctcagatcacagcaccacagctcatcagagaatgttttatgaggtgcacacacactcaatgagagacacactctcgcaaaagagatactcccctcacacaacacgagtntttggtgtcacaccacaagaatatacgaccctagacgacgcttgtgtgtgtaataacacacgcacccgcgtcgcccacgagtatatcacacctattataccccggggtctcctctatagagggtgattacgccgcgagaggcgcncnctggtgtggtgtgcgcgagaatnttcttcgcggcaccacncgagagnggggttatatagaggtgtgctctctccacccttggcgcgccaacaacaacactcgcgccctgttctcgctctcactcgtgggtggtgagatagtctctgagaggcacacaatgagagggcctcacacagccacagagagagtactcacacacacggcacagctctctctctcaacacaggggagagaggccacagtgtgttgcccactcttcgcctctgggggctcgttatttcccgtctctctgtgggagatgtttatcaccgtcgcgagagatttattanagagagggggtgcacacagaatctcccgcgcagaatgccctccgagacacccacacactcgctttgtgtagagccctcatcactcttgtgggagagatataaaggagagatatatatttgggttctttctcggagatttgtgaggccacacatcacgccgcgaccacgccactgtgaaagaatgttgttgcttctgggctcggaatataagaagaatgggacacacatcacattcacgctcacactatggttggaatggcaccaaggctcttcaccaacccactctgtagcccgaatggaaccttgtactaacttatgatagaaatgtatccagaataaaagtttttaacccctgta

SEQ ID NO: 708337 - DNA, 164 bp, Homo sapiens
ggtgacgtccgggtacagtatgtgaggtcagacgccgtgcagcccagtgactcagcaccgggtgagacgagttgttgaagagccactgcccagtgtcacgcgaactgtggtctgcatggcgcaccatcagtggatgggtggtcgggatctttcctacgggctgg

SEQ ID NO: 708338 - DNA, 123 bp, Homo sapiens
tcctttaacttttttaagggggccccaaatttcgggacaaattttggggccaggttgtcctccataaaaagatattcgttttaaaaacatcataatcacttaagaagagtgcccagcagccac

SEQ ID NO: 708339 - DNA, 200 bp, Homo sapiens
ccgagatcttggatgtcttccacagttcaaaagaccctttcgtcacccaacctgggtataacactggaaatggtattcaagcttcctggcacttctggtcagcaaaccaagtgttgggcaacaaatgattttgaggaacatggttttaaggcggaccacaaccggccacaaacgggcaactcccataaaggcataaagcc

SEQ ID NO: 708340 - DNA, 117 bp, Homo sapiens
agctggaactggtgcagtggctcacacctgtcttgggcaacttccccatcaccttcgcctgctatggggccctcttctgcctctcggcctccatcatctaccccaccacctatgtcc

SEQ ID NO: 708341 - DNA, 458 bp, Homo sapiens
  misc_feature (8)..(8): n is a, c, g, or t
  misc_feature (46)..(46): n is a, c, g, or t
  misc_feature (237)..(237): n is a, c, g, or t
gccaccgngcgagatgtcagatctcgtgtacgtcgattgaacacgnagacgaatacgtactcccaatttaattgttggtattggaagtaaacttcaagtttccacataagtcctaggagtttcgtaaaattggaacggcgaattttgggttaaatggcactttacccttaaacgacgtaacaatttgacatcacctttggtacgatatcattatttccaatatattctctctttaantttaatttacacaaaaatttaaagtttttttttagttagaaatcctactgaatttttaactaaacggtacattttacatagacgtaaaaaatgtgttttgaacaaaaatcgtattttaaaattttgacatgatgaactacataatatgtaaaacttggtatacataatttggtatttgtcatattacaacaatattattttgtccgttgtttaaatattta

SEQ ID NO: 708342 - DNA, 118 bp, Homo sapiens
atggatcacatcgtccacattatcatgtccatctgcaccatgctgtgcaacaaggatcatgttattcatgatctgttcagggctgtgtacccgttccctggccgccagaagattcaca

SEQ ID NO: 708343 - DNA, 233 bp, Homo sapiens
gatggaagagaaggggagcaaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctcgcct

SEQ ID NO: 708344 - DNA, 233 bp, Homo sapiens
agcaacaagcatcagaaaacacacagggcaagaggacacaggactcagagggcgacagggaaagacctcagccaatcaggaccatgcggacaagcatccgccccacatgggcccgtcagcccgaccaggatatgcctcacaaacgcatcagagttgacacaaccatggctgacctcatgcccagccatcggcatctcgtctcttctcttgtacatctcgtctcttcttcttgg

SEQ ID NO: 708345 - DNA, 823 bp, Homo sapiens
gtagttataattatttcagagcttccggaaatactgtcctaactggctatgttaggatcttggttatctctgaagacaaagaacgaagctaggactcttaatttgggggtgcttctgtgactcttagtggggaaactgaaaatatttccacacttttacccacgtcaatggcatattctgggaatcaccaccaccacacaataccacagaaagaggctggaggctctgtaccctgttcattccttaagggccctgcttcccttaataagtaagtacagtggtctacggccctaaatatgcaatgagagctgaaggttttctacaaggtcgcccacggacacgggcaagggtttcccacccctgctttaaaacttgattattacatctctgcttgtatcctatgtggagcagagtaaggatagaaccaacaaggggctgagtacctgagactgggggcacccaaagagtgacacatacttttataccagaggcagcggtgagcctcatgcaggacaattactcattgtaaatggggtcaaataatacaattttgacattctttcactccatacacaaaaaaaggtcaggactgggtgtaataaacgtggtgtgatttcatccatcgtgttgtcttgaaatacacaagcctagaaggaatgaactagtgtactgaactggttacataatttgtgtggtaacaagtacctgtgggtatttttcacaattaaaactttgtgattataatgttcttacttttacaatgtacgtgtaaaattacataaactaaatgtgggggttcaaacaccggaagggatttggcaag

SEQ ID NO: 708346 - DNA, 421 bp, Homo sapiens
cagagctgttcctatttggccatcttggaatgggaaaaactcttttttttttttaccccattaattcctttatgtaggaagactgaaagtttaaatgtctaaaagacagacaacagataaaaggcaagagaaaagtaatttttttttatcctggcatcacaggcttaatcatgtcaagtttcaaaacaaccccagcagccatctgaccctgttcctgcagttacctagtggaagggtagtgtcaagagtgataaaagtgtaagaatatttacctgtggtttccttcttaaaataaagtggaagccaggcacagtggctcacacctgtaatgccagagctttgggaggccaaggcaggatgatccgttgcggtcagggtttcaagaccaacctggacaacatagcaagacctcatttctaca

SEQ ID NO: 708347 - DNA, 117 bp, Homo sapiens
tgggaataaaccggggtttggttttttgaatttttggaaatttggggaaatgttccccctatgggggccttgttttcccccaaggggtgcctcttgtttttttgaaataaaaactga

SEQ ID NO: 708348 - DNA, 177 bp, Homo sapiens
  misc_feature (35)..(35): n is a, c, g, or t
  misc_feature (109)..(109): n is a, c, g, or t
  misc_feature (166)..(166): n is a, c, g, or t
gattgctattcactcttttcctccccttgcttatnactgtggctagtttcccatttttcttttgttgttccggttttttttcggttttgatttttggcggctgcgtggntggggtggtcgggtatgtcggcgggggggtgtgggctgtgcgggggcattacaaaanaacccccaagg

SEQ ID NO: 708349 - DNA, 1346 bp, Homo sapiens
actatctacttcgagtagttacgagaaatgaaaactggcgccgatcactggttgactgacacgtgaccggtatgtggtgtgtcctcccatcatgtaatcactaggtgtagcgcattgagtaggtgctgcgatataggctacgggcaacgtgccacgcaagaattggttcacccgttcaatatgcgtcgcataatttacatattgccaggacataataactactattgtcgtagcaatgcatatacagcgggaactactaacatcttaaacagactatcatataatgatttatagcatcctctaatgcggcaagctatcacactaatcaagtgcactattaacttcttcaatcgctcacctgaacaatgagatcaaacagggcgtttagcggggcgacttaataggcttattggctctagttttcgtgtagctctaagtcgacatggatagtgtgttcatcgcatacccagtaattctcatcgcaccggggtcacaaagatcttcttgactcccttacgtggtaggacagcggaggactcatgccttaagagatcttattaaatttcccactagtattaatgcctatggctgggtggacatgcaacggtttcctggggacatgtcccccttggccattcaactttgggttagaacgcatgttttgacttggcttcaagtgctccccatttcgataatgtcatgattaacggctatgcgagcttaaactaatgttctccacaccacttttagccactcattttcggtaaacgccacgttgacgaactataccctttgcacattcatgacccttcagaggacactccactgtaatttacctattgtgagggtagaaataaaacgatgtcgcatgaatctcacatcttattcatcggaagtccataacctcacccttgtggtattctatactggaaatagcatgtcccttgtcaactttctccactgtggtcgatccgttggccttactttgctcgtcctcaattgaccctttttcacagggcacctacttcatacagcgagaccgtccacaagcgtgtgcatacggggaaacctatacgctatcttggacctcagggactaaactgggtatcacgctcccagtacttcgcgtaacttatgagccgagttgtgtcgctgtgatgtgcgctacttcgacacaggtacaggaagtctatcgaccactgataattcatcaactgcgcatcccgtgtgtctgtgacgtttgttcgtcccgacaccctgtgcgatcaatatgtccatcccgattctcagtacgatggcccacagacatttgagatacgagacattcgtgatttagttgctcatct

SEQ ID NO: 708350 - DNA, 284 bp, Homo sapiens
gtgactagtgtttgagctctgtacatgtcgggtcggagttacgcgtatcgatggcgcaggtgagggggcgcaatatgcatcctaggcctattaatattcgggagtatacgtagcgggataaggttaacaagcggtacctctagaactatagctagcatgcgcaaaatttaaagcgctgatatcgatcgcgcgcagattctgtcagtgatgactcattgcaatgtggatccatcttatacgggccgggggttatacattccctcagggtcgactgtcccagtggc

SEQ ID NO: 708351 - DNA, 199 bp, Homo sapiens
  misc_feature (17)..(17): n is a, c, g, or t
  misc_feature (128)..(128): n is a, c, g, or t
  misc_feature (183)..(183): n is a, c, g, or t
gcaccaaccagcgccanccagcaagaaagcctcaaagggcaaggggctccgagggcgccaaagatttggtccaagtcaaattgaaagaactgtcgtttcctccctggggatgtggggtcccagctganttcctgcctcttaggagtcctcaaatacccttctgtgcccctggcagctgataancctaggttcatgaccc

SEQ ID NO: 708352 - DNA, 335 bp, Homo sapiens
ccctgagcttttattgaccagtggactgtgacttttgatgtaattttatttttgagagagggtcttgctctgtcacccaggctggagtgcaatggggtgatcttggctcactgcaacctccgcctcacgggctccagtgattctcctgcctcagcctcccgagtagctgggactacaggtgcacaccaccttggctggctagtttatgtaattttttgtatgtctgtggagacagggtttcaccatgttgcccaggctggtctcaaactcctgaactcaggtgatctacccgccttccaaagtactgggattacaggcatgagccaccataataa

SEQ ID NO: 708353 - DNA, 275 bp, Homo sapiens
cgcgtgatgtcttgtttgaaagccgtgcagcttgagaccctgtggggaagctgatgttcctgtttgagagctgtgcagctggagatctggctggggagctgatgtccagtatgagggccgtgcggctggagacctggtggggagctgatgttccagtttgagggccgtgcacctggagacccggcaggaagctgatgttccagtttgagggctgtgcagctagataccgggggtggcgctgatgttccagtttgatggccattcaacgcctcccg

SEQ ID NO: 708354 - DNA, 300 bp, Homo sapiens
  misc_feature (5)..(5): n is a, c, g, or t
  misc_feature (26)..(26): n is a, c, g, or t
  misc_feature (44)..(44): n is a, c, g, or t
  misc_feature (282)..(282): n is a, c, g, or t
  misc_feature (288)..(288): n is a, c, g, or t
gcacntatataaatacatatatattntattataaatttataatntcttatatctgtgattttcatatatatgaatcagatctatgattttcatatatatgaatcggatctgtgattttcatatgtatatgaaagatgaaagatcgtatatatatgaaaatcatagatctcctgcccttctgtggtatgtttcacctcctgagacacactgaatattttcctaaaatttaaactaggattatgttcacttttaatttgcatgcctgggtaacaatgtcactanccaaanctactcctttat

SEQ ID NO: 708355 - DNA, 294 bp, Homo sapiens
aggatccccatgttgccccctatgggcggggtacagtggtgcgatctatggttcactgtcaagctcagcctcctgggttcgcggcgattctcctgcctcagcctcccgatctcgctcggtactacaggtcgccaccaccttgcctcaactaatttttaagtattttttagttacagactaggtttcaccgtgctctagccaggatggtctctatcttctgactctcttggatccgcgctgcctcagcactctcatcgctgctgggacttacaggctgtgagccacccaacggcc

SEQ ID NO: 708356 - DNA, 593 bp, Homo sapiens
cttcttcgggaggagcggattaagagggcttgggcaagggaccagaaatttgaagaactttacgccaggtggcaatagggtgccgctgccgcagcacgcccctctgggacgcagaagggaatgacccatcccccaccttctataaaaagaagaggcgcttctgttctgccccgtgaagagggttggagcctgttcaagatccccaaggggtccttgctaaaaatggcaccagaggagtgaggggggctgcggtagatgccccccccccttttattttagaataaattccccccttctctggctttctatgcggttgggagggaaaaaaaagaatgggcccccctcccaaagctttattccccgggggggtgtggcatgtttgaaatggggtctgtttaaaggggcaatcccagatcccgttggggggggcagatctttccccctgaatttctctcgataacccccagggggggggggtcttaaaaaatttgaaaaaaacttccttctcgggggtcctttaaagggggccaagggccccccggggacttagggtttcggtttgattcttttttaaaaaacccctctttgtttta

SEQ ID NO: 708357 - DNA, 174 bp, Homo sapiens
gactgtcgacaggttctgatccagtataacccagcagcttcttgcacacttcgcagaagccccgtcctttggctgagtcacgtgaacggtcagtgcaggcagcgcgtgccagagcaggaggtgcagcatgctgcacaccaagctcagggctgacgctcctccagcgaggatgga

SEQ ID NO: 708358 - DNA, 422 bp, Homo sapiens
  misc_feature (13)..(13): n is a, c, g, or t
  misc_feature (55)..(55): n is a, c, g, or t
  misc_feature (57)..(57): n is a, c, g, or t
atggcttccacgngggcgagtcgagtcttgctgcgtctccgcggccgccgcaggncntccctcgcgacaggacaagtactcggtgctgttgccacctacaacgaacgggagaacctgccgctcatcgtgtggctgctggtgaagagcttctccgagagtgcaatcaactatgaaattataatcatagatgatggaagcccagacgggacaagagaagttgctgaacaactggcagagatctatgggcccgacagaattctcctaagaccacgagagaaaaagctgggtctcggaactgcctacattcatggaatcaaacacgccacggggaactatgtgatcatcatggatgctgacctctcccaccatcccaaatttattcctgaatttatcaggaaacaaaaggagggtaattttgatat

SEQ ID NO: 708359 - DNA, 224 bp, Homo sapiens
  misc_feature (41)..(41): n is a, c, g, or t
  misc_feature (58)..(58): n is a, c, g, or t
  misc_feature (79)..(79): n is a, c, g, or t
  misc_feature (172)..(172): n is a, c, g, or t
  misc_feature (198)..(198): n is a, c, g, or t
  misc_feature (202)..(202): n is a, c, g, or t
cttgtgggcgtgtcttggccgtgtgtaaggcgggacacgcntgagaagggggtccccntgtaccgccacatcgcagatntcgctgggaaccctgacctcatactcccagtgccagccttcaatgtgatcaacgggggctccatgcctggaaacaagctggccattgaggaantcaatgattctgcctgtgggagccantccnttcaaggaagcaatgggaattg

SEQ ID NO: 708360 - DNA, 955 bp, Homo sapiens
gagtccgagtggagagagggagctgagtggttgtgtggtcgcagtcgtcggaaagccggtagtcgctgcaggcaatggaggtgagccaagcaatggaagctgagaggagtcagatcgtcagaaattcaccaggaaggctattgtatcatgtagttcgaacaaagtatggtgagtggaagcgtatgaacaacgcataaggacatcgggaaactgatacaatgagagtctcttgggacagaggtcccgcagaagcagtaggttatcaggacatgattaatgaagtagactgcgtgaatggtaaggggctgcaagttgagattcggaatgaaatttgcgtgagcaatgatggtcggagatcatgaaagacacagatagctgaacgaagaaggtgagagaagcattcacgtgtgtttgataaaggaggggaatcggctatattagtgtggtggaagttcgtcatgttgaggacaaatcgtgtggagagaagtgaccaggatgacgaagttgactgacatgatcagggcaagcggtgatggtggtgcaggtgacgttgactatgacgaggtgtgtccatgtgtctgccaggcccagggaaagactgggacagaatcgggtgcattcctgcccacactgctaataagcctttctgggggacttactgctgaagggtctccctactgggacaaaatccgtttgtacatagggacgtacaaccccagggggtgttaccccaaacttaaggagaggttctaaaacccttttgataggtccacacacgggcgtgcgtgtaacaacaatctaaattctaccaggacaaaaaggaaagaacggcaggcgcatacagaatgaaaccagcacgatgagcaggaacacacaacaagtccgctctctctgttctgcgatccaggcttcattctttttgtgaaaacgataaacagcagaaacatgaacaaac

SEQ ID NO: 708361 - DNA, 314 bp, Homo sapiens
  misc_feature (10)..(11): n is a, c, g, or t
  misc_feature (80)..(80): n is a, c, g, or t
  misc_feature (94)..(94): n is a, c, g, or t
  misc_feature (188)..(188): n is a, c, g, or t
  misc_feature (192)..(192): n is a, c, g, or t
  misc_feature (230)..(230): n is a, c, g, or t
tggtcatacnntgtgtttcaaaagcaatatgatggagctaaaatcgtacatgtggttttaattgattttacttactgttngcatcctcacaganacaaaggcatgtgcaagggagaaatagaaatctttttcaagtgatcttgacctttttttgttgagtctagtacaccgttaggaaaaggtcacanttgntcctagaacttttctatcaaccagtaagtctgtgtgtnaattagtaatttttttgaaaaaccaatgtttgaccacaaaatggtagcttattttcacctagtacacataatggggtatcctaa

SEQ ID NO: 708362 - DNA, 210 bp, Homo sapiens
gctgtagttaaatgatagcgaactcctgcagcatataatactagtggaagggtgcggacagcatgagtagctgcagcggctgagctgagcgacgtggacccatagtctagtgtatgatgtagtaagcaacacggctgtggtagaaatagactacgtggaaccttgtgaaggaagctggtctcatagtaactcacatggttggtctcagga

SEQ ID NO: 708363 - DNA, 793 bp, Homo sapiens
tgccaccgccggagggcaggcgcggtacacgcgacggacaggtccctgcggggaaaaattggcagaaacatcccgctgccaccccaggggggtgcgaggaaatgcatgtccgtggccgcgtcgcactcggtaggcaccccccagagtgaagcgaggggaggccgagccgcccgcggagttggcgcccgagtcgggggacgcacctctcaccaccgacggagagaaaccgccctgtgtggagaggccccccccccatctcacctgggagcactagacgcgcgaggagacgcgtgctcccacaggcgagcggagccgggcacttgttcacgcgccacgcgggttgccccccccgctaggggatctattgctcgccccgcgagaagggtggccccctgtgggatagcgcccgcgcgagtagatgtgcgggagcatgcgtccacctgagtggaatatgtttgtgaggcacgccccaccaagaggagagctggaagagaaagggcccagactgccgtccccacagaagaagagacgggccccacgaatgtgtaggacgccgcgaggagacaggaacgcgcccgcgggcaatcccagaggagccgtggccaccgcaaatgacgccgcggcagacagagccgcaaatgggcgcgcctcactgtgtaaaaagcaagagagcttcacagagaggttccacctcccccgcccaacaccccgcacagagagtctccagcgggcccgggtcgaccccacgccgcgcgttggacaaaaaagcgccaccgccgccccaacatgatac

SEQ ID NO: 708364 - DNA, 104 bp, Homo sapiens
  misc_feature (101)..(101): n is a, c, g, or t
gagaggttgggaagatggtgtggtgaggctgggcgcacagaggctggggctgcgtccaggcatggggagcgaaaaaagagacctcgtagctgggttgagcncac

SEQ ID NO: 708365 - DNA, 117 bp, Homo sapiens
agtggatgcagcgtgcattctgtagtaaaagatgggagtggggagagagaactaggccaaaaggccatggcagctccaaggctgccctggtcactgaccagcacttgtcttgaccct

SEQ ID NO: 708366 - DNA, 186 bp, Homo sapiens
agctgtgtctttccgtattaggaataaccaagtgatggagtgtatacccaatgcccagttgaccagttctggcgggtgcatgcctgcagtcatcaacactgcctacgagaggaaggatggcaaattcgtcttcttcaaaggagacaagcattgggtgtttgatgaggcgtccctggaaccaagcta

SEQ ID NO: 708367 - DNA, 126 bp, Homo sapiens
  misc_feature (71)..(71): n is a, c, g, or t
gcttggatcagtctaggtgcagctgccggatccttcagcgtctgcatctcggcgtcgcccgcggtacccgntggcccggcttttccgtccggttttcccgggggtttcgggggcacttggggcccc

SEQ ID NO: 708368 - DNA, 1170 bp, Homo sapiens
tgatcaactgttcagggtctctctcttacaaccaagaacattatcttagtggaagatggtacgtcatgctcagtgtccagtttaattctgtagaagttacgtctggctctaggttaacccttcctagaaagcaagcagactgttgccccattttgggtacaatttgatatactttccataccctccatctgtggatttttcagcattggaatcccccaaccagagatgttaaagtgagctgtcccaggaaacatctccacccaagacgtctttggaatccaagaacaggaagccaagagagtgagcagggagggattgggggtggggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcgccaacacccacccccacacacaccaacattttgctgcctaccttgttatccttctcaagaagctgaagtgtacgccctctccccttttgtgcttatttatttaataggctgcagtgtcgcttatgaaagtacgatgtacagtaacttaatggaagtgctgactctagcatcagcctctaccgattgattttcctcccttctctagccctggatgtccacttagggataaaaagaatatggttttggttcccatttctagttcacgttgaatgacaggcctggagctgtagaatcaggaaacccggatgcctaacagctcaaagatgttttgttaaaacagctcaaagatgttttgttaatagaaggattttaatacgttttgcaaatgcatcatgcaatgaattttgcatgtttataataaaccttaataacaagtgaaaaaaaaaaaa

SEQ ID NO: 708369 - DNA, 180 bp, Homo sapiens
ttcctcgttgtcatctgatcccactcttaccgcaggacgtcgggcgtgctgaatcgactgagctgctgtcgctactagggtaccgatgctcgatacttcgtaaatcttagtcagtaggtttttcctgctttgaaaatgcctggtcgatctagaacggttcttaactggaacaacccttgg

SEQ ID NO: 708370 - DNA, 169 bp, Homo sapiens
gtatgaggaattgcttaatatatacagtgaacttgagtaggattcgtcgtactcaaagacttctcggggaagtgtccagaattgaccacacaggtgctagacggtacgaaagaacacagacccaaaaccctgatctagatgcattaactccaattagcccatgaggttc

SEQ ID NO: 708371 - DNA, 232 bp, Homo sapiens
tacccacggaggtccccagagtctgctgcggcgtacttcctgtcatggtgggtatccgcaggttcctggacatgtgcctgtctgagagccgcacctcgatgttgggcagatcgcgccagtctgagcctagggtcgaggggatgtgccgcattcgtgcatgcagcaatgcgctcatgtgcttagagatctggtccctgaggatgggcttgtactgtgcaagccgggctgtgtg

SEQ ID NO: 708372 - DNA, 415 bp, Homo sapiens
tcaacgctttatacttcgagattcttaatgaaggagtcaaaagacctctacaaagaaaacgcaaaacactgctgaaagaaatcgcagatgatacaaacaaatggaaacacatcccatacccatggatgggtagaatcaatattgtgaaaatgaccatactgccaaaagcaatctacaaagtcaatgcagtcaccatcaaaatgccaccatcattcttcacggaattagaaaaaacaattctaaaattcatatggaaccaaaaaagagcccacacagccaaaggaagactaaacaaaaacaacacatctggaggcatcacattacctgatttcagactatactataagccatcaccaaaacagtgtggtactggtataaagataggcatggaagtataaagcgttgaggggtaccg

SEQ ID NO: 708373 - DNA, 417 bp, Homo sapiens
gatcctcgctccacctgacggggtgggattacaggtgcttgccaccatggctggcgtaatttttgtatttttagtagagactggggttttgccatgttggccaggctggtctcgaactcctgacctcaggtgatctgcccaccttggcgctggggttgcaggtgtgagccaccacacctggtcacaggtgcagttttgttacatggatatattgtgtagtggggaaatctgggcttttagtgtaaccatcaccaaaatactgtacattgtacccaaaaggtaattgctcatccctcaccccctcccacctttccaagcctccagtgtctattattccacactccatgaccctgtatacaccctgtttaactcccacttataagtggaaacatgtggtatttttttttgtttctgagg

SEQ ID NO: 708374 - DNA, 412 bp, Homo sapiens
aatgtttctggcaatttgctgaccagatgggatacctctacttcagctacgaggttcagcgcattctcgggatgtcacatgaccgccacattgttgccacggcacataccccgcagggtttccttattgacacttcccaggatgtaaggggccagattaactttgctacacaagaaacaggcttctatcagctttgtctaaaaaatgagcagaatcgcttcagttctatacaagtgtatctcaactttggagtcttctatgaggggcccgaggtggatcacaagcagagtcaaaggaagcaactgaacgacactctggatgcgattaaggacagcacacaaagggtggagaaccaagtttttcacatgtggtgcttctacaactatgccaggatgaggaaagtggctgactt

SEQ ID NO: 708375 - DNA, 338 bp, Homo sapiens
tagttgatatgtcctggcagcccatgtgtgtgagagcttctcagactatccacctttggtcgcttcgcttgttcgtgatatgagacagacagttgcggtgggtgtcatcaaatgcagtggacaatgaaggctgctggagctggcaaggtcaccaatgtctgcccatgaaagctcagacaggctaagatgaatattatcccataatacctgccacccacactctataatcagtggtggaagaacggtctcagacactgttggtttcaactgggccatttaagtttagtagtaaaagactggttaatgataacaatcacatcatgaacaatcacatcatg

SEQ ID NO: 708376 - DNA, 306 bp, Homo sapiens
  misc_feature (234)..(234): n is a, c, g, or t
  misc_feature (240)..(240): n is a, c, g, or t
  misc_feature (300)..(300): n is a, c, g, or t
aattatcctttcaaacatgaagaagtaaagacttcctcagaaaaacaaaaattgagaaaattctttttccaatacaactgccttgcaagacatgttaaaagaagttatttagaaagaagaaaaattatacaaatcaaaaactgggatcaacataaagaaaggaagagcatcagagaaggaacaagtgaagttgaagtattctacaatgggaaggacaaaaaaaggaaaaagganaagganaaggaaaacccaattcaagtctgtggggttttgaggtatggggtcccttgaggaaagggntttctt

SEQ ID NO: 708377 - DNA, 449 bp, Homo sapiens
atccggtaacacatccggggccaaggtccacctgctcccgcccctgttggaggagctggccctgaacgagttggttacactaaggtgcctggcacccggtttcagccccaaggacgttctggttccttgggtgcaggggtcacaggaatttccccccgaaaagtactttactttggtatcccggcaggagcccagccagggcccccccccctttcctgtgcacagcattctgggggtggcaaccgaggtttgtaaaaagggggcccccttttcttgcatggtgggccacgaggcccttcctctggctttttcccaaaaggccttcgcccgcttggggggtaaacccccccttgtcaatgtgtttgttttcatgggggggggggggggcccctggtttttagccgcccgcctgtccccccccctgaataaactccatgttccccccagca

SEQ ID NO: 708378 - DNA, 170 bp, Homo sapiens
cagctagcataacaggaatactttctcacagtttctactccaaagaccacatcatcgaaacgcaacatatcatacacaaacgccggaagcctattcgcaggatttctcattactaacaacaatttcccccgcatcccccttacaaacaacaattcccctccggcctaccg

SEQ ID NO: 708379 - DNA, 468 bp, Homo sapiens
ctggtgaagatgatagaccaacaggagttcttgtccataggtgatggtactacagcatggcacagtcactttgaaagacagtttgaccgtttcttataaaattaaacatcctcttaccatatgcatccagccatcccagttccttggtattaacaaaatgcgtccaaaacatcatatctgtacacaaacctgcacactgatattacatagcagccttatacatactttcccaaacttggaagcaaccaacatatccttcagtaggtgaaagcaataacttctggcgcacctagacaatggcacatattattcagcactgtaaagacctgcagctatccatcacctgaaaggccatggcaggaacactgaactgcctcatttctaagtgaaagcaagccaatcatatgcatcccaactctctaacattctggcaaaaggcaaacctatggagacatacaaaagatcagc

SEQ ID NO: 708380 - DNA, 819 bp, Homo sapiens
ctagaagggtcctgtgttgggccaaccccggcatattgggccattgcgaaatgggctcctatgcccttgtatctggcctattatttactcgcaactttatggtgtcttgccgtgctccactggtcccagaccccccatgggctttctaaggctctttgtggccccaacaaagacttatgcccaagatgtttctcagagccttttagcaatttgctattgcagaaacgggcttttcttgggtgcaacaacatttgtcttgggacccggattggaaatctcgagtgaccatgaatgtttctgtctcatgcaaggcgcaattggaatgccgccctgttgtaccagtgcctccggagagaattgatggtgcgcacccggggcacaaaaacacttcctcacgtgaatgcccctcggtattttacttctagatggcaactaacttcctgtctgtgtgaaggaacactcggaacgcacgcctgcctgacctatggccgcccgcatccccctgggctgaaatgggaaaaccgcgatttcgtgaggtggatgcccagtgtggtacactggagatttgctccaagtactatttatgacccagtgcccagacagatggctggatatggcccccattgagccagctccccagacttaccaaccggatctcgttagcggctatgttttggctgcgcttttttaggcgggaagacctatgtaagcaagagggcagggccggggtttgtggtcccccccccaccacacaaaacagcactttggcttctttaacctgtgccaacaggtgaccccccattaaatcctttgctgaga

SEQ ID NO: 708381 - DNA, 133 bp, Homo sapiens
ccgaccgatcgcgtttctctgccggtcgcaatgcgcaccgaagagatcgccgcgctggtcatatgacaatggctccggcatgtgcaaagctggttttgctggggcacgactttcgctctctcctcccctccct

SEQ ID NO: 708382 - DNA, 189 bp, Homo sapiens
cccccctcccccccccccctttttggtttccatggcccgcctgtaaaatgggggggtttttgtttcagcttttaaagggggggggggggtttttaaacccccaggaatggttgccccgtgacccatgttttaagaaggtttttttttagcccttttcttggaataaacatttgggtttgggtttggtga

SEQ ID NO: 708383 - DNA, 283 bp, Homo sapiens
ccgacttgagaaactcaaaaatgtcatccacaagatcttttccaagttttgggaaaatcacaaatgatttttatcctgaggaggatgggaggccaaaagggaatattttcctggagtacgcgtcccctgcccacgttttggatgctgttaggaacgccgacgtctacaagcttgcacaggcagcacacattccgggtcaccctctttccggattttgacatgtatatcgcgtcagtcacgattggtatatcccagagaaacagccttccaaagacctggggac

SEQ ID NO: 708384 - DNA, 200 bp, Homo sapiens
aatcgcaatacagagagcatagccaggagcttatatggccctggatggtacaggataatcacctgtagccgtgaacccagctgcttccattaggtggatcatttcatgcagtcaccagacaacgtagccaagcacaaacataccttgacagacacatacttgaacataagacagcccacatcgtaccccaggaaaaagct

SEQ ID NO: 708385 - DNA, 724 bp, Homo sapiens
ggttggtccgcgcgttgctgcgttgtgaggggtgtcagctcagtgcatcccaggcagctcttagtgtggagcagtgaactgtgtgtggttccttctacttggggatcatgcagagagcttcgcgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgagtttctctactctcaatttatcttccaacacatagagactgttgggtaagagagtgatgtcgtgcgagtgattgtcctcatatagtccgccactaaggaggtgctatgagagatcattcctcatacatcgctaactgtgtggacctctattcagctgctcatgtcagaacccaaccctgatgacccgctcatgggctgacataatcctcagaatttacactatcataagccagccttcctcaagaatgccagacagtggacagagaagctatgcaagacagaaaacaaaaggctgatgaggaagagatgcttgataatctaccagaggctggtgactccagagtacacaagtcaacacagaacaggacaggccagtcagctagtaggcattagaaaagaaattcatcctg

SEQ ID NO: 708386 - DNA, 607 bp, Homo sapiens
cgggggagcgatgacaatttttttttttccaggggaccctaccggtctgagggggaatattacagatgcggctacccgcctcctatggtgaggaacgaaggggactagcaccctaaaagaaaggtgtgccgcaaatagattagaaactggcttgagaggaagggataccaactttggaaccgagtttccaccccatgctgaatacggcagaagcgttgacgtaaacgggacagcacagctaggggaatctacaaagccggacatgcgaagaacgtaaggtttttaaaagaactgactctggaatctgggatgagaaggaccccaacatgtggtaaatttgcataagaacacttcttgcctctcaagaatcgagctgacctagggcgattacggattttttaataaaccgcggtgaacacaaaacgccttttgacgtcccatctctttctggttttaaatttgggggcctctggaaataggttttccttaaatgcaattgtgggggcgggtgcattcgggtaaagggaggcctttccccatgatttcaattataaaaacatctttgtaacggagttcgggttctttctaaaggcgcgcgtttttaagc

SEQ ID NO: 708387 - DNA, 574 bp, Homo sapiens
  misc_feature (272)..(272): n is a, c, g, or t
  misc_feature (276)..(276): n is a, c, g, or t
attcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaagaggggggggngggngggaatttccaaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacaaaaaa

SEQ ID NO: 708388 - DNA, 957 bp, Homo sapiens
  misc_feature (2)..(2): n is a, c, g, or t
  misc_feature (142)..(142): n is a, c, g, or t
  misc_feature (158)..(158): n is a, c, g, or t
  misc_feature (248)..(248): n is a, c, g, or t
  misc_feature (403)..(403): n is a, c, g, or t
  misc_feature (407)..(407): n is a, c, g, or t
  misc_feature (411)..(411): n is a, c, g, or t
  misc_feature (417)..(417): n is a, c, g, or t
  misc_feature (421)..(421): n is a, c, g, or t
  misc_feature (425)..(425): n is a, c, g, or t
  misc_feature (461)..(461): n is a, c, g, or t
  misc_feature (466)..(466): n is a, c, g, or t
  misc_feature (476)..(476): n is a, c, g, or t
  misc_feature (495)..(495): n is a, c, g, or t
  misc_feature (516)..(516): n is a, c, g, or t
  misc_feature (518)..(518): n is a, c, g, or t
  misc_feature (525)..(525): n is a, c, g, or t
  misc_feature (536)..(536): n is a, c, g, or t
  misc_feature (546)..(546): n is a, c, g, or t
  misc_feature (548)..(548): n is a, c, g, or t
  misc_feature (551)..(551): n is a, c, g, or t
  misc_feature (565)..(565): n is a, c, g, or t
  misc_feature (604)..(604): n is a, c, g, or t
  misc_feature (635)..(635): n is a, c, g, or t
  misc_feature (640)..(640): n is a, c, g, or t
  misc_feature (644)..(644): n is a, c, g, or t
  misc_feature (653)..(653): n is a, c, g, or t
  misc_feature (656)..(656): n is a, c, g, or t
  misc_feature (659)..(659): n is a, c, g, or t
  misc_feature (694)..(695): n is a, c, g, or t
  misc_feature (728)..(728): n is a, c, g, or t
  misc_feature (730)..(730): n is a, c, g, or t
  misc_feature (747)..(747): n is a, c, g, or t
  misc_feature (749)..(749): n is a, c, g, or t
  misc_feature (762)..(762): n is a, c, g, or t
  misc_feature (766)..(766): n is a, c, g, or t
  misc_feature (782)..(782): n is a, c, g, or t
  misc_feature (815)..(815): n is a, c, g, or t
  misc_feature (818)..(818): n is a, c, g, or t
  misc_feature (873)..(873): n is a, c, g, or t
  misc_feature (889)..(889): n is a, c, g, or t
  misc_feature (941)..(941): n is a, c, g, or t
tnacgggaggtctgtccgggaatcaggtgggcagcccctccgcggggccagggcggagacggggtctgtccagtcccccactcgaggggggggcacccgcctgcctggatttccaggaggaaggggcccggcgaggacaggnctgggcagcccaagcngaaagggggtgccggcgttcgggaaggggccgcggccggtccggggccgtcgcgcttgggggcccggctaagggagcccccaacccaggnagccagaaggagggagcaggggcacggcggggagaaggggcaggtcatccaccggggtccacgggaggaggaaggcccgggtggaggagcagagagcatggtgcgatcaccgcttgaagcggtaggtaaagggcagcagcaacatgctctacttnaacncctncacctncttnagcntctcgtcgtccagggccaaaaagcaacggcaggaantctcnaacagacgcnccttggaaaggtcgaactngcccacctcggccagcctctngngagccanaattaagcagnacggcgaaangngtngtcagcaccacggngtacctattcacgcggtggtacacaaaggcccgcgacangctcttgagcttctggaaggtgcccaggatnttctngtancggcagagnacnccntcggcgtccttcactcgctgactctcccgggcctnnggcttaccaaaacgcctccgactagcacctacntnctgcttctgccgcctcntntaactggcgctgncttnttcggacgctccgctngagggaggaggctgcagactcagggtccgaggnatngcccccagcaccaccacggctgttaccctccatccgccttggcccaggcttcacncggcagttgtctctgnctccatccgagcagagagatgaattagtcagcaggcacgcagaagtactctntcctcaagatctcgat

SEQ ID NO: 708389 - DNA, 843 bp, Homo sapiens
cattccttaagtcctaatgggaaaaaaaaaaaaaaaaaatgaaatatttgaaaaactctggggtgtaaccaattgattgtacccctacacctatccaataagtagtaaaaggagcatcacacaaattcagtctaatctggcccttctggtggggccataatataaccataattgtgtgtacctggataaaaagtcattttcttccaaagagactacagctagctgcactttggtgtagagcagcttctaaatggtcagacttggtgtggaactgtaatattctatttatggagaagtgattaacaatcattattttaatcatagaaatcagggttggggctgtatggatatggtccgatacatgaactggtcccacatcttattctaagtgggccaatttatttggggaacataacgaaggaacaataaagatggtttccccctgggaaatctaagtccttccagggtggggacgattacctgggttcataccccttttggcctgaataacaagtattcccatgtaggaggacctttatatcccttttgggatagaccgttcccatattttctggacctcaatattctcaaaatctctgtcaacgggtatacctggaaataggggctaccatacttaggacaagtgtttcgcccatccaccaaaaattattctgccctaattaatctttacagtttattcaaaaggctggtccggggatacaatgcgcatgggcgtccagatagcgggaaactcatattctggaccaatggacccaacggtagactccgggggagatacactccccatgccaggtataaacccagcccatttgctaaagaatc

SEQ ID NO: 708390 - DNA, 981 bp, Homo sapiens
gagccctgagcagcccaccggcgcgcggctagttaccatcacaccccgggagaagccgcagcttgccgagccggcccagtcaccatcaccgcaaccatgagcagcgaggctgagacccagcagcggtaccggcgacccacctgggctcgacagcagaaccttaagcgcgaggccgaagcatcgaggccccgtgccgacgtaggataccatcgagacgagacgagccgggcccgttgagaccaccggagccggacacccaccacactccgccaccgcgaggacccaagcgcacacccaccccgcacacaccacaacagagcccaacacagccacccggcaagaaccctcagggcaggcagcgccaccagccccacacgcgctcgccacagcagcacaccagcgacacccgcaccctactctcgcggacacaccatcgcaacagccggccactacagcacaccacccccacaacagcacgacgacaggcaccatgcgcaccacacacacccacacacctcggcaccacatacctcgtcacgcagcacacgacacaccgacgcagaggacagaaaactcaacccagatcggccacagacggcacagacacacacagaccgcaccagccactgcactgccgcaccaaaggcacacaatgacgctagccacagggcactcacaacgaggtcaccccaccaaccacacacacaacgaggccgacaacagaacaccatggcacagccatgcaccccaacacaccagaaggccgcgccacaacaccgcattcccaacaccagagcacccggcaccccccacgctaccgtccgcccaccacccaccccacgctccggcaaccacccaacccccacgcgcgaccttaccaccgcacaaaactcaccacaccacgatcagccggacgccagagcgacacaacccagcaacacaccagcacgagcaaaccaccactgagacacgccgcgcagg

SEQ ID NO: 708391 - DNA, 1169 bp, Homo sapiens
agtccatgtgatcttgggcgcgaatacttatgctgcttgcctatacccctctaacttggtcaacagcacatcacagggccaagccccaatccctggctatcatttattatatatgggctgctggtcccacagcacccactctccagccatattggaaacaaaaacagatgctattgttcttccattagagaacgtggccagtggagacggcacactgtgacaatccagcagtgcaatgttcttgcaacagcagggtcacggtgtcaaccaaggcccaagcccaacaggcatgccagtcagaaacccattttccattcagaaacatctttgcggcagtgcacagtcaggccttacagaccaactcccgatccctgcaccttgacggctaccactacacccattagttatagacagggatcgggcggggaggggtgtggagaagaaatgaacttgcctgtggccccccagtgctacccatctgacctacgctcacggtctgggtgccaattacatttagaaatcgatgatgctacagctcagccacaccatcacacacacttgcatggtacaaaccaggaaccagactcgcctacatgctccctgatggtccagatggacggaacacccccttgggattggctcaaagcgagtccagcgacttggcactttggggaccatccagggttagactgacattgaaataccaacaacaccccagagccctactcgggaagtagcagacccccgccgcaccatgaacataagcagccccaccgcgcaactgcgacacgcaccgcgcgaaccgaaactggcggctacgacggaccgcccgacctcaccgacaacacaatgccaactggggacccgctccccagcatggcgcgtgcacgcgacccacgacagccagcttgccgcgaccgaacagcgaaaaaggaggcgcaaccagaccccaccgacaccacctccaagaaaccaacacccccccacgaaaccaaagaaacaagtagaggcaaagaccaagcacacacagctgacaccaacacaggaccacacggacccgacgcctgaaacgaaccacgacggcagccggacgaggtcagcacgcgaaaacgacaagcgccgcgaccgaccactccaaactgaatacaagcaagcacagcaacacgaga

SEQ ID NO: 708392 - DNA, 155 bp, Homo sapiens
cagaggaacaggcaactggggtttaggcgattagctagggtcacacaatttaagtatctgaaacctgttttgaattcagatcatcttgactctctaggcccagaactctatatactgcaaaaactcccatcacacactaagataagctctatatg

SEQ ID NO: 708393 - DNA, 219 bp, Homo sapiens
  misc_feature (124)..(124): n is a, c, g, or t
caaacaatcaaggagataccatgctgtattaggaatcgggcaaccgtgtgagccatgtgagccctgtgaaaggttatggatctcggtagctcaagtctctctcacctctcaaaagaagaatttnttttttctattttattttttatttattatttatttatttttttggggagaaaagccctcactcttttcacacccaagaggcgggggggtggcggg

SEQ ID NO: 708394 - DNA, 822 bp, Homo sapiens
acttcaccttcctgagagaggaccagcggtcagagcctcagtgactgccaccctggcaggacaggtcacaacaaccgtttctggagagaatgggaggattccagaggggcaaatatggaactatggctgaaggtagatcagaagataacttgtctgcaaacaccaccggcattgaggattatcctagttgggcaaaacaggctgcgggaaaagtgcctacgatgggaacagctatccttgtgccagtcccgtgatttgagtccataggctgagggtcccagtcacgtgaccagtgacgtgccatggtgaagaacaggaagcatggaacgggaggaaagtcctggtggttgagcagctgctcctccatgcttgtgagtcgacagtgccgatacccaagagctgtacaagaactatcgtgggcactgtcgtacctgcgtctctgccccgggggccccacgtcctgcttctggtgatccaagctgtgggcgtttcactgctcaggacacagtggccatcaggaatggtgaaacgaggtctttggcgacagtgcgccatgagacatgtggtcatcctcttacaggccatcaaagaggacttagtggggccaggccctggcattgactatgtagcaatacgacggacaatctgcagcctgataagacctggtgcgggagtgtgagagaaggtactgtgccttcaagaactggggctctgtggaggagcagaggcagcagcaggcagagctcctggctgtgattgagaggctggggagggagcgagagggctccttccacagcaatgacctcttcttggaatgcccag

SEQ ID NO: 708395 - DNA, 483 bp, Homo sapiens
  misc_feature (12)..(12): n is a, c, g, or t
  misc_feature (26)..(26): n is a, c, g, or t
  misc_feature (78)..(78): n is a, c, g, or t
caaactgtaccngattaataaacctnttcccacaatatccagttttctaactccttgttgccgtacagtgtatgtttncttactcatacattatttaaatttctttaacctctgctatttatgctccacaagtaaaatgtacttagactggtcactgtattgtcccttattaagatgctgatattaatttttacagtttattatctatgtacaatggtaaatgataaacattttgtgtacctttgcaatatgtgtgttactgggtttacttcggattgatttctttctgaatagggtgtcttcatatggaaacctcacattacatcatttatatttggtggtctacatgtgattagagcttttatacattctgtatatttttattaaatgtaagacttttgcttctataatgttagaggaaggtagctcacacatgtatttataatttagtcacattacattaaattttagatttatgtaaaa

SEQ ID NO: 708396 - DNA, 480 bp, Homo sapiens
gcaacttctgccagctgtggctctgcctgatgacccttctactttgacaccgagttccgtcccgcacaccctaggattcccgaggcatccccccctgcgctggggcccatcagctgtccggggcttcgcttcgtggcaccggcctgatggaagactacggcaatcctcgtgccccgcaggcacccctgcactcggtggtacagcaactccatgggaagaacctggttttcagtgacggctacgttgtacaggagacaattggtgtgggctcctactctgagtgcaagcgctgtgtccacaaggccaccaacatggagtatgctgtcaaggtcattgataagagcaagcgggatccttcagaagagattgagattcttctgcggtacggccagcaccccaacatcatcactctgaaagatgtgttttatgattgccaacacgtgtcctggtgacagagctgatgcggggtgggagctgctg

SEQ ID NO: 708397 - DNA, 203 bp, Homo sapiens
gctgtggtcgctctacgagttcccccctggctcgcctggtctctcaaaagtgcgggccttacatggtgtgagccactgtgttccagtcccattgtttatcttattttctatccactttactgtactattcctactctctattctgtggtgtaccgcttgcgtgcactgaggtgcggaatgggtatcactgccttttgccttct

SEQ ID NO: 708398 - DNA, 221 bp, Homo sapiens
gcatgtattggtgtggtgacagcaacagtgacgaatagtacctacgagtatgacatgttcaatggataggaaccccaatgaaatgttcaagttcaatgaggagaactacggtgtgatgactacctatgatagcagcctttcttcttatacggtgcccttagaacaggacaactcagaagagtttcgacagaagagagctgcgtgctggccaagtttgagat

SEQ ID NO: 708399 - DNA, 770 bp, Homo sapiens
  misc_feature (147)..(147): n is a, c, g, or t
tgttctcagtacaggtgtaccaacagtacgttattgcaccacaagtaaccagtccctcacttctgtgccaccaatgaatccagctactacattaccaggtctgatgcctttaccagcaggactgcccaacctccccaacctcaaccncaacctcccagcaccacacatcatgccaggggttggcttaccagaacttgtaaacccaggtctgccacctcttccttccatgcctccccgaaacttacctggcatttcaacttcttcccctggcattcgaattccttccggtataattcccttgggtcccaagaagagctctttctgcaagcaaggctccagggagagctggttgggttttcccttccgggcccaacaagacaaggcacccttctgaccctgccacacatactgcaaaggcagacgctgcctcctcactcactgtggatgtgacgccccccactgccaaggcccccaacaccgttgaggacagagtcggcgatccaccccagtcagcgagaagcctgtttctgcggctgtggatgccacatgcttctgagtcaccttaactttgaaccattctttggacttggcgtgctatatttaaccacggagaagcgtgtctgcaaacgcacacctatcattaattcatactagtatagtcccgtatctggtaagctccttgtccattattccacggggacatacacacgaccggctgtatccggcacgtgaatgggtcacagcctagtgcatgacaaccgctgcttccc

SEQ ID NO: 708400 - DNA, 182 bp, Homo sapiens
ggatacaggtgtgaagagtgagccggcctaggaggtgatatgggcggagaagacaggctaagacccaagatcggtgcccccaggtgtaacagtcaagtcacaccagtgtcacactggtgcacagcagcctagcacggaccgggcggcagctgccaccagcacctctcacatcggcttcccca

SEQ ID NO: 708401 - DNA, 122 bp, Homo sapiens
gaaaccagctcatgtttaattgtggcattatacaaaatgtacaggtattatgacatcagcacaccacagttagtctctcaaaatgacagtaaaacatccaatcgcaggtttaatacattgac

SEQ ID NO: 708402 - DNA, 156 bp, Homo sapiens
  misc_feature (27)..(27): n is a, c, g, or t
ccctttaaatcccccttgtaaatttanctgttagtccaaaaaggagttttggcactaggaaaaacccttgtagagagagtaaaaaatttaacccccatagtgggcctaaaagcagcccccaattaagaaagggttcaagctcacccccccctccca

SEQ ID NO: 708403 - DNA, 148 bp, Homo sapiens
gaaaaaaaaagaacgaaaagaaattctgaaatgcttcaaaatcccaaacttttcggagtatcactgtgacactcaaaggaactggctgcactgggggcacttcagaattttcacgattatgggatactccagctaatgataagttata

SEQ ID NO: 708404 - DNA, 147 bp, Homo sapiens
aagaagaacgtccagaaaaaataccagatttaaaattattggtggagaagaaatttttggctttacagagcaagaattctgatgcagactttcaaaataatgaaaaatttgtacagtttaaacaacagctgaaagaactaaagaagc

SEQ ID NO: 708405 - DNA, 302 bp, Homo sapiens
ccccaaccccccctgggtttttttttttaaaggccctttatttgaaaaagggggggggggcctgggtccctccccggggggggggatttccagggggcccctttttttccctttttggggggagggggccaaaaaaaaattccttttttccccccccaaagggggaaaaccaccccgtgccccctggcccttttgggggggggggggggggggggggcccctcggggggggcgggggtttttgggggggggggaacccgggagggttcccttttccgccaaattttattttttttaattgga

SEQ ID NO: 708406 - DNA, 780 bp, Homo sapiens
gcctgctgctcctaggaccgtctccagctggctgagatcctggactgagggggcctggatgccccctgtggatgctgctgcccctgcacagcaggctgccagtgcctgggtggatgggcacgccttggcccagctgatgccatccaagttgtatattttttaatctctcgatgaatggactttgcacactttggcccaggtggccaacctctatcccggctttggtgcggggtacacaagaggggatgagttgtgtgaataccccaagatcccatgagggagatgcatgagccgccaaggccttcccctggcactggcaaacagggcctctgcggagcacaactggctcaccccagtcctgcccgccaccgttatcggtgtcattcacctttcgtgttttttaatttatcctctgtgatttttctttgcttaatgggttggcttgttttcttgcatggttgggagctgatcgttctcccccaccccctaggggtaccagcaggcaagagctttgccctctgctccagggctgggggtccagtggggaggggcccaaagatctctgctcaaggaggaaagtgcaggggagccttcaagctcactctccctgaggactgcttgacagggggctatggggtttgcttggtgttgtcttcacacacccacgaaacatatttctttttggaaaacaaacgactggcccaatcccgggtccttctccctgatgcgttggggcagctcaccttggttgttgtttactccaaaaacaaaaaaaaacac

SEQ ID NO: 708407 - DNA, 351 bp, Homo sapiens
taagatgatatagcacagatgtcagataatagggacaaacctactcatccacaggttacaagattttagtattacagaaaacatttttaataaggatcccctaggctaggggatccttattaaaaataattgtatttttactgccttctagtctatctgtttccttactaatattctctcttgttttattacagaaagtggagtattgaaatatcctactataattgtattgctctctttgtgtttattcagttttgttagtatttgctttatatagctgaaaccccaatataagacacacacacgtaaatacacacatatatatacaaatataaaataaggatcccctag

SEQ ID NO: 708408 - DNA, 399 bp, Homo sapiens
  misc_feature (16)..(16): n is a, c, g, or t
  misc_feature (49)..(49): n is a, c, g, or t
  misc_feature (395)..(395): n is a, c, g, or t
ccgggacaaacattanagaaaaatattgcagacacgtatagcttaaccnccaataaataaactgtaaatctctctctctctctctctctattttttttttttgggggggggaccgagtctcactcttgtcacccagactggagtgcagtggtgtgatcacggctcactggaacctcaacctcctgggcttaagtgatccttgcacctcagcttcctgagtagctgggaccacaggtgcacgccaccatgcttggctaattattttattttttgtagaggtggggtctctccatgttgcccaggctggtcttgaactcctgggctcaagagatcttcctgccttggcctcccaaagtgctgggattacaaatgaaagccactgtgccctgcctagnaaat

SEQ ID NO: 708409 - DNA, 889 bp, Homo sapiens
ggtttattattttttttttaaattcacactttttttaaatctgggtaaaaacagcatcagaaaacaaacttcaatctagaggagaaccaaaagcagggaaatgggcagccaacttattcccaaggccaaccgtgttcacagaaggaaccttggggtcataccacccctagggctataaagtgtatctctaaaaaggtttcgtgggagttgcaactctcaacaccacaatcagaaaataacactcgaaatcagcaccccaaggagttgacatctgtagtttaaagaaacaaaaacaaatgggacgctccagaatatggaatattgacaatatcaatcactatgatatgacagccggccatcaagttgggccggacccctgctggggtctaaagggaaatctggtcattgggggccagcactcagccctggcaaaatggggtaaggtcctggaattggggccaatcgggatcaaagcgtaggactacagtggaggaaactggctgggcgtctaccccaggaccaggaatgagtgaactgatggggtactaccaacatagaggacagtgtacgagacattgggaccatattacaccgcccgaaataataccgtggaaggacaggacggagaagcataggacagtggccaaagggtagcaaacgaggaaagacaaaagaaaaggacacatgcgtggtagatatgagcacaaaactgagcagagacaaaatcataccagaacacgggccatataaagactacaatacagaatagctcagagatatagaacaccaacaaatccacggtacccagaacatgtaacagaaacatgagattatagcacaatacgacaagaaaatagagatacaaaaatgacaacacaaagatttaaaa

SEQ ID NO: 708410 - DNA, 347 bp, Homo sapiens
ccatatcaagatacgctcatggatgtggaagccaagaacaaactgaagtccgaatgtatatatgacttcattccagaacgatcttagttcttatgaatagctatgctagttatctcgactatcggaagtcaatagtacagaagctggtatttcctttatgctaagctataccagtgctaaggacaatcgacaacagatccccacgctagtgtattctattgtgggtctactttccaatgcagcgttcacaacagactattctcagcccactgttcctagtcctgtaacttcaactcttcagtagctggaacttgttctattttggttaattccttagctattgtaat

SEQ ID NO: 708411 - DNA, 427 bp, Homo sapiens
acgtaacccatcactttggatgccgttcgtggttgccaaaatgttaccggggggtccttgctcacagagctccaagatggtggtgaaccacttccaagatggtagcaggccgcttccaagatggtggcaagcctcgtattctctgacctggagttcttggcctcacggattccaaggaatggaatcttgggccatgtggtaagtgttatagctctattagaagccgtgggtcacagaccgagaaccatggaagccagtgactagtgtacagctcaattagagacaaggtagagccgagggacaaggtagagccgagagacaagggtagagccgagagacaaggtagagccgagagacaaggtagagccggagagacaaggtagagccgagagacaaggtagatgctgagagacaaggtagagccgag

SEQ ID NO: 708412 - DNA, 1126 bp, Homo sapiens
ttttttggttctaaagggggtaaagggggtgctatagggaaaattcgggcccttattttcaaaaatttttatgggagaatttattctcttaggacagatgtgggcattgaaacgtggtggttggctctccaacaaattttcaaaaacattgtgaccgttagttttcccccgcggtgtcgtgtgtataaccggtgatgacaagaggtaggtatgtgtggtttataaacagtctccggagaccattgtggcctctctgtgttttatataacccctataaggtgtgggaacacaagctctccagtgagagtgtgacaagacgaaacagtctctgtgtgtgtgaagttgttaaattctattatatatatcaacaaatgtgagggggggctctctcaaaatctctggagaaagatctaactataactcctcgaaagtgtgctcaacagcgcctctagaggggaaatctcacacaggggtcttccccctgtgtgtttccccatacgcgcaatcttatatgtgcggggggaaaaagtatttttgtttcacgagagatttgtaaaaaaaaatcttctagtcttcccgctcgcgatatatgtctccgagggtgtacttacacctgcgcgactaagcggtcgttctcacgggatacacccaaaaatgtgggcaatgttggcccccaaaaagttgtagacaactatcgcacaacatggggtaataaagagcggatactaaggggacaactactgcgtgtatacacacccctattcgcgactaactgttgtgtactccagatgaatcacaccacgacgtcaacttcgcgatcaattcgcggtggattattgagtagaaaagatggggcacacacataacatcgaggaaactctacacagcgcatctgcacacgtaaactgtgggctccacacgagatacatcatctctcatccccaaccacccgcagtgatagaacaaaaagttatccaccctacttcgcaccccccctcatacctcaacacaaacactgtatctcgcaatatattttcaccgattccaacacgaataagagaatcaccaatacaacactggatttcatgccacaaaaaacaaggcgagaccattaacaacgagacct

SEQ ID NO: 708413 - DNA, 168 bp, Homo sapiens
  misc_feature (150)..(150): n is a, c, g, or t
ctgatgtccagcacacaaacaacaggccacaccctgctgcactcagctttctcccacagacgtgtattttggcgtttctcatgcagtagctcactggctggaatgggttcccaggattttcccttaaaaattcccatttgctcttctganatgccttataaaggatct

SEQ ID NO: 708414 - DNA, 209 bp, Homo sapiens
  misc_feature (3)..(3): n is a, c, g, or t
canacattaactacttgcatgcaatctaacagcaagatatataacaataacgagtcctaagatgagcctcaccatgtatttgggcaaacagtattccccgttcttctttctatactgcttctatcagcaggcttcaacctccataatctctaacccccttctgtttggaccccataccactatcttggcccacatagttcagcgtctga

SEQ ID NO: 708415 - DNA, 728 bp, Homo sapiens
agcggagcggcggggatggcgagcagcggaggcgaggcggtgacgagagcagcggctccgccattggacgaggaggcctgagtggacgggccagtggtgcacaatgaagagacctgaggcgggtggccccgagatgagccaggccatggatgtgccaacatgcctgaagcggaaggagcctggcaggtctctccgcatcaaagtcatctccatgggcaactgccgaatgtggggaaaagctgtattataaagcgatactgtgagaccagattcgtgtctaaatacctggcaacaattggaattgactatggagtcacaaaggtacacgtcagtgacatgagacatcaaagttacacatccttgatatggctggacatcccttcttctatgaggttcgaaatgagtttttacaaggacacacagggtgtgactactggtctatgatgttgggcagaaacgactcctttgacgcccttgatgcgtggctggcagaaatgaagcaacgagctttggcacctcatggaaacatggaccactacttactatttgtagctttgtggccaaccaacgacttgacttgtaaccaaacatcggctgttgtagactgaccagtgacggacgctctttgcggctgtcacgcaccaggggtccctgttaccttggaacgcttcagcaccaaacctggccacggccatcactgatcactgtccagaacctttatatctccg

SEQ ID NO: 708416 - DNA, 277 bp, Homo sapiens
  misc_feature (254)..(254): n is a, c, g, or t
gctcgacagaacttgccacagcactctgataaagaaatagctttaaggctgggcatggtggctcacacctgtaatcctagcgctttgggaggctgaaggtgggaggatcacttgaggtcaggagttcgagaccagcctgaccaacatggcgaaacctcgtctctactaaaactacaaaaattagctgggcatggtggtgcatgcctgtaatcccagctacttggggagctgagcagcagaccccttgaaccagngaggtggaggttgcagtgagcca

SEQ ID NO: 708417 - DNA, 203 bp, Homo sapiens
accggcatctggacttttcagaattgatcttaagtctactgtcatttccagatgcattagtttgtacagactgtagtccttgcgaaatatatttctagggatgaatattattgatcgaacatatgttaatagccgtgagctcgaaatttcatgcagactgtaccagtcattatgtatcagctgcgctagcgaaactgcatacg

SEQ ID NO: 708418 - DNA, 490 bp, Homo sapiens
  misc_feature (31)..(31): n is a, c, g, or t
  misc_feature (38)..(38): n is a, c, g, or t
  misc_feature (45)..(46): n is a, c, g, or t
  misc_feature (58)..(58): n is a, c, g, or t
  misc_feature (61)..(62): n is a, c, g, or t
  misc_feature (322)..(322): n is a, c, g, or t
  misc_feature (345)..(345): n is a, c, g, or t
attcgcggccgcgtcgacgtacaaggccatngagatcntcaaacnnggctgccgcctnggnnacatcggtgaaatcatccagaagcacgcggaaaagaacggcttctcggtggtgcgtgagttctgtggccacggtatcggcaaggtgttccacgaagaaccgcagatcctgcactacggccgcgccggcaccggcatggaactcaaggccggcatgaccttcaccatcgaaccgatgatcaaccagggcaaggccgacaccaaggtgctgggcgacggctggaccgcgatcaccaaggaccgcaagctgtcggcccagtgngagcacaccctgctggtcaccgncaccggctacgagatcttcaccctgcgcagcgatgagaccatcccgcgcgtctcggcctgatcgcttgcacctgccgctctgtacagaacgcctatcagaacccaaggaaagccaatcgatgccgcaggtggaccccggtcgagc

SEQ ID NO: 708419 - DNA, 260 bp, Homo sapiens
  misc_feature (123)..(123): n is a, c, g, or t
  misc_feature (131)..(131): n is a, c, g, or t
  misc_feature (167)..(167): n is a, c, g, or t
ctatccaagtagacaattagaataaaacaaacaggtctttggtgctgaaagactttgagagattatcaggtacagcagttgacatataggtgatgcatcagaaacaaccacagagcttttaanaagatacnaccttagatatatcaaacgcagaactatatatcaanaccagaaacttttgggcgatgtcgtccagggcatacattagtagtttgaaacaatgagaaattcccatttttattaagtcgaaaaagaaaaaa

SEQ ID NO: 708420 - DNA, 501 bp, Homo sapiens
taaaaggcatgtgtagcaggtgagtgataacagccgttaggattttcaaagcaggctgtgggatgggatattggcgttgagtggggtaagcgccgattaggtttaatgagatggtaagggttgcatgatcggtcgccaaggagggagtagaggtatcttatacttgtgggttaaggtgggggaatacaagaggaggacgcaagggaggctttgtattgggaagaagggcagcaataagatgcagctgtagtccaggaatagtcagggaagcagataatttggttaaaatatctcggcctgataagggaactgggcaggtggagataactaaaaaagagtgcataaaagagtgttgttcaagttggcaccagagttggggagttttaagaggtttagaagcctggctgtcaatacccacaacagttatggaggcaagggaaacaggcccttgaaaagaaggtaatgtggagtgggtagctccatattgattagaaggggacg

SEQ ID NO: 708421 - DNA, 185 bp, Homo sapiens
catgctagagcacagtgcatgtgcgggaacacacacgtgcaccctgagctgctggcggatccagagcatctggtcccggctgcggagacaggcctgcttagcaagtgcgagcggatccgaggtcgcagagccacgctagtatgagatccagatcagtgcactctgacataccacagccctggctc

SEQ ID NO: 708422 - DNA, 495 bp, Homo sapiens
actcgcaaccctgcctcctgggttcaagtgattctcctgcctcagcctcccgagtagcaggaccacagtggtgtgccacccgcccagataatttttgtatttttagtagagacggggttcaccacgttggccaggctggtctcaaacttctggcctcaggtgatctgcctaccttggcctcccaaagtgttgagattacgggcgtgagccaccgtgcctggccggaatattctattatagatgccaattaggtcaagttagttgatggtggtgtacgtcttctgtttcttcattgagttcctgtctacttattctatcaattattaagaaagaggtattgaaatctccaactataattgtgaatttgtccatctctccttgcaattctaccactttttgtatcatgtatttggaagctctgtcattaggggcataaacgtctaggattattgtcctttgaatgaactgacatatttatcattatgataccgcgaa

SEQ ID NO: 708423 - DNA, 331 bp, Homo sapiens
ctggcatggccatcggcggacgtcaccctcctgagtggatccagacccagcgtgctgacctggagaagctgacctccctcttctgaccgttacgtgagtcactatgagaccgaggggccccaagttctgctgtattttgacttcagatcccacctcccgggagtgcgtgggctttgaggctgtgcaggaagtgcccggtggggctggtgcagccggccagcgcaaccctgtacgactactacaaccccgagcgcagatgttctgtgttttacgtggcaccaagtctgagcagactcttggccaccttgtgttctgctgaagtctgccagtg

SEQ ID NO: 708424 - DNA, 685 bp, Homo sapiens
ccaatgccgcaggcctgattaaggcgcggactgcgataattagccaatcacggatagcaagctggaccgcttgcacaatgtcatgatgatcaagttactgatggataactggatcttgtccgtgcctatcaatgagatcacgagcattggtaactttgtactagtctctgtaaagcttacgcggctgatgatcatgcgagagcatgagcagagacgtgtctgatggcggacccacaccctgtcatcacgtgatatcagtctcaacaatcttcaccgtgcctctggctaacaagggctcgcggcatatcggacgtcaacatttctctacacagtgaccttgggcatgcgctattatactcatgctcgcattggatactaagtctacagagcgtctatcctgacgcgaggccttagatgattgcgagctgctaccgctactgcctgctacgtatccagcattccatacattgtagcggaactagctcagcgaatctgcctaagatgcttattaaacagtctgcccctgacacgtgattaaactatcactggacttacctgcatcatggcagacttagcacgatccacttggattatcgccaggacgacttctacatgcccctagacattacagcatacgattctgtcacgatactagtcatcacgaccccttggttacttcttggcg

SEQ ID NO: 708425 - DNA, 412 bp, Homo sapiens
  misc_feature (1)..(1): n is a, c, g, or t
  misc_feature (79)..(79): n is a, c, g, or t
ntttggaggacgaaggcacctacgttcaaactctggcgttccgtaggggaggtgatgaccagccaagacgatccactcngcggggcggggggggtacaaccaccccgggctcggaactaataggaaaagactctttgtgaagaaacgagccagtgactgaaacaccctggtgaaaacctgttgacagaccttccactttctcttcagaataagtagctgtggtggatattattatttgagggagtggggaacagattttagggtggaaaaaacagtcaactcacacaaggaatggaaaaaaatactgagttaaattaagcagataccttttacaagtgaaaggaagaatttttcttctgccgtcaataaaaccattgggctaaaaaagaaaaaaatgggctcgttggcctaa

SEQ ID NO: 708426 - DNA, 86 bp, Homo sapiens
ggaacgctgctgggagacggcgggatctctttcgccatggctgccgggccgatctccgagcggaatcaggatgccactgtgtacgt

SEQ ID NO: 708427 - DNA, 675 bp, Homo sapiens
  misc_feature (432)..(432): n is a, c, g, or t
acactagaaatattgataagtggcaggttgcgtgcaccgcacatgcctacacaaacctgtttagacacgcgtggttcggacaaaccattattgcccatgataccccagtgaattctgggaacatatggggcaaaatagtaagccttggggcaagccttcctctgaaatgttacaggctacggctagagttggttttcaggaccgaagactgtggtaactggcatacgttagcaggatcacttgaagactgtggcccgtaaaagatggcatatgtgtggctgacactgaattcggccctgcatactgtgaggtctctttacagaatggactaggtttacaaccggaacaatacaaatgttaaccgtgcacgcatgcacaatgctataaaattggtgctgctgttgacggcacatattgtagacgcatgcgtgncctatttttcattgagaacaacatgacattaagggcatggggaattgagtaggctctatacttataacaaaatttcctggtgctatgaagaactgaacacgagacctttttagataacatcataatccacacgtttagggttgaaatcggcattgatatttggaaaaagatgggggtttaaaaagcgatttttctttcccgacagacacctgaggggcctgtggtagccggaattcgtttttg

SEQ ID NO: 708428 - DNA, 80 bp, Homo sapiens
  misc_feature (59)..(59): n is a, c, g, or t
cattcatgggaccactgaagaaagaccgaattgcaaaggaagaaggagtactcgcgggngggtatcacgaactcttcttg

SEQ ID NO: 708429 - DNA, 130 bp, Homo sapiens
gccgagtgagactgtgttctcaacccggtatggtggtcacctttctccagtcaacgttacaacggaagtaaaatctgtcggaatgcaacatgaagctttgaggtaagctctttcttgggacaatgtgtgg

SEQ ID NO: 708430 - DNA, 314 bp, Homo sapiens
  misc_feature (59)..(60): n is a, c, g, or t
cccctttttttttttaaaaagggggggggggggaaaaaaaaaggttttccccccccccnngggggttttttttcagggggacccctggggaaaaaacccccccccccttaaaaatagtttttttttttggccccccccccccccttccccccagttttggtgttgggttttggggtttttcccccttccgactggttttttttggggcgtgttgtttccccctttttgggggggaaaaaaaggggggggggggggggggtgggcccctttcccccccttttttttttttaaaatccgtggggccggggggggga

SEQ ID NO: 708431 - DNA, 282 bp, Homo sapiens
atgaatatcactatttgttagctattaatttaaacaatagagacattagcttaacaagtattttacaagttcttcatgcaagaaaaaaacatgaaagtgaaacagacattcacttctctggaaataattcagaaaagccagtagtgatcgaaaaggacatacatatacaagacaacagagatgaacatgaacataatctgcacctttaatataataaaggaattcagttaaatctttctgtgtggtccctaaaaagtccagaacagaaacacctcttttcaa

SEQ ID NO: 708432 - DNA, 2625 bp, Homo sapiens
tcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcggaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcttcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaacagagggtcagtttactctgattggcatagtactgggtctggctatttacaataactgtatactggatgtacattttcccatggttgtctacaggaagctaatggggaaaaaaggacttttcgtcgacttgggagactctcacccagttctatatcagagtttaaaagatttattggagtatgttgggaatgtggaagatgacatgatgatcactttccagatatcacagacaaatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccgcaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaa

SEQ ID NO: 708433 - DNA, 810 bp, Homo sapiens
  misc_feature (30)..(30): n is a, c, g, or t
  misc_feature (32)..(32): n is a, c, g, or t
aagcacccatcacataccaaacgctcatcntntttcaaaacgagtttaagcatcgagtgactgacagaacatcagcctacataattttacttcattgacgtggaaaagcactctgtgaatttttacagcaagattctaactaactatgaatgactttgaaactacttatactttatactcataaaaactattgcccgttgctaatttgttcatacccactattggtgaaatatttctgcaaattctgatatatgatcttcgcgtaaaccctaaaggttaaacctaagccctgcgggaaaggcatttcggtgggttgtaggaaatctatagcactaccttaatgtctctgcgggggcacgccccggtcgcgactgatcgtcacatcacataaaaaaaacactacccgtctccacgatataatacgcgtatcccctaagtccaattattaacatgaaccacccactctcaccaaaaacgctcgaaatggctcacttagatcattacagttcgcaaattacccccccacaccagaaacgtgcccacagacaatctaaaccacactcacaggtataactgccaatcataaccacccccgcacaagacaacgtacacatatttcacaattaccacatcacacataatagcatccggaacacctcattgtctccctcccctctctcaaaccgccccatcccacctctaataaacccccttatcaagataacacaaaacatgctgtaataaaacaaatctctcaacatatcagaacataacttcaatatgattcccatatatacacttcaaaactta

SEQ ID NO: 708434 - DNA, 218 bp, Homo sapiens
acgatccttagatctttgagcatcaccccatcagatggactcatgggatgtagattcaccacacagagttccggcattaactgcatcatgtataaaataagtacggaaaagtaaggcaggaagattgcctgagctcaggaagtggtaagaaaattatactgcagagatcatgccaccgcactccagcctgggcgacaagagtgaccctctgtctcaaa

SEQ ID NO: 708435 - DNA, 899 bp, Homo sapiens
ttctcctcttgtgggggacaattttttatacgcgatacgtggtcccgtggaaacaaagttggacgttgacttccccttggcttgctagatgggtcagcgacctcccggcctatgttcccccttccgtgtgggcgcggcctcttttggggcctccggaacgcccctaaggttgtggcgcccagcgccctacaactatgttttattagtttgactcctcgccggagagcataactactcagcacggggtactgaattggctgcactcatcctacgcgctcctgggtttgccttctgctcgctcacaattgccactgctgtcctgttactataaatcccctctctctcaacaaacaggctttctcttagattagcttttatcactcccactctagtaagggcttctatttcaggcgtcttttttttcaccccagcgacgctcttggcttttacgcgctgactcggtaaacctctcgctcctcacgttcacatcactcgctcgctgtggcgaagacactcgactcactctaggtcactggtgactaccgcctgctcttcctcgctgggtccctcacagacaagtcccgtctctctcactgacctgacgtcactcggccactcacagagcacactattgtgttcgcccccccacgcatgaaactcctgtctacatacaactgttttcacccacgactcaccttatgggtgcacaccttcccgcctcacccacctatgtccacatactatggcaatcctctctcgttttaccacactgagatcccaccttcgattatttctaactcacctcgtcttacccccttgatcattcgctcctcattgctcctactccaccacgactactaactataaccgaaggttcatccccccccaacatagacgca

SEQ ID NO: 708436 - DNA, 900 bp, Homo sapiens
  misc_feature (886)..(886): n is a, c, g, or t
gcaatcacagccaaaggcgcaacaataatcgtgtattaacccgatctggctgtcctgccaggattgcgcgtgtgacgacacccgagtgattcaactcttgaccggcagcagcatgtggttgtcctaatcaacaaagacattgccagcgctgcgtggaatatgagaacatggtgaccaagatacgtgcccagctggaggagaccttgtcggccattgtggtccagtcggtggacagcaactggtatccatctatgaccccagcaaggagcccgctttggtgttcttcaggcgaggaatacccattctataccatggcgagatcaacgatgacgaaatcctagacttcttcaatgacaacttagagccagcggtcaaagagctttccgacgacaacttcgagcacctgactcaagcctcgtcgggtgccactaccggggactggtttatcttcttctcttcggccgaatgtaccgtctgtcagcgactctatgccgtttgggagtctgtgggcggaaagctaaagcgaaagctgaatattgcccgcatgaacagtttggagtctggaatctcaactgctacgcgactgggagtattggaagcaccggcttttattttcttgaggcaaggaaagatgtacaaatattcagccaagcaatacagtcccgaagcctttgtccagtttgctgagaagggatatacccagagccatcctcaaccagtgcccgcaatcccaagtgccgtaaacgaatttttgggcccactgcaaagttattttgcagctgaaaacataacatcgctggcgactttgagtattttcgccttagttgctctcttattcgttggcaaaaggtgccaaaatattcagttcagagcctgcgaaactaanataagtcgataact

SEQ ID NO: 708437 - DNA, 1269 bp, Homo sapiens
  misc_feature (788)..(788): n is a, c, g, or t
ttatgtcctgcccgactgagtaacgttagtggggtggccccctggccgacgtgtgtgggggcccagagtgtgccccggtgtcttccgccctggaaagtcggttttcgtggtgtcccgacagggtccgcctttggggtccccaccagtaacctgtccccgtttgtcttgctaggtggccctggtggcaaccgctggtgtgtacacccgacgaaaaatgtcggtgtggacccatctaacgatgccgagagggttggttgcccctgtgtggtgggtgctcaggggtcgcgtgcgtgttggtgtccgggcctttaatttatgtgtgacccatgccctagcgtgataccacagagtgcgcgtgtgcccaagtttccgccgttagcgattccccgtgcggtcctggggaatccgggagcgccgtggacacactgcccaatcgtcgtaggagccacaggattggaagcgccttggacatcgcctcgtgtgcgtcaacggcccattgcgggggtcaccacagactggagggtgtggccctctgggaccaagaatgtaatggggccacatggccgtgcgcgctgtgcgttaggtgtagaaaaggactctggacctattgggcccctctgtggtggagactgccacagggtgtcccaacgggaagcccttggccttgtcgtgacaattacttgtgggagatgccacattccacgggaccacgcccggtgattgtctgagaggtcccagcgcgccacataagcgttcccctggcgctccctcgtttgctttcgtcgacnctaggcgcacagaagggctccccacagaggttgagagctttgtgcctctagttctgatgagaacacactgtggaaagagtggcccacaagagagcctcggagaggcacctcggctgtgcctctcgctggcacgagaaccacgctttctgcctccgtccccgtcacgccctctgtggcccacgcttccttcttcaccactgagagccccctcggcactcttgctcggggaacgggaactggcctggtaacttgctcgttagggcacggaaaggggccaaacggaagaacttgggtatgtaattctgcggggttcacagaatgggtagcacctatagccacagctggcctaaagaatgcacaataagttcctataggtaagtctacccttacaccctgaggaatgggaaaatgaacctcagccccttaggccggaaaagcttgatatttaataaaccaggaaacgagtgaactgagaccccca

SEQ ID NO: 708438 - DNA, 130 bp, Homo sapiens
ttggagtgaaattccacgtcatcaacgaggacggaaccacctctggtggcccgatgtactacctgcgtgacggtcttgcgtcgatcggtaaacccacattgggccgcgtccttgcttccctcttcgccat

SEQ ID NO: 708439 - DNA, 192 bp, Homo sapiens
ctactctaaattcgcggccgcgtcgacataggatcctcccgaatcaaccctgacccctctccttcataaattattcagctccctacactattaaagtttaccacaaccaccacccacaagattatttttcacccaaacctcaaataaatcccctgcgtttttgtcgacgcggccgcgaatttagtagtagta

SEQ ID NO: 708440 - DNA, 285 bp, Homo sapiens
agcactcctttcctggttgcagaaccgatattaaggttgccaaaagggcagatatgccctttccaagttttggtcgtggcaagcagggtcgtggtgaaattatgcgctggttttggatgggagcactcaaaaggcattggttagagattgaagtttcaagctatttatagtttttcaatgggaatatatcagttagggagaaaccatcaagctcagtattattgtttgatctgcaggtgtagtctgtgaatatttttatacatctttttcaaattatgaaaaaaa

SEQ ID NO: 708441 - DNA, 668 bp, Homo sapiens
  misc_feature (364)..(364): n is a, c, g, or t
gagcggggcctgcggggcggggcctgggccaagcggccgcaggaggcggcggtggcgttcagtcccttgttccccgccgcgccgtcgctgacccagcccgccaggcgctcctgaccgtcgcttcctccggtcccaggtccccggcctcgcctcagtcccggcccctgggtccccagccctcgtcgcgagccccggccgcccgcacgccgacatgtccaaggaggagcgcccctggtcgggagggagatccgtggagtgccaggtgatgtgggagcctgacagtaagaagaacacgtcagatgtgaccgctttccgggctggttgtggggctgccgcctgtccggccattggaccgctggagacnttagtgatgacttgtaccattggtccggtctgagtcatatgcagacttctgggcagagttcttggcaaaattcagtggaattgtcttctcacggtgtgtatgatgaaggttgtgagaccacattcgaaaagcgaatcgccagatgttccgccgcaggtggtacaaaaggcaagtcggctcagctattgcaggaaacacctcctgccggcacaacgagaatgacagagttgccattaacgttgcaaagggaaggcaaaacaggaaatcgtgagagtgcacttaagaagagctgaggcacacaagc

SEQ ID NO: 708442 - DNA, 124 bp, Homo sapiens
ccctgcattagttcacttaatagtggcttccagctccatctatgttgctgcaaaagacagtatcctaagtgaactaatgcaggacagaaataccagacaccacaggttctcacttataggtggg

SEQ ID NO: 708443 - DNA, 320 bp, Homo sapiens
  misc_feature (18)..(18): n is a, c, g, or t
ttaaaaaaaaaaaaaaangggttttttccccgggggggccccccccccccccccgccacaaaaacctgcctttaataaattttcgccttgccggaaaaattagggttgggccccccattttttaaatttggtttttaaggtttgcccctttggtttggccccccaaaggttaatttgtttgtttttccccccaaggtttttgggggggggtccaaagggggtccccaaatttttttttaaaaaaaaaaccaaaaccatggttttttggtaatccgtttgggcccggttttttagggccttttaacccaagcccatttaga

SEQ ID NO: 708444 - DNA, 1241 bp, Homo sapiens
acctagcaggctgtctccatctactcttaggcggccatcaactttcactcacaaccaattatcaactactaaaacccccatgccataacccaataccaaacgcccctctctcgttcctgactccgtcctacatcacacgcagctcctacttcatcctatctctcccagtcctagctgcctggcatcactagtactactaacagaccgcaacctcaacaccagccttcttcgaccccgccggaggaggagaccccattctataccaacacctagttcgtgcattctctccggctcacccctgcaaggtttagtatgtctctactccgtaaccagcgccttcgggacatacatctacccactactacgtcaacctctacctacctccggcacaacaacaagaaccatctaggactacataggctactgcgctctgagctactgactactcacacttggaccttccctagcggctcttactcgctgctgagccaccacccactatactcttcacacgctacgcgcacactacgaacagctacgcacacaaccgacgcaactactctctcacccctccgcctaccccactaacctcactcagctaatccaccccacccgcgccgcctcaacaccctcactcccaacgcctgcacctcgccccacaacctcccaccgcgcacaccacacctcatcgcacccactgcactcctcggcctgcccaacccgacttgcttgcaacgccccctcacgcatatcaactcatctcccctcactctacaccccgatcaacggctggcccctgcaccttgggcattcgtcatttaggccaacggtccatccacttagcaccaatccgtaaccaccaaccgaaaccacggttactcaacgctaggtaacacgcccaagctggcccaaacctactggcgtcccctagttcgacgacgggcacagccggcaataacaggcccaacacacacggcgatagggcctattttcactttacaccgtgggagttattccccgcccgctactcaccttcaaagatcgtaaacctccctaatgcacacctaaagacgccgattgcgcacaacatcccccagatatcacacactactccaactctccattggagggtaagacactcaatctctacgctttacccgactccaacaacattttcttcggcccctatttcgagaatatgcccggcacgcttctatgccacactacacaccgatgtacaa

SEQ ID NO: 708445 - DNA, 362 bp, Homo sapiens
  misc_feature (20)..(20): n is a, c, g, or t
  misc_feature (22)..(22): n is a, c, g, or t
  misc_feature (34)..(34): n is a, c, g, or t
  misc_feature (38)..(38): n is a, c, g, or t
  misc_feature (42)..(42): n is a, c, g, or t
  misc_feature (354)..(354): n is a, c, g, or t
gctgctgcctgcaggtaaantnaaaagggtaaantttncctnccccttggtggtggtgctcaagagcgctgaacggatgggttacaccgggctcaatatcacctatccctgcaagcaggccatcctccccttgctcgatgagctttctgacgaggcgcgcggtattggcgcggtcaacacggtggtgttcagggagggcaagcgcatcggccacaacaccgattgccttgggtttgccgaggggtttcgccgtggtcttgcccaggccgcacgtcaccgtgtgatacagatgggggctggcggcgccggtgcggcggtggcacatgcgttgctgtccgaaggccaccaaggggnagagaact

SEQ ID NO: 708446 - DNA, 945 bp, Homo sapiens
  misc_feature (542)..(542): n is a, c, g, or t
ctagccagtcgagttaagaaagcctgctgaggtggtatgctgaggagtacaaagaaccactgctagaggagcccccaggctggttgaagtccttgctgtgtggcgaggctggtgttttcagctgcctttctttcccattgcgaagtatgccttcctcagaggaagctgctggtggatacgaactcctgacttcaatccatctcacgtcctgttccacacgcatgaaccaactcattaactgtcctgacatcactcctcctacattgtcctggtagtgagtgattttctccgaacaggccgagtggcttatcgaagggacgaaagagcgtgaagtacgttaggcatgagacggactcaactcgcttgttggtctgtcgtatgccccaccttacattaaatcatcccattcatactatataatctatgatgtggcggagcccctactaactaattatggaggcagcagaaaggaaaaacaacatgaatggaagggaaacaaccgatctggccgcagggtagagtagcattgcctgacgagggtnggttgcttgtgtaggaatacaatacgaggaatcgactggctccagcaaccctacgtctgtcagcatgcatttggaacacgactggcagccgatgccacaagagcatggatggtgtcaggaacgatgtccaaatcctcaccttctatcccattcttgttctcttctcgcaaggaccgcctcagtctggtgcccaggctggacttgaccgggggggcatcatacgcggctcgatgcaacgtccggctgcttggtatccagccttcttcgtcatccccccaaggttgtagcacccgcgggtgttccccccggtgtggtagctggcgtggtcctgttgtgtggtgccaacgtttgccattgcgcccgttgtgcaccacctgctttggtggccctgtcctgggcggta

SEQ ID NO: 708447 - DNA, 141 bp, Homo sapiens
ccacgcctgatatcatttctctatggtttgagtctccatgtatacacatgagtggtatgaatattatacgttgttatgtgactgtcgtatttcacttagcataaggtcctcaaagcttacatcacatagttcaccgtctga

SEQ ID NO: 708448 - DNA, 1147 bp, Homo sapiens
gttttcctgcgcagtgagcctgcagtgctgtaggcagccatggctgcccagccggaatggcatggtcttgaagccccacttccacaatggactggcagcgtgctgctgtggccacgtggttcaaccagcctggccctgtaagatcctgcagactgtaagtgccctgtgcaagccaatggctgcgcctgcatctgcccctgcgcccctgctgtcgggtcccatcctggcccatctgtgcgcttgccccactggttctggtaaccacactgaaggtgctgctgccggcctgcgggcttcagccatggaggaggctcagtggtggcctgtgcattcacgaagaaggttggccctggaccatctgcgcatttcttgtggatccgcacggaggctgtgaacaaggtccaactggagtccccttgcaggaccaactgttgcatgctggttgacagggaagtacccagcttccaaagattcattcccttctatcccacatgggaacgcccatcggggtcccccaaatgcacagggggaggaaccagagtttcatatggcttgaaagaaagcctttgaaaacattttgaggcaccaatccccagtgccttaggagcccctggggaaaccctggtgttccatttagccgccctggtaccctgggggaaaccgggtccttatttaaacggaagacgcgcgaagcaaccactggcttcctggaacgttccaattcacaaccctttgcaagtgcgtgaacagtgaatggaaggggacaacgtatgttatacgaagaaatagagacaccggtttctaccagcgcgttttaatagggtatcctttcacatgggttaaatgttggcgggcccccacggggtgttggcccctaaagaggcatgcgcgcgccgggaggagctgtatcctttgatccgggtggtgcatattattacccgtagaggtagtacctaaaaaagtagaaagagcgatagggccccccaaaacaatacgcgtcgaaaaaatgcgggcccagtggcggcaagcggtaacgaacgccacacagggcgatacatattgggtttagtggcaccagccgagcacagtgttgcaatgatgaccgtagaactttttaacagtagggtggacgcctcagtatttaccg

SEQ ID NO: 708449 - DNA, 540 bp, Homo sapiens
ggcctgtcccggccattctcgctagttcgatcggtagcgggagtcggagaggcggacccagagagccctgatgcagccccactcgtcgccgctggcctagttaccatcacaccccggtgaggaagccgcagctgccgcatggcggccccagtcaccatcaccgcaactcatgagctagcgaggccagatacccatgcagtcgcctgtgtcttctccgaccacgctggggtctgggacgcgaatgagacagaagagaggatgtactcgtacaccggggcctgcaaggagctgcctgtgagccatctatgttcgcgcttactgctacaggtcctgaccaaaggaagcgatttgccagttagagcgagagcgtgctttccatagtgatgcgatgcatatgcctggtgccgtcggatggtctcagccatggagtgattggtcttcagcgcatcttgcatgtcccttctgatcccttcacagcactagttatttcactgcttgcacgatcccatttccagagtcgcgaggaaacttggtgccacc

SEQ ID NO: 708450 - DNA, 117 bp, Homo sapiens
aggatccaccctgggctctgtaaagaatagtgttttgctctgcaggacattagtgtccccccttgaagcaataactccaagcagactccagcccctggacccctggggtggccaggg

SEQ ID NO: 708451 - DNA, 122 bp, Homo sapiens
tctgggtgatctagaggatcctgaagcatccctaacaggacagatcctaaccagtctctctatgtctttgtactccttgtatcttagcccttccatttcctaggaggatagggttgggccag

SEQ ID NO: 708452 - DNA, 374 bp, Homo sapiens
tggcacgagccgactccctgccctctccagtgtgggtatttgtgacaaggcagcttgtgtgtgtgggtccccacagcctgtccaaggcaaatgcgatgtgtaagctctttgtgtgcacagacacgaagggtgttaaccgcagactcttttgtgatggggacacatgactgtggagaccactccgatgaagccaactgtggaagggtttatataggataaatttgttcacaaacaggtttgagggcccacttcttggtcaccagtattattccagtggatgctccccgcatttcattctggacaccagggttaagaagcccttcactgtgtgaaggttcacgccccagaccccaagcgaataccaattctttttg

SEQ ID NO: 708453 - DNA, 334 bp, Homo sapiens
cccgtgtttggaacctaaatctgtttttgggtttgcctcaaagggacctttggttcactgggtggtaacccttggtgaaatggggtttgtccaagtaacgttaactttgaagttaccccccgtagctggcttcaaagtgcctgttctgtaaaatttattttaaacttttcccctagtcttaagttgtttttgctttttccggctgggtaatttgaaagcctaattttttgaaggtttttttgccttttggggccttaaaaaatgggtttcattttaccggctaattttgtaactggcttgtttgtaaaataaatccttcctgtgtttaaagcca

SEQ ID NO: 708454 - DNA, 895 bp, Homo sapiens
  misc_feature (10)..(10): n is a, c, g, or t
  misc_feature (12)..(12): n is a, c, g, or t
  misc_feature (152)..(152): n is a, c, g, or t
  misc_feature (181)..(181): n is a, c, g, or t
  misc_feature (207)..(207): n is a, c, g, or t
  misc_feature (252)..(252): n is a, c, g, or t
  misc_feature (278)..(278): n is a, c, g, or t
  misc_feature (311)..(311): n is a, c, g, or t
  misc_feature (313)..(313): n is a, c, g, or t
  misc_feature (317)..(317): n is a, c, g, or t
  misc_feature (333)..(333): n is a, c, g, or t
  misc_feature (342)..(342): n is a, c, g, or t
  misc_feature (353)..(353): n is a, c, g, or t
  misc_feature (360)..(360): n is a, c, g, or t
  misc_feature (384)..(384): n is a, c, g, or t
  misc_feature (397)..(397): n is a, c, g, or t
  misc_feature (402)..(402): n is a, c, g, or t
  misc_feature (429)..(429): n is a, c, g, or t
  misc_feature (432)..(432): n is a, c, g, or t
  misc_feature (457)..(457): n is a, c, g, or t
  misc_feature (485)..(485): n is a, c, g, or t
  misc_feature (502)..(502): n is a, c, g, or t
  misc_feature (509)..(509): n is a, c, g, or t
  misc_feature (512)..(512): n is a, c, g, or t
  misc_feature (618)..(618): n is a, c, g, or t
  misc_feature (622)..(622): n is a, c, g, or t
  misc_feature (707)..(707): n is a, c, g, or t
  misc_feature (756)..(757): n is a, c, g, or t
  misc_feature (769)..(769): n is a, c, g, or t
  misc_feature (772)..(775): n is a, c, g, or t
  misc_feature (782)..(782): n is a, c, g, or t
  misc_feature (784)..(784): n is a, c, g, or t
  misc_feature (787)..(788): n is a, c, g, or t
  misc_feature (795)..(796): n is a, c, g, or t
  misc_feature (798)..(798): n is a, c, g, or t
  misc_feature (802)..(802): n is a, c, g, or t
  misc_feature (830)..(830): n is a, c, g, or t
  misc_feature (832)..(832): n is a, c, g, or t
  misc_feature (862)..(862): n is a, c, g, or t
tagaaaaaananaactttattctttatccagtagatcccagtggaaagcccaacagtaacaggggcacccacgggccccaggggaaggggccccaacccccggtgaaggaggtcggggcagagccagcccccccagccgggggtgcaggggngaggggagacccccctgtaggcccgtccngcggggtaaggagggggcacgggggngggacaggttgggggtggggggcaggccagggaaatggaggaacncgggccaagtgtgtgtcggcccatcnactgtccagtgtgtgtgtgtttgtgtgtgtgcncncgcncatgtgtgtggtgtcngggggcccnatgggggtgcnggtggcngaggccgggggtgggggcagcccnggcccctggccanccccntcacagtgggggctggggagcctaaangangtgggccccgacgggaggcaacccngccgaggagccaggtctgggaaaactcngtcccggggcccttgcnctccccnccnccatccctcaaggtgggtgcaggcaaatgccaaggccaggagcctgtcctttcagggctgccccacaccgtccacacccagtggtcaggcagagggagaaaggggntggnggcttctccagtgggagggaggggaaggcaggccttggaaagttagtacttcacagttttaaagagaaaactgaggaggaaaggntgaggaggagaactggggggcacagggacatgaaaggagagtggggggnncttccgagccanggnnnnccccggntnaanncctccanntntttntcaactcccccaataaacagcacaaatncntcaatataaatttcttaaaataaaattctnttaaaaatcaaacaaaaattaaataaaacaaac

SEQ ID NO: 708455 - DNA, 175 bp, Homo sapiens
agctcgtaccgagtgatgtgggcgattgatgaaaaggcggttgaggcgttgtgagtagtgcatggctaggaatattcctgttgctgactatctggaggagtcctactgacaagtccgccactgcagtgagtcgaagctttcatcatgcgcggccaatagtaaattcttccacggt

SEQ ID NO: 708456 - DNA, 371 bp, Homo sapiens
cagtacggatggtaatagaacactctgaggactggtggcagtggcacctcagagactgactatcaagccaatgacatggaggtgtgggtggttacttgggtgaacagtgaagaatggggacagcccccaaaatatcccctataggagtagttaagccacagtcgcctggggtagagtgctgcaaggagaatgggccccgggcatgggtctccagggaaaaccaggtgtccacgtggacttggagtacctgctcctgccggccctgacggggatggcagcttgctggggtcttcagagaaggtccttgcaccccccagtcctgtgttgccaactgcagctcacttcccatgccccaatctcatttgggactc

SEQ ID NO: 708457 - DNA, 162 bp, Homo sapiens
tacttcatagctaaggaagtgtctaacacctgagcgaacatatctgaaggatctcgaagttattacttcgtggtttcagagcacagtgagcaaagaggacgccatgccgggaagcactgaaaagtctcatattcccgaattttgaaccggcggtgcggcgtg

SEQ ID NO: 708458 - DNA, 164 bp, Homo sapiens
ggcgcttccggaagctggcgtctcgtctcctcccacggcggaacatcctgtgcctgaagctgccgggtctgctacggtgatcgcggggctgctgaaagcccggtgggaccaaggagcagaggctgctctggccgcctatgtggctggcaagttcaggacgatat

SEQ ID NO: 708459 - DNA, 512 bp, Homo sapiens
  misc_feature (1)..(1): n is a, c, g, or t
  misc_feature (15)..(15): n is a, c, g, or t
  misc_feature (45)..(45): n is a, c, g, or t
  misc_feature (122)..(122): n is a, c, g, or t
  misc_feature (283)..(283): n is a, c, g, or t
nctccaacagccacncgggccggattcagagcattcttccagccntttcaaagaccccacttccttctgtaatcttctccacgggaagaccaagcccatttgccggagcccacattaatggnaccattcagcctttgaattgccacttctctgaagactctacagggctatgagggtgactcctcaggccgggaggaagggaggaaggtaggaaggaggttttgagcctttatctgactagaaagaggctgctataggcccacaaaatcaaggtctcaccccntcacccctgagaggcagccaggcgtcctgggcaagagtgatgctgtctccacaccgcaggggctagcaagcaaggctgtagacagggctgttccaatgtgtgaccccaagaagacacctgccaaggagaaggaggcagtgcgggcccctgagaaggagctgcccagcctgcgtgtgtgtgttgggggccgaggctgttggtttcagtgcattaaatcatggactgctca

SEQ ID NO: 708460 - DNA, 109 bp, Homo sapiens
gcggccgcctactactactactgctcgaattcaagcttctaacgatgtacggggacatgattctccagtatatttgtaaaaaataaaaaaaaactaaacccattaaaaa

SEQ ID NO: 708461 - DNA, 1278 bp, Homo sapiens
agtaccattagcgcggggcggcgagcacaggtaggtccgataaagagtagttagagcgtgagctctatgcagcagtgccatgagttcctcggaactgattgaatgtgcatcacgtcgagacaactagagaaaagaacctgtgccagtgagaggcatatcgcagaacaggcagttcctagtcagctagaccttggggtactagcgaatatagctgctgtgctctagtggaagttggaatgctcagtcgacctgattgcatgtaaccagcggggagcatcgaaagatcgagagtcatggggaggagaatcaaggacgatcagaatacacctgaccttgacgccaaaggaagattcaaggagaggactacacatgcatgaggacaaaaatacctggatacagatacaccactaccttagggcatagaagattcacatcggagaagatcccaccagtgcaaagcacaatcttatgaaaggacaaaaacagaaagggacacgaaaagacacaagaaaacacatctgaaaaagagaggataccaagaacaccgaagaaacgaaagtgcacggtttaccacaaagaggacaacatgagaggaaaacattaaccccctatacaaaattgaggaccacatgcatgactataggagttattatcacacaaccacaagagaaaattatgagacaccaagagaaaccagcttgcagccataggacacgatttaacacacagatccaccatttaggaaatttatacaaaggaggatgtgatagacaggaaacaacatggcacacacttggttagatgaacaactataccaaaagccaacggtggacacattaattatgtcaaaagaaaggggaatacaacagagagtgacacacaaagaggagcaaagaaacgaaaaagagacagacacaacaaggacagagaacagcagaatcaccacatatcacacacagaagtggcacatgacgcggacctgagaccatgaggaaggaaaacaagacaataggacatagggagaagacaggaaccacagcagcaaactacaaaaagacaagaaacaggacggcgagacaacacagagagaaatagacatagaagacccctacagtaggacacatagcaaacaaccacgattggacaaacacgaatagacaacacaagaataggacaaaacgagacccgaaaaccagattacaaatgagcataggaacgcccaaaaacggggtaaacacgataccaaaacagacatggagaaacacaaagactcaaaaa

SEQ ID NO: 708462 - DNA, 122 bp, Homo sapiens
aatcagtactctcctcatgataaaagagctgggtggctgatggatgcagagatttctcatgtcttcctcctctccctccctaacgcactttccccatgcttcctccaagtgtgaatcatctt

SEQ ID NO: 708463 - DNA, 320 bp, Homo sapiens
  misc_feature (246)..(246): n is a, c, g, or t
  misc_feature (280)..(280): n is a, c, g, or t
  misc_feature (292)..(292): n is a, c, g, or t
atactcgctgtatccttgaactcctgagctcaggtgatcctcctgcctcagcctcccaagtagctaggaccataggcatgtgcacaatgcctggctaattttgaatttttttttttcataaacagggtcttgctatgttggccatgctggtttcaaactcctggcctcaagctatatttcctcctcagcctaccaaagtgttgggattacaggtgtgagccaccatgccctgccacttaggagttnttttatttttatcttgattgattgggtttttctnttgggaaaagtntttactgataaatttatgtgtggttaat

SEQ ID NO: 708464 - DNA, 110 bp, Homo sapiens
agtgatgatctagaggatccgatggagtctctatacccaagacaagtcatccatggataaacacgttaccaggagcagaaccattaagctggtccaggcaagtgagaact

SEQ ID NO: 708465 - DNA, 122 bp, Homo sapiens
gcagaaattcacatttagagcagggtggtcttctgtggcactactgacatcctatatatgccctgtcctgcaggtacaatgtgagctgtagccatcagttccggctgaaggggaaaaaaaaa

SEQ ID NO: 708466 - DNA, 874 bp, Homo sapiens
gtacacaggcccctgcccctgcctcagaggatgaaaaggtcgttgttgaaccccctgagggagaggagaaagtggaaaaggcagaggtgaaggagagaacagaggaacctatggagacagagcccaaaggcagaggtgaaggagagaacagaggaacctatggagacagagcccaaaggtgctgctgatgtagagaaggtggaggaaaagtcagcaatagatctgacccctattgtggtagaagacaaagaagagagaagaacacgaagaagaagagaaaaaagagatggtggttttacgtgagcttgcactccctttgggctagaatgaatgatgcgggcagaccagagattaccaagagagactctatgagatctggcatcgacggcgtgacttactggctgctagccggcattataataaccatgtgtttatgcccggtggcgaagacatcctagatatgaccctacgctatgccgatcctcaatgagcctttcaagggtgaaatgaaccgtggcaatttcttagagagtcaagagtaaatctcgtatgctcgaaggtttaatgctcttagaagctaagctcgtggtggagttgaggatacagcgtgctgcgcgggctgcttacttgaactagtgtcgatgaatgacccttctcacccttccatgggccctcaactacccgctttgctgatggtggagtgttaggcggaaagtcatcagctagcctgtccagaggaagtctagtgggcaggaagatcaagccaggcaaatgcgagtcgtgctcaaaagttctgaaacagctggaaggaacgtggtgagtgacatgaaagctgatgtgactcgactccccagtaccattgccgaattgccca

SEQ ID NO: 708467 - DNA, 121 bp, Homo sapiens
tgcaggtttagtagttcaggactgtgggtttgtaaggtactgattgcattaataaattaaagctccatagggtctcctcctcttgctgtccacctcctccctcctccctcctctgtgctgt

SEQ ID NO: 708468 - DNA, 112 bp, Homo sapiens
gtctgatcataggatacggagatggtgggtccagtttccagagcaccacagggacactgtgtaacacatgaggggggttaccttaacaggagcccactgagattgatttttt

SEQ ID NO: 708469 - DNA, 127 bp, Homo sapiens
ctttctctactccatccattatctccgggattcctccacattcccttcagctcctagttgttccaccttggctaacaatttaccaatctttttttctatgaacacgttctgcctttgctgctacttc

SEQ ID NO: 708470 - DNA, 731 bp, Homo sapiens
  misc_feature (731)..(731): n is a, c, g, or t
agaaagaagcccctgacgagaacggaatgctagtctagtctacaggacctacctgaagcagcatgattagcacagcatcaacttttcaacttcattatcttggccatccaggtagtcatgtgtaactgaggattaaattacggatggaagcatcgctaagagcgtgtcgagggccgtgagagtggagagcggagcgagcgagcgggaaggacctttaaacgcaccccatcacgagcaccgtggagagcacgcgcgttgagcggcgcagaagccggcggctcacgccgctgacgtgacagctcacatagcaaaccgacagatccgcgggcgggacgagtcgaatcagagaagacgtggcgacagagcccccccgccagcctcaaggcgaaagtgtccgaggcgttgcttgcacgcgacgacctcgaccatgagtacaatagctttcggcggggtcccggcacagaggtgcgcgcctggcggccggatccagcgtgcgaccacccgaccaaacgccacgccacacacacagggagtacgctgcgagaccgcggctaggtgagagctgaccacgcaagcgagagtgagaggcgcaaacatcgaggttgacaggagcacacagcgaggaaccaggccgaatccttgcgagacgatggcctgacggagataacaagcgctgagcgcgtccccgcgtcgcaacgggatcacccaagcatgcacgcgcaccaataatn

SEQ ID NO: 708471 - DNA, 669 bp, Homo sapiens
tggtgatgactcttaacaagcatgctgccttcaagcattgtttaacaaagcacaccttgcacagcccttaagccatttaaccctgagttgacacagcacatgtctcagggagcacagggtgggggtagggttacagattaacagcatcttaaggcagaagaatttttcttacagaacaaaatggagtctcctatgtctacttttttctacacagacacagtaacaatctgatctctcttttccccacaggagttcagtggcatgaccagggctcactgcaaccttgatctgggctcaagtgatcctcctgcctcagcttcctgagtagctaggaccacaggtgtgcaccaaccacaaccgactaattttgtagagatgagatcccactatgttacccaggctgtcttgaactcctgggctcaggtgatcatcctgccttggttcccaaagtactgggattataggcttgagccaccgtgcctggctgtgatcagaattctcattttttgttagtcactaaaaatgctggggggacactccattctccattatgtgattagttcacattgcatgttgtatcaaaagatatatatacccaaaatatatcaaaaatttaaaattttagtattattgtcaggacaattaaatgtgggagtgaatctcaaggcc

SEQ ID NO: 708472 - DNA, 1001 bp, Homo sapiens
ggaggaggaggaggacgaggaggggctgggccccccaggccctgccagcttgggcaccacggcactgttcctcccgtacaaggcccagccatgcccgatggccttcctgcggtgatgtggttcccaggggtgcttggggggccaggagcgtgccggggcctggccctgcccatcccgtgaggggggcgccacgttaggccccgcagctgcagccgtcctgtaccacggtgactggacttacgaggagcagtttaagcagctctacgaactcgacggggaccccaagaggaaggaattcctggatgacttgttcagcttcatgcagaagctgagggacagcctgtgaagccgcatccccatcatgggcaaatcaggtccttgacctgttcatgctgtacgtgctggtgacggagaagggcggcctcgtggaggtcatcaacaagaagctgtggctgtgagatcaccaagggcctcaagctgcccacgtccatcaccagtgcagccttcaccctgtggacccaatacatgaagtacctgtacccctacgagtgtgagaagcggggcctcagtaaccccaatgagctccaggcagccatagacagcaaccgacgggagggcccggcgccagagctttggtggctcctctttgcctactcgccaggcggggcacacggcatgctctcctcagccaagctaccgtgtctccctgggcctggccgaagcaccaagagagtccatcacgccgccctagatcagaaagaggagactcagcatcccattaaagtcctggcgcttgctgtgtccctggcgggccacctgttgttgggcagcccaggagcaattgttcaagcagcatgcggccaacagtgtggcttgcaggcagttgcctggacaactgcgagaactctgagttggaaactctcgagaaaaaaggctgtggcagaacacacgcttgagcatatcacacaaattggcgggccaagcccaaatcgacaacacaa

SEQ ID NO: 708473 - DNA, 369 bp, Homo sapiens
aaggatctatttctggcacgatgagggtagatacttcttaacgtactaagaagagaggctgcggtgacacagtagatgcattgatctaaagatgcgtcttgacttcagaaggtcgggaagtggaaagcaggtttcagggctgctgaggtacaggtactcctgtaggccccaggcatggtctcaggcgtgctgagtgcgtgcgtggtaaatggatggaggccagtggtgcctcctggcagtgtcctccaggcactcaaacctagtccttatgaagccgagctcacgtgacctcacagcccctcctgaaggcgcctcactgatgacggtgggtggaataacagcccgcagagatgtccaggtttggaaccc

SEQ ID NO: 708474 - DNA, 226 bp, Homo sapiens
  misc_feature (15)..(15): n is a, c, g, or t
atacataaagatcanggagctgggtgtgggggtgatgcctataatcctagctacttgggagactcaggcaggaggctcccttgagtcccagtaatttgagaccagcctgggcaacagagtgagaccctgtcacaaaagagaaagaaagggcgtggtggctcatgcctataatgttatgcctacaatcccagcactttgggaagccgaggtgggcagatcacttgag

SEQ ID NO: 708475 - DNA, 301 bp, Homo sapiens
ggggaaggggggcccccccctggggggggccccccccgggggggggggaaaaattttttttcccccattttgggcccggggggcccatttttccccctgggggggggggggggggggcccccgggttcggccggggttttttggggtccccccccccggccccttggttcccagggcccccgggtttttccccctggggggtgaggcccctttttttggtccagggtttttgggaaatttttctttttttttttttttttttttttttttttttttaaaaatatttggcttccggccccca

SEQ ID NO: 708476 - DNA, 207 bp, Homo sapiens
gcagaaaaacatacaagacttccttcaaccaacaggaatggtactgaaagttaggaggaacttgtgcaactggaaagaagaatggcaattggggaggcagggaatttccttcctgaggatttcagaagattggtgagtattgaggcttcctgttactttaggagaggcaggtaggatcttaagacacttcttgcccaccctttaccc

SEQ ID NO: 708477 - DNA, 534 bp, Homo sapiens
cttccagctaaacgtttacaaccatgtttgataccgattacgtcgcctcaatcaacaagagcggctaccgttatcacccgggcgagccaagaaccttcttgctcacagccaatatgcatttctgattcagatgtggggcgcaggcaatatttataatcggcgctactttttcaacagcgtagagtcattattgtcgcgacctgttgttaaggacttctgtgtcatgctggttgatattaatcagttcaaacgcatcaatgcccaatggggacatcgtgtgggtgataaagtgctggtttcaattgtcgatattatccagcaaacatccgccccgatgatattttagcgcgactggagggtgaggtgtttggcttgctatttaccgaactcaatagtgcccaggcaaaaatcattgcggaacgtatgcgtaaaaatgtcgaactcctgaccggctttagtaacagatatgatgttcctgaacaaatgaccatcagtattggcacggttttttcaacgggtgacacgcgtaatatc

SEQ ID NO: 708478 - DNA, 353 bp, Homo sapiens
ccatccgagctgaggcaggagctgacttcgcggttcatggcatcggcgtctcagtggcgtctccagctcgcgctgagtttccgggggagggttggccgctggcctcctcttcggcctcctccagctgccgttgagctgcttcaggcggggtagatgccttgtcgtgctgcgaagatggccgtgtggcccgttgccccggttaggggctctgggcgtgcaagccagtcagcccccattgccctgccttgtcacccctatcttgctggcccagcccccgttgcccttttttcaattgccccatcaagagcccacaccttggtccttgaactggttcggggttccctccgctcgtg

SEQ ID NO: 708479 - DNA, 264 bp, Homo sapiens
gaatgagccggccacgacaagatatcgacgtgatcgaccgcctgcccctgcgggcaatctgtcggcggtcggcaacatcggcgacggcacgctggaccagctatcgctgaacgtcatcgtgccgctggacaagttcggcatctcgggcgcgcgcttcaccttccgcaatgactggaacaagaccagcgtcaccgacccgacgacgggcgaggaaaggccgatttcccgcgttcgggccagtcaggccaacgtcggcttccagca

SEQ ID NO: 708480 - DNA, 125 bp, Homo sapiens
ttttttaaaagaaagtttttattaacaaaagtttccttaattcacatttcaacctttattaaatagtccaagggtttcatttatgaaccacttattccagtttagttctcttaaattcatttgct

SEQ ID NO: 708481 - DNA, 434 bp, Homo sapiens
ggccacggtcgcccccccgttccccgcacgcgctctccagcctgctggcgcccgcctgccgctggtcaccccggccttcctgcctactgtcccccagtgatctggatcaaaggccgctgagctgatggccctgcctgctggggctggcatgcggtggtgacaggagcgctgacgacgagcgcaacggtgcccgctttcagcccaccccttcatctgccataccactgtcgctgcgtcagcacgaggattcccacattcatggacctgattggcttgcatcccggcgggcaggcggaccggagaatgcccacaggaggccagccgggaacacaaaaacggtcggccacgatcccaccaatacatgaaaagaacacacgtgaccgcccggggagccttggacaatggaagaggactgagcccggagagatcggagg

SEQ ID NO: 708482 - DNA, 121 bp, Homo sapiens
agtagagaatttgacaagtaaactgaagttttgattcagatatattttgaattgaaaccagagatgttctagagtttagattctttcatttgattaaggtatggtctgaatatgcgttgct

SEQ ID NO: 708483 - DNA, 181 bp, Homo sapiens
  misc_feature (58)..(58): n is a, c, g, or t
aagtgggccggtgctgcgaccacagtcagttcttcctggtgcctttgcctctacgtgngctacacccgcgtgtctgattacacccaccactggagcgatgtccttgtaggcctcctgcagggggcactggtggctgccctcactgtctgctacatctcagacttcttcacagcccgcctta

SEQ ID NO: 708484 - DNA, 1423 bp, Homo sapiens
gcagaggatggcaccactagctggatgatgacgattactttctgctgtctaccttccaactactaacgcttcgctggcactcgcgctccctaactgacgaacactggcgcactacaagcaacttcacgactggacggtacacgcattggcatctcccaaacagtccatctcgactgtacgactgaacacagcacacgcgcgggcacgggcctctgaacgctggacacgaactgtgagccaggccagcgtgaaacgaacgatacgtgatccagccatcagtcgctcctagtcagcaggaggacgctccacgatgcatgattgacgcctccactgcctcaggacctggactcacggaagctacagtcaggagtaagagccacgcgatccagacggcatgcagacagcacagctcccagacacggctgcttcgaccacagcgcagagcgacagtgcgctcaggtccagagcacgctccctgccagcgtgctaacctccaggacgtctcgcgacaacacgaggggcagacacaatcatagctcaacacgcacgcgaccgcagctcccaacacgcctgcacatattggctgagcgcaggccgcgactggcacgctcagaacacgaggctaactcacagccacacacgcaggacccatcacatcgggcaccgcatggccgcacaagcggcgaacgaccgaggaaatacccgatacccacgcccaccgacccgcagacgcacggccaacgcccacacaggcagaccaccacccgcccacaccccaacccaccacaggcactccccgccaacgctatacggctgctacactgtccgcgcaccacgaacccacgacaaacagaccgtgcatgacccagcagtcagcaccacctgaaaaacgacggggccgcaccccttccacgccaaacgcaacgaaggaccaactcgggaccccagacggaacccgcaccatggcgaccagcccggcggaacaactcagaaccaagcacaacaccaagaccacagtcacacaccgccaccatcgcaccatagccactaacaccaacacacgcagagagagacaaattaccccaacaacaacagcgacaagcggagtcacccacaccacagcacctgggaggaggacaccctggagcagaacaccacacgtaagacaccaagcacggaccgcaaacagaccgcgcaaatgccacaacacccagcacgtctcacacactacagcaaacagtgcgaccccaacggtgaaacacacatgtacgggccgccgccgcgactacagcctggaatagcagccccaccgagacgcaccaaactaagtcaagagacacaagcagcggcacaacaagcaagcccacgagcggcaagaacgagcgcacatggagcagaggcgcgacacgagaggcaccacgca

SEQ ID NO: 708485 - DNA, 888 bp, Homo sapiens
ggcttactctttctttcatgcagcagttattatacttgattaaagggaagccctgtcagtgaatgaaaaataatgaagagtgttcattaaaaaaaaaaaaagtctttcaagtgtttctgggaagaagtagattatgttagacaataggagaggaaagtatctactgatggggataacttccatatgggtgtaatgcaccatattaaatatgatactggctaaagatttctaaattaggatggtgtataaatggcatagagccattgaaaaatttgccctataagacacctttgagatgtgacttcggtccatagtggcttaaatatctgtcggcagtctcatggaaagtcaactgtcactatgagaaaacatcatgtcatggccttaaaatttcctaactttggaaaacatctctatctatcaagaagatactctgaaaatcagaatctcacatttccacagtcgaggaaataagtgttccctacggcaaattttagtttcccaaggcatatgttaaaacattcacttatgcgttctgggctcaccacttaaattatgaactaaccttaattcccttattccttgcccactggtgacaacgtcagaaaacaccttccggcggcaaacctttccaccatggggcaacgtctaagtggcttaaggagggattcaaaaaggtgacccagaccccagcacgtctttctcaacgatgtcaaccaagatgtatcatgggctggtcacggagctatcggaagattctcgaacccagtctaacacaaggccgctgttcacaattcaaaacgacaagctcgggaagatatgagatgtccaataagtgcagttgaagtacacccaaaaatacatggagacaccaaattccacgtctta

SEQ ID NO: 708486 - DNA, 116 bp, Homo sapiens
tgatgttatgaatgtccacattaatgcagctcataactggaagtcactggggagttctttgctgcttgctgggtttaactctgatcatgcattagagtctcctcagcacctgttgt

SEQ ID NO: 708487 - DNA, 148 bp, Homo sapiens
  misc_feature (135)..(135): n is a, c, g, or t
gcagcacacacgttgcacacgcaagcacccacctgcacacacacacacacacacacacacacacacacacacacacacacacacacacacacacacacacacacacacacacacacccctgttctgcagggcttnagcgtggggtttt

SEQ ID NO: 708488 - DNA, 775 bp, Homo sapiens
gcataagttggaaacatgccacatgtcggacgctgcatggatcatcccatggccgcgtatcattccgtatggccctcggcaccaagatcggtatacatcagtagcgaaactcgatcacagggctcgtgcgaagccatcacatctacagaccatggacacgtgatgtcgaaagtgaggggctactgcgctataagctccatctactataggaagctgagagacactaaccaacgagccatgcgcatgggtgactgctggctgacagagaaagatcagatccctaaattgtgtcaagtactgtgccatcgggacaaagatcaacctgcgggctacacaagaacgctgcaaatcccaaatcgacatttgcatcgagccaagatggcacagatcgagtatgaaggcaattgcctcccacccctgcctatagactaaagagacagtcacattacactactaaaccagctggtgcaggggttgatgcatgaactcaggcaaagccaggaagcaagcaagcacaggtcccacacagttgagacaccacggatataactggatatgaaaagtttgtataccttaatcagacccattatcacagcctttggagcacttatactctttgagacaactgggctagcagatgaaaatggcaaccttgatggggttggtgaccttatccggaggcagatgacctttctttgcacaatagtcaaaagtctttatgtttgggccaaataaaaattttctcaaaaaagcaacaaaattgccaggcagggtt

SEQ ID NO: 708489 - DNA, 339 bp, Homo sapiens
atcccatatggctggctgcacataatttaccatgcctctttgtgaggatgagactgtgagccttcatcttacctatcctgcatctttctagtgggctctgtggggcttagtaaaaaggataaacctggaggcatcccactacctgattttaaactatactataaggctatagtcaccaaaacaacatggtgctggtataaaaataggcacatagaccaatggaacagaatagagaaccctgaaataaacccaaatacttacagctaactgatcttcgacaaagcaaacaaaaacataaagtggggaaaggacacccttttcaacaaatggaactgggat

SEQ ID NO: 708490 - DNA, 220 bp, Homo sapiens
gaacaataccccatccgggcacgaatgcacgcacagcgttccgcccgtttttctaatgcgtaagaataatgccaaaaataaaagttcggttttcctttgtctttacaacttttaacaaatcatttgaaactgcatcataatctaatgaacctttaaaaggcggattggcaaggacaagggtgtatttgtccttgcccactccgccttttagaggttcatt

SEQ ID NO: 708491 - DNA, 832 bp, Homo sapiens
cactccggcgcgcggggctagctgcgggtttcagcgacgtggagccctcaagggacatggcaatctacagcggacgccggcgggtcggcgcccgaaatggagctggccccggaaatggggatgcgttcggaaaaatacatccaggtcggaggctcagactgtgcatttgtacatggaagaaactatggattgattacctcaggctctagcttcgaggaatatgggatgatgctgcactcagcgcctgcgcgacgtgaagaacgttagacgctgatccaggctgtattgcatgctgctgctgattgaggaggatgaagagttacctgggcgattaaacggacatccaacgtggacgacctggagcccggtgtcagggttgtgcatgatcaggattgttggcagagcatgtgcaacacagagacaacgtctcatcacgagagtcccgtatcaggcattgatatcggcacaagccaattctgacatccatcgagtacccgatagctttgattgtggttgcctgcatcagcgatgctcaagacgagagctttccatgggtagtccattgcatccctatcaaggaatgtgttcaaggattcccccgaaagagaattgcgagggttgatactcttatgggaccctctcatgctaggtccttcactcctggtatgctattgcgtactccagtgttaattgtgacgacggtctgaccattaatttattccggcgtagtggctccccttgatttggccacagcccatttgggcaccctcgcttacgggcccctggctgggagctctcatccgtcctttgctttcctggccctacctttgcc

SEQ ID NO: 708492 - DNA, 607 bp, Homo sapiens
aaatagaatttaagcaacccaccagaccagttaacctacagatataaccccgacaataagtcaaaattcggtaaccactaaataaactaagccactactagaaaccccgaaaccattaattaattaattacacgagaaacagaccgagataactacgtagggttggtttgcgatgcaagtgacacaagtggcggtccagggtttaaaaaccccaaagcttaatgaggtccaaccaaaagagagccgagaagaaaaaactcgacccctaatttaagatcctcaaagtttactaattaacctctccacctcaggcccttcttaccaaaaactcgaccaaccttactcgttgcgaagaagtaagtgattgatgcatgccagagtgccgagccgagatcccgaatgacgttcttcccagggactaaaaaggaattctacggacgcgacaaaagaaaaccgtaaaagagatgagaagagccggcaagactataggtcaacctctcctccaggcatacgaaaaaattcgaaaacttcataaccctcggagctaccaacctcgacggaaataacaattaataagaatgagtcgacgaaacggacttagagaaca

SEQ ID NO: 708493 - DNA, 528 bp, Homo sapiens
gcctggctgatctgaggatccccgaacatgtcgaggctataggaaaaaaaactccttctacttgagaaaagaagacataaaagaggactttatcttgcagcttaggtaccagttaggccacagttgggtagagcaacaagtggtctattggcatccctgattccaggcattagctcttggatggcatttctataactaccctgagccagagagaagccaactgccctgaaggtgagtcctaggcctggcagcactcatcataagctgactaaagagcctttggtccttgaatgaatatcattggtagccaggcagtactccctgtgggcctgtggtagtggtggccatgagaagagactcctcttcttacggaaaggggtaggaagagtgggaaaaactatcttgtggcttgggtaccagctcaaccacagtagaatagaacaccaagtaggttcctaaggtttctgattccagtccctagacaccggatgtcatctctggatgtgcccaggagcatggggaacttgc

SEQ ID NO: 708494 - DNA, 669 bp, Homo sapiens
ctacccctcacgacgcagacatgttgcagctgcagaatggaccagcagaaatgatgcctgaggcggaatgtggctgagctgtgcactgacccttgctgcctgaatgctgattccctccgtgtgcagtgcctgtggagtgtgcttggatgctgtgctgccgctgctgaccatcctggccctgtgatgcaccttctgtggaccatgcagctgcttctcactgtgcccctgcacaccttgggatgatgcttgtgccagctgcctcgtactgcaactgtggagtactaccatgagcaactatgtgttcgtgttcctgggcctcatcctgtactgtgtggttgactgtcccctatgttgcttggtgtgctctgtgctgtctttttcgtgtgcctgttacattctctatcttgcgcaccttggagtccaagcttgtgctctttggcctgagaggtgatgcccagctgcatcagtatgctcttggcttggatggcatctccttccccttcttcttggctggctggttgcgggctctggccgtcttctgggtgcttgggagccaccctggtggtcatctggctcccacgctgccttccaccagattgaggctgtggacggggaggagcttgcgatggacccgtgtgaggtgtcttctgggacctgcgtgctccgggc

SEQ ID NO: 708495 - DNA, 148 bp, Homo sapiens
tggcctggcgcctcactgacctcaatgatctcacgtgaattggataataacgaatgtgcgagaagatggagtccagagttcacaacaaatacatgaggatagaggagacgctgacaatacaacgagagaagtacaatgcagagatcga

SEQ ID NO: 708496 - DNA, 1485 bp, Homo sapiens
  misc_feature (531)..(531): n is a, c, g, or t
  misc_feature (1485)..(1485): n is a, c, g, or t
gcctaagctggagcatcctcgagagcccgaagccggcagtgtggatcattgtacacgcaccttcagcgctttctgaacattcacagagtcacgacacataggtctagggcattccccatcattcgctgggcaactagtggacactgtaggggtgacctttcgaggatggcgagacgtgatcgtcccatggttgtccagtgttctacaggcacctctcatttggcattactccctggatgacgtgggaacccgtcgttgtgccatcaatactcaccccagaatgcgctgcaagaagtgtagaccggtgatgtacagcgcgagttgcggcagactgatcttggtgacctaggatgtaccacgggatccatgagcaacgcctggtgccccacagcgttaacgtgtatcttgctcctgccggatggtggccacaagtgcgcgtgattccatgagacgacttggtgtggcaacttcagttgaaaacccttgatcccgttgcccaggcattgccgtgaaacgatgaccaatttgatnagggcgaggggcaaacagtggtcggacatggtagtaacatggggtgcacgaaaaggaagcgtctcatatgctttccgcagggagccaggtcgttcccttcccagagtagagcgtagtatggcgacgctaaggtttgcgtaggcgattgcacacacccatcccaggcacgcgccaggataccgggagtaccttgtgacgtgccgcgccctccaagttcttgagacctggcccagggttcccttggagcgcgtggtgcggcccgggttgtgctgggcccccttgggactcgaggaattgcggacccggcaattgccagtgccttcgtggggactcccctggagagctagttgaaccggtgatgcctggggggggctggtttggccccaacccgactcctgtgggaaacgggcgtgggaagcgtcacggcgagaaccggcttcggatttggcctggcgggaacggaaacagtagcccccgcgcggggaactccaataagctcccgacccgtggccgcacttgcgcgccactaggctggaatccggaaccgacgccgacactcgggccccgggcgaacgctcccctagggctcgaaaacgaccccgcgccggactccgcatagcaccggccaaacatcgccggcgccaattagaccaaaacccttggggtgagccagacttgctctttgtggctgttaggatcccgttggagaacgcgaaggaaagggggctgggaggaccctgacgagtaagctcacttggagataccattggcggccctacgtgggggcagaccccttggtgcgatcctggacatttgcctcctctctagaggaggttacagaggcccacacgacttggggcctggaacgcatatgggtggcccccgtccacaagagtatctcacagggtaggacattcgtgtctcatggagaggcgccaatcggaatatttaccn

SEQ ID NO: 708497 - DNA, 614 bp, Homo sapiens
agttgatggtggacttaaaccaagatccagctacgcaaagtcttatgacagtactcttcaattacccacataggatgaataagtagacagttctaccgtacaaccctaatcgatagaccattcttaatttagctatttatattatcctaactactaccggcattcctacttactcaacttaaactccagacaccatcgacgccatacgtatcgtatcatcggcacctgaagacaagctatagcatgactaactacccttaattccatgccatgccgtccgtctccctaggaggcctgcccccgactaaccggtctttttggccagaatgggccagttatcgaagcaattcagcaaaataacaataggcgctcatcattccctcagccattcatagcccatcatcagccctccttaatcctctactttctacctaccgcctaatctactccacgctcaatcacactactccccatatctaacaacgtaaaaattacatgacagtttgaacattacaagaacccgagctccattcgctccgccgacagctcatcgccctttaccacgctactcctacctatctcgcccttttatacgtaataatcgttataaagac

SEQ ID NO: 708498 - DNA, 978 bp, Homo sapiens
gtggtctcatgcctccatagatcactggtgtactctttggcgtttggggcatggtgaagccaccttcatgactagcactgtgttccatgtgcctgatgtggctgatatggagctgctggcctgttgcagccctgattatggccactcgttgtgcccttgaggtggtcatgctcttgacggttcgcaatctgtgctgattgacatgaaggtatccatgcaggtggacgtgtgcagtgcttaggtgctatgtaggcctgcatcacgagacagcatggagcaggcaagggttgtctgatagcccaatgtgcatctctgactttgacgcgcgtgcacggacagatgcgctgcgccggtggcgttccgagatttctccgtgttgcacgagagctcgaaaggtgatctgagcaggtgtctagccatgaatattgccccgaatgccgccttatgacgagaagatacgacagtctatgtatacgacatcaagtactctaacttcattttatcgtgcgcgtcggtgctctgctcgccttatatatcctcaagcttttgaacgatctctaagtcgatccaattcccgacggtcataggcacgcgcctcgtcgtgagtcatttgacattgttgggtcaagtgttgggggagaatccatagtcatagtcattatcgtccaaagtcattagtgagcaccatcgagtcgctacaaagctctcagaagctgcaggccgggacggaaaccatactgatcccacccgaggtgtggtcgaggcttcctgcaaagagaaagtggcctgctggtactcgatccctctgatttccttgtgccttttaatcttataacctctcctgcacgtccaacccgtttttggtgtgtgctcaacccgcagggatgtgtaaccccggttgtaagggacgcgctgaaatcgtgggtgagctgttccggaacttgcttatttagaggacagaagctgagtcctgggcca

SEQ ID NO: 708499 - DNA, 104 bp, Homo sapiens
tccttacgatagccgacagcagacatgtgtcatgggatgccgcacaaaacagctgatgctgctcctctcctgtcgggctagtcgggggggtactgagctcgaat

SEQ ID NO: 708500 - DNA, 178 bp, Homo sapiens
tcgtctaagataaatactagccactcttacacaagcacactacaccccttatcccatactagttatatcgaaaccatcagactactcattcaaccaataggcctggacgtacgcataaacgataacattactgcaggacacctactcatgcaactaataggaagcgtcaccctagaaa

SEQ ID NO: 708501 - DNA, 737 bp, Homo sapiens
  misc_feature (152)..(152): n is a, c, g, or t
  misc_feature (227)..(227): n is a, c, g, or t
  misc_feature (239)..(239): n is a, c, g, or t
  misc_feature (305)..(305): n is a, c, g, or t
  misc_feature (535)..(535): n is a, c, g, or t
ttagatctatttattaaaaataaaattaaaatcagattgtcagggaagaggtatgatttgagtaactttgggaaacttggtagaggcatttctcatggagatacaggttaacaattctaagagtgctgtacatggacgatgggtctgcacanaagagttaatagatgtcagatggcgtgagccagatttctcacttttggagagggaggttatagatagcagagtanagccagtatgcnctatatagttctgatagtcagagtcatcagtatgaactcatgtttacctcaatatagatacagatnatagttatatatgtgtatacatacatatatttgcaggtctatactctgaagaggcctagaagtcatgatattccaacagcaatgagcacattgagtacgcagatcttggtttctcacatgattcaccaaaatatagacccagggatccttggaaaaatgtctgattctaggtctggggcaggatatatacaagatgagtctggaacttcttctagtgccagagagtaagngagtactcaaaaaacacaactatggagtatgtcctgttggtagaaaaatttgagcaacaaaataaatagagtagtataggattatgaccccgaagtataaaataaccatctatgagtccatacatatataaatagatgattgaataaatatatcggcggagaagaaaaaaagactatccatagcagaagtattcctaataat

SEQ ID NO: 708502 - DNA, 143 bp, Homo sapiens
tgtgggccggttacttggtagacgtgcagagctctctctggggtggctgtatctcatcttggggggatgctggactcagatgcccccgtaggttcaaaagtcaacatccacatctcactcctcccggtgctttctgagtcctt

SEQ ID NO: 708503 - DNA, 1973 bp, Homo sapiens
  misc_feature (135)..(135): n is a, c, g, or t
  misc_feature (178)..(178): n is a, c, g, or t
  misc_feature (184)..(184): n is a, c, g, or t
  misc_feature (199)..(199): n is a, c, g, or t
  misc_feature (202)..(203): n is a, c, g, or t
  misc_feature (211)..(211): n is a, c, g, or t
  misc_feature (217)..(217): n is a, c, g, or t
  misc_feature (222)..(222): n is a, c, g, or t
  misc_feature (224)..(224): n is a, c, g, or t
  misc_feature (231)..(231): n is a, c, g, or t
  misc_feature (233)..(233): n is a, c, g, or t
  misc_feature (237)..(237): n is a, c, g, or t
  misc_feature (298)..(298): n is a, c, g, or t
  misc_feature (305)..(305): n is a, c, g, or t
  misc_feature (330)..(330): n is a, c, g, or t
  misc_feature (334)..(334): n is a, c, g, or t
  misc_feature (342)..(342): n is a, c, g, or t
  misc_feature (365)..(365): n is a, c, g, or t
  misc_feature (373)..(373): n is a, c, g, or t
  misc_feature (384)..(385): n is a, c, g, or t
  misc_feature (399)..(399): n is a, c, g, or t
  misc_feature (405)..(407): n is a, c, g, or t
  misc_feature (410)..(411): n is a, c, g, or t
  misc_feature (416)..(416): n is a, c, g, or t
  misc_feature (418)..(418): n is a, c, g, or t
  misc_feature (420)..(420): n is a, c, g, or t
  misc_feature (422)..(422): n is a, c, g, or t
  misc_feature (424)..(424): n is a, c, g, or t
  misc_feature (428)..(428): n is a, c, g, or t
  misc_feature (431)..(431): n is a, c, g, or t
  misc_feature (441)..(441): n is a, c, g, or t
  misc_feature (446)..(446): n is a, c, g, or t
  misc_feature (453)..(454): n is a, c, g, or t
  misc_feature (456)..(456): n is a, c, g, or t
  misc_feature (462)..(463): n is a, c, g, or t
  misc_feature (468)..(468): n is a, c, g, or t
  misc_feature (485)..(486): n is a, c, g, or t
  misc_feature (488)..(488): n is a, c, g, or t
  misc_feature (504)..(504): n is a, c, g, or t
  misc_feature (519)..(519): n is a, c, g, or t
  misc_feature (527)..(527): n is a, c, g, or t
  misc_feature (629)..(629): n is a, c, g, or t
  misc_feature (842)..(842): n is a, c, g, or t
  misc_feature (1370)..(1370): n is a, c, g, or t
agcaccgggtcggaatccgtcgacccgagccgcgcatgaagcttgtaccgtaacctctgcggacccggccccacccaactcaccttcgcaggtcaccagcaccctcggaacccagaggcccgcgctctgaatgtnaccccccttgggaggaaggcgatggcccctgcgaggacgatgncccgcnccctcctcgcccctnccnncatccctnccttcnccttntngcttctntncacnctcggcctccagggcacccaggccgggccaccgcccgctcccccttggctgccctctgganccgactncctgaacagctttacctccggggtncctngcttcttncttgacaccaactcctctttcancaactganctaccttcctnnattcccccaccttnctcctnnnctnngactncntncncncctnctncaccacccanaactncaacttnncnctattnnatctncagcccgacctcggggnngnacgccatctccgcctncttcctcatcaactncctctacnagcagaactatcgtgtgcaagttctgcgcccatgtggatgggcttcatcaactacctcacgagggaatgtgtaccgctcctacctgccagctgcggacccanggctttgtgagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactanctcagaccacccagaggacacggccaacgtcacagtcactgtgctgtccaccaagcagacagtaagactacctgcctcggcatcgcaaacaacggtgggatccgctgaccagagggcatctttcaccacgactggtacttatgaccccacggatgcagatactgcatatgagttgtctgtattagtgcgaagggctggcatctcgggccagacatatgaagcaaccttatccttgcaggtgaacgcaacgagatggcgattcgtagtcctgctctgagggatgatgcagaggtcacccatccattggcaaatggcgaccatgccagttgatggctcgtgtgtcacactagtacaaggcaccaacaccaagtttccgtctgactagacacacttggctgcctgacattctgacgagatatatactctgagcatggtgtgacggactacctctccaaaacttgccctccgatcgtctccatccgactggacggcttgcgcttgtgaccatacattaccacagaaagtggncgtttgagcggaggcctccaagcgcgatccaatgttcccccaatgtgactcaaaggggcacttgctgttggaccattgtcaggaactactaggcactctgccaatgtagaagccataccagtggcctggtttacttaaaaactcctttctagcgaatcacgtggggccccgggttaagcctatggggggcaggtatggggcacccgatgaaacaacctttgtggggcacaacacacaggggccccccaatccttggtcgcaggcgagatatttccacagcaaatggccgctgtttttggggcctgtaatggcggggagaaaaatttcccccccttgcccgaaacagggcttccgtgtgtggaacaaggcgtttctcgaccgacggatctccgggcgagaccgagccatcgtggggggggggggggacaccaacccatcgtcggtgtaatgagcgtcctttctagcgaagcgcgagccaagaaaaattcctgcgctgcgcgactgacaacaacacgacgacaccccctgcgtcgtcgatagtgctcatccatcgaaaacgaggacgaccgtctcaatcatcacaccgtcggccaagcgtgaaga

SEQ ID NO: 708504 - DNA, 360 bp, Homo sapiens
atttttaagcagatttgtttgtccctttcggaactcacattggcaagtttaaaaaggtgacttaaggtgaagtgggggcaaaatccccttttgcatactaccctatttttttttccctttaaggtgttaaacttgcccctcatgtccactcagtaacaagttttgggacgtagagcacagcctcactcagctttgaaaggtaataccgcctttggggaagtgaccccgcagtggcctttgcaattgtggatcttgagctttgctctcagcagattttaggtgtaaccattttttaactttactggaggtgtgtcctcaagaagaaagttttcaaattaaaaaagttgtttccaagtccca

SEQ ID NO: 708505 - DNA, 206 bp, Homo sapiens
agtactgcctcccgagatctctagcttccagcctaatctgttatatacaagatgtaagcgtcatcctgatgaaatcaccgcagtccgctcagccgccccaaaccaccagaggcttcggcccggatgtacagcccctgagtcagctcgtcgcaggggcagttcccgtctggatctgggccgattggcttcatgtcgtccgtgggcca

SEQ ID NO: 708506 - DNA, 433 bp, Homo sapiens
gtcagagagatgaactggattagagcctgagtggaagcggattggtgagtggtgcggggagttgactccttccctaactgctctgcgcatggtccctgcctctagaggagcaggtggtgaggatggctccgggcccgtgtggtgcctccccgacccaaaagcttcaaggacacggggatgccatgctcttccccaagatgatcttatcgagtgcacacaagagttcatccttgggttggcaaaatgtcccagaatgtgaagaggcaggagtgctcatgtgaacatggagcgctcaccccaggcgcctcagcacagccagggaggccttggggtacagcccctcgttccctggggccgccagcacctcctctgccctatcccggatggggcctgggggtctgcccagggtgcgagactggaatctatgctgaaa

SEQ ID NO: 708507 - DNA, 132 bp, Homo sapiens
  misc_feature (70)..(70): n is a, c, g, or t
  misc_feature (114)..(114): n is a, c, g, or t
gctttttcgcaacgggtttgccgccagaacacaggtgtcgtgaaaactacccctaaaagcctgggggagnagactcgtatccattgtcgtcattggacacgtatattcgggcantccaccactactggcctc

SEQ ID NO: 708508 - DNA, 921 bp, Homo sapiens
  misc_feature (212)..(212): n is a, c, g, or t
  misc_feature (456)..(456): n is a, c, g, or t
gcagagttggtggcgttcaatagggcagcgtgcgtatgtggtgaattactcgagagggtggggacgggctcgtcgttgatcctgaccggggtcggaggtcgatgctgcgatgcgtctgacgaaggtcggtaatcggatgaccttcttctataaattggctatgaactgacataggagcttcgagcatgcggagagttcagcgggccatcagngacctttcccaactgctaagggcatcatgcgatcacagtaaaagtagactgtgccttgttcgtttgagtagacatctggaaggactctgagtccagtaagttgatagagtctatacagacgattgtcatacgtttcgcatacaggtggccaatgtcgtaggtccatgacctataggatccattgcatgagtatggatagtagacactcctttacttggtgtaagaaactttagtgtcagtcatnattctgtctcacgaagaaaactactataacatgttggaactgatctctccgatacaagtactaccaatgggtaatgtgacgtgtcccacgtctgacttggtactagtctcggtggatggagctaaccaatctattgcatcactggatcaacgtcgggggagatgagtaactcacaggaagggcacctatgcctattgctctctcggtaaaggtagcagataccatttgggggtaaccggtaaagattatgtaggtccataaagacagtaccggtacggttgttcgaaacggaaagtaagtcctcgcatgaagtcaacctgtggtggcattgtaccttgcccgattgatgcatgaatgggccgttgcaatggttcggctacggcttattcaaaacgtgaccccgctgggtcaaatatttaaacggtgaggttccggcaagggtgcctggacgcggttggtgtggga

SEQ ID NO: 708509 - DNA, 318 bp, Homo sapiens
  misc_feature (13)..(13): n is a, c, g, or t
aaaatgtttcccnaaaaaaaaaacagtggtagtaggacacaattttcatcattttctttagagctttaagcctggatgatcctttcttgcgcccaaatgctttccgaccatagacacagtgggtactaagacagttggagcaggagccataatgctcattggtacaggaatcattggggtccctggaggtacaggtggaggaaatcctggaaactgcgggggtgggatccctggtgggagtgctgggattcccatgggagggcgattcaaatgaggtggaaaagacattcttactgcagcagtccgccgctgaggaaa

SEQ ID NO: 708510 - DNA, 249 bp, Homo sapiens
tcccaaatcatgccattgcactccatcctgggtgacagagcaagactccataaaaaaaaaaaaaaaggaatacggcaggacctttaaaaatgagtattggcttgttcccaaaaataattagggataagctctgtagggaacatttgttgcaagccccgggttgggacaaagttggggggggctccagggggagaggccagaaaattgggtttttttggtcactcctccatccaaactctacttttctcg

SEQ ID NO: 708511 - DNA, 370 bp, Homo sapiens
agagtgaccatggaattcatgttcattctagagcaatggaaaatacacccttgccaaagagagtctaatgtcccctcatgtgtccaagcgttctggccaggtgtggtggctcacgtctgtagtcccggcactctgggaggccgaggtgggaggactgcttgagcccaggtggttaaagctacagtgagctaggatcacgccactggactccagcctgtgcggcctcaggctctggggctcaaatgaacctcttgcctcagcctcacgagtagctgggactgtaggtgcaggccgctatgctcagctaattttttattttttgtaggatagggtctccccatgttgcccacgctggtgctcggcggccgca

SEQ ID NO: 708512 - DNA, 451 bp, Homo sapiens
  misc_feature (382)..(382): n is a, c, g, or t
tacagaggtcatgtactctgggtgttttaaaagaaacattttaaagaaacccacagattgtcattctctatcttgttttctcacgattctctgcaattcttccctgtactaaacacaacagagaaactggactgttttgtatagaatactgcttccagcaaataaaccatcacaagtgcttgggggtttgtatgtacacgatactctcagaggtaataatgcatgaacctattttatatgtaaaatatgtacagtattcatgtcaaccatctctttaaaagttagcctataaatattgttgtataatttctttggtcagaaacatttggactaagtcatgtcacctgggtcaggatttctttcagtgccatttagcaaactngtctttagtctatgcaaatagcaaagatttacagaatgcaactgaatgcagcttcactggtaaatttca

SEQ ID NO: 708513 - DNA, 175 bp, Homo sapiens
ctgtcgcacagaaaacattgagttatttgagaatttcagcaaggagtctcctgaaacaagtgacaccaagccatttatttcaagtaagggatggttacacatgattcaggaatacacggcaatagtagcctaacggtatgtcacaatgcctatgtaattcacctcacttcatgtc

SEQ ID NO: 708514 - DNA, 246 bp, Homo sapiens
attcgcggccgcgtcgactgcaaaaatccttcagttttattaatagtaaagtacatgaaaattaaaacaacaatacaattttatttttaaaccagcaaattgatgaaacaatgttaaaatattaaatgctcccaagggtttttggataatctgttccttgaagggtaaatgggtatgattttcctggaaatgcatgtaacagtgttatgaactcattcttaaaaggtcgacgcggtggggaattta

SEQ ID NO: 708515 - DNA, 206 bp, Homo sapiens
gtggaactgctccgtagatccagaaaagcacattgctatcttactgtccctaagttatggggcttatttgtttcgcagcacacaggtaactggaacagagggcaagcctgagtgaatgggcgcacagactcagcccataccttccctggttctagtgttctcaggtagcccggaccaaccctgggagcctcaggaagttaggcggt

SEQ ID NO: 708516 - DNA, 347 bp, Homo sapiens
ttatgcagagagcagagatggagtgagagaggtttttagaaatggctactgagagctgctctgcaacgctagatcgtggagaagaaaaaatctgggtgcgttgtcttgtgaagccttgttgcaagcacagtccttatgcggttaatcctgaagtgctgattattaatcttagtgtatgattactggccgtcgttattaaatcaagaatcaacctaaaactacaaatcagaagtacatggtggctaccagtataacgaagccaactatgatcatgaacgatgtccaacccgtcgggcccaccagggtcctaccgacactgctctaacagcctgcctctatgctcagtt

SEQ ID NO: 708517 - DNA, 348 bp, Homo sapiens
  misc_feature (38)..(38): n is a, c, g, or t
aaggaagagaaggaaggagaaagaaaaagaaagaaggnaagaaggaaagagaaagaaggaaggtctataaagatagaaaataacctgataaaaaggctacattttgaggaatggcaatgaagcctgtgagaggacgttttcactattttctttttcttttcttttctttcttctttctttcttttctttctttctttttctttctttctttctttctttcttctttctttctttctttctttctttctttctctttctttctttctttctttctttttctttctccttccttccttacttccttccttccttccctccttccctccccctccttctttctctttcttt

SEQ ID NO: 708518 - DNA, 115 bp, Homo sapiens
attacagaagaagcaggctttgaatgctatccttagttatgaaatggtgccctaaagaggcagcatccctttctccgttctgctgtaagacaccacatcagaaggtccaggtatg

SEQ ID NO: 708519 - DNA, 106 bp, Homo sapiens
tggagtatctagagatccgagaagatgacgtcatgtcacagcttgcggttttgtcaagaggtggaagcttcagagatgaagttggatcccttctgtgcgtcttctc

SEQ ID NO: 708520 - DNA, 193 bp, Homo sapiens
gtcctggcatgttgacgcgtaaagaagaatggagatggatgaaggcaaatgcagagggcacagttaggagcaaaccattcaaaccgctggagtgaggaggggtggtggccagttgcctatggtaaagcttggagaggtgaactttttcttgactgctgcccaacatctcctacctctgagactggagaaagca

SEQ ID NO: 708521 - DNA, 428 bp, Homo sapiens
aatctatgtaaaacacaaccaacaatctgcccgtaaaaagctggacggaaatagctcaaaatgttatgtgattgtattcaagaagtgatctaatagggatcttcttgcttcctttcgactctactgacttttcccaaatgtttctctactggggagatttttttaaaaagctattagggaaggagtagaacaaaagtggaaaaaaaaatctattagttacaaaaaactgagtctgatagaagcattgcatttgagttaatgaatctaagtctagcctataagaatttgtacatttagaaaactatgaaacagtccaggctactccatgaatccattggtaggaccagaggctggaggtggaagtgccacctggtcctgcctgataaaaaatgctgaatcagccaggcacggtggcccacacacctgta

SEQ ID NO: 708522 - DNA, 1150 bp, Homo sapiens
ccctactgagtgagtgccctgcggctgcatggatgcccagctgggccacctggcggcatctgtggagccccgccatgggcttccaccttccccatggaggtggcattaccagacgtggctacctcaacaaggacacgcacgaacagctgtcagagcccagcgagtgtgcgcagactacgtggaccacgtccaccgacgagcgcctcagactacacagcagcgtgctcaggcggtgccggcgtgacgacggacaccggcgcagctgcctcctgccgctgtcaggacagcccgcaaagctgaccttccgatggacactgcggaagcagatcaccatggaggagctggatgcgctcgaaagagtcatggacgaggccacggagaatgcagacttgcggagagggccatgaacatcacatcgaggaggttcacacaaagaacatatgaagcaagttgcctaggacagggcaaccaagcctagacatacagcctagagatagtactatacgatagagaacggcccaacaaatggcagcagaggactactacgacgtgtaagccaaggggcccatggaacgcaagggggccaatacaataacgcgagcacacgagaaacaggacacaatagcagcataccattgggcaagggacggccacgtgacagggacgcaaccccgggtataccacgttccaatacccgaaagcccacccgaatcaacagagggaagcgtgggaacagcgcatgcacacggggtgggcacggacagggccgcggaagacacgtaacggaggggccacaaaggatcgggagacccccgcaaagcttaccacagcggaacacaacgccgtggacatgaacgaggacacgagaacgaccgcgccggccacgagaacacaacatggagagctagcacacggggagcaccccctatacccaacagtgccggcaacagacccaaacgccatcaacccacccactaacacagaagcaacaacgcgacaacgacacgggggcccgtggcaatacccacgaaaaagcgacaagccgatggagcgcaccccagcccagccagctgcaaagaggcaccgagacaaacgaacaacgggggaaggagcaaaccaaacaacgaacacccggaccagcagaagacaa

SEQ ID NO: 708523 - DNA, 335 bp, Homo sapiens
tgcggctgtgcttaatatctcgatgagatttattcttctttctattgggtaaaatttcataaaaacagattaaataaattttctggtaaagatataacatatataatcaaatatgtgccaaatcacattagattcttttgggtttttttaaacagggtcttgttctgtcacccaggccagggtgcagtgatgcgatcatggctcactgcagcctcaacctcctggattcaaatgaccctcccacttccacctcctgaatagctgggaccacagctcatgccaccacgcttggtttttgttattgttgttgtttgtttgagcaaagaccccaaaag

SEQ ID NO: 708524 - DNA, 162 bp, Homo sapiens
  misc_feature (1)..(1): n is a, c, g, or t
nttggggggggggggggttctcccccccccccccccccccggggttttctggggcccccccttttccccgggtttttttggggtttcgggggggttttttggggggccccccccccctttttttggggcaggggggggttttacccgcccctttttttccca

SEQ ID NO: 708525 - DNA, 440 bp, Homo sapiens
tcacaagaaggcacagcttctaggttaagtcaattcagggggactacaaatgggcagtgccttcattaacacatttcaaacacatagaggtttggcagcgttgcttaagtgatattcattacaacggagtggcagaaaataagatgcggtcagacaaggcggctagggttaacgcggtaaatgtgaacaaagtgggctgcaaagtcagggccctcaagtgatgagaggagatgatgggtaatcttcagttattctggacgaggaggtgggtgatgaaaggtaacaggaaatcaatcaatgcacggcacggggggaaaggtgacaaaataacacctgaataaatgtgcaccaaatgaagagcgggttgaaaaggttacgtaactggcaaagacactgggaatgcataggtggaacattggctgaggcctgctgacatggaa

SEQ ID NO: 708526 - DNA, 176 bp, Homo sapiens
  misc_feature (114)..(114): n is a, c, g, or t
  misc_feature (120)..(120): n is a, c, g, or t
  misc_feature (147)..(147): n is a, c, g, or t
aataagaacattctacctagcccaaacaacattttattacacacaattattaatttcttaatatcatcaaatatccaatctaaattccagtttctccagttatcctgaaaccgncttttncagctgctctgtttttccagggtaggnccacacattgcatttgttcccctttcaat

SEQ ID NO: 708527 - DNA, 487 bp, Homo sapiens
  misc_feature (16)..(16): n is a, c, g, or t
  misc_feature (71)..(72): n is a, c, g, or t
  misc_feature (80)..(80): n is a, c, g, or t
  misc_feature (82)..(82): n is a, c, g, or t
  misc_feature (85)..(85): n is a, c, g, or t
  misc_feature (87)..(89): n is a, c, g, or t
  misc_feature (91)..(91): n is a, c, g, or t
atttgaaaaacaatangaacggtccgcgcgccattgtgttgataccccggaattcggccattatggccggnnaagttctnanatntnnngncatgtaaataatttccatatttctcttttataataaactaatgataactaatgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttggggcccctttggccaaagcaattttaaaatttgaaaattttttggattagggccaaatttggggcaatttggaaaaattccccataaggggggtcaaaaaaaattcaatgggcaaggtttaaaaacacccaaattggaaaaacccgggggatcccctttcgccttgg

SEQ ID NO: 708528 - DNA, 131 bp, Homo sapiens
gccagaactaccaccaggactcagaggccgccatcaaccgccagagtcaaccgtggagcgtcgtacgccgtccgtacggtttacctttccagggtcttactactttgaccgcgatgaggtggctttgaaga

SEQ ID NO: 708529 - DNA, 367 bp, Homo sapiens
  misc_feature (9)..(9): n is a, c, g, or t
  misc_feature (259)..(259): n is a, c, g, or t
  misc_feature (283)..(283): n is a, c, g, or t
  misc_feature (286)..(286): n is a, c, g, or t
  misc_feature (314)..(315): n is a, c, g, or t
  misc_feature (327)..(327): n is a, c, g, or t
  misc_feature (357)..(357): n is a, c, g, or t
gaattcggnacgagccactccctctctaaaccttcaatggccttgcacttgggataatgtcaaacatcttcgatgtggcccaacaggaagtgcctgctctggcctcgaccactcctccatcctcatttaccacattgttcctgccgctgacataagatcagattcccttctaattagcagggctctcacgtggcatcagatgtctgtgtgtatcacgggggtcctagcattgcagccagaggaaccctgacccagaggncgtaccgctcctgggtcatgcagnctncacacttcttatggcccctgccttcccnntgcagccacagngggatccttgcactgagggttctctgcctnaggggctttt

SEQ ID NO: 708530 - DNA, 104 bp, Homo sapiens
tgcgagagagtagcggatacagccgggcaaacccagctgcacgctgtcccatgaagtgtctgagcaccagagtgtgtcccagcactgtgtaccagtgcctccgt

SEQ ID NO: 708531 - DNA, 640 bp, Homo sapiens
agcgggggaggccacccagcgaaaattgcggaggtgtgaccggagcctaagaggcaaacttgatagcacagtggagaattctggaacatacttgcaataatagacggctgatgaaaaacaggatacttgctttacaaccaacagctgtcacgaaaagctagacacatagaaaggagttaccccattgagagttcaataatccacgtactattgtagatcctgctggagccaaaattggaaatggaggatcaacactttgtgcccgttccaatgtttggaaaagctatcatggagataacatggacattcttgttaccatcttcattaatgtcactctgatgaatggaagaaaaaagtccagtgaatccatatgttatcacgaatagaaagattagaagatgacctgacagatcaagggaaaagagaagctgacagaactataggaactatattctggtatttagggtacatgtgtcacaagatgcagctcgtgatgaagccttcagtaaagtcaatttaaattaccgaaactgcaaaatgggctgtctctactacattaatgtatgcatgtgtggaggcaagaaatcacatattcgaactcttatgttgaaagggctccgtccatctcgactgacaagaa

SEQ ID NO: 708532 - DNA, 1646 bp, Homo sapiens
ggacgcgtgggtcgacccacgcgtcgagacaataaaatcttgagtttatgttcacttcaaaaaaaaaaaaaaaaaaaaaaaaaaaaaaaaaaaaaaaaaaaaaacaaaacaaaaaaaaaacaaaaacaaaaaaaaaaaataaaaaaaaacaacaaaacaaaaaaacaaaaataacaaagcaaacaaacaacaacacgctgcgccgccctacacaattatcccatagaccagcaccaatacaacataaacataacacaaacatatactatagtataaccagaaaacacgaagcaaccctagagaaaatcaagcaggtatatataaaaataacaaaaaaacaagcacgagccatgataatataaataccacacacgaacacaagtacaagacacaaacaaaccacactccaacacgagacaataaaaacgttacaaccacacaaacaacactttatcgctctcacaagaacagagaaaaaaaacactaaagcaacaaccacaccccatacaccaacaaaaacaaacacatatacataccaacgaaataagtaaactaacaaaacaaacaaaacagacccaacaaacaaacaattttataccacagcgagagagcgcacgaaaagataaaagcagcgaaaaccacgagatgagatggttggagggggcgaggagctacagagagaaaggaggagaagagcgaaaagcggaagcaaaaaagagtgataagggacatccaagatgatcgacgaagtacaaagacaagagaactagtttaaaaccagaggacaggcagactcgggctgtcgagtatcagagctatagagcacggaccaagagcaagagcaggagacaggaagagagaaaaggtaaacaagacgagaggcacaggagaggcgaggagagagagaagggcgagaggagaggagaggagaggagagagagaggagagaggggagaggagaggaagaggggagggagcggtagagagggacagagggagaggggaagagagaaaggggaggagggggagagaggagtggagaagggagggaagagcgaggggcaggagagggagaaaggaggaacagagaacggagggggaagaaggcaacgggcaggcgagaacgaacgcgagggagggacctaggaagcaggcaggagacagcaaagcacagaagagagaagaaggagcgaaagcagcaaagagaagagccaacaagagaaagagaagcagagagaagcagaagcagagacaaagaagaagcaaggacgaaccgacgagagaagaggaaacaggacagacgagagaagcggaggcaagagcacgagcaggcagtaagagagagaggtgagaaagaaaaacagcacgacagaagagcaagatgagtaacaagacaaacaggaacaaagaaagacgcacaggggaactcagacgcagaaatgaacgagatcagaagacaggaaaaagaggaaccagaggaggagagaagaagagaaagaacagaggaagagagagacgatgggagtgtggaagagacaaaatgaaatgaaaaatgaacgagagcaattagactccttgatcacggcactccatgcaatcacagagagacaagctcgacgcggacataacgagaatgcaagaacgac

SEQ ID NO: 708533 - DNA, 1353 bp, Homo sapiens
gccatcgcctatgtaagaaccgtgtactattagccatgtgtctgaccccatcgggtacgacgagatgtcgtcgacgggtatcccttgtgccgcgtctccatttgaccattgtttagtcagtactatggtcccagaatgtacagcatgagagaagttttgctgtgctcgtgtatgcaccgtggtagacgatacatcgagtattggttataagcaaggattcaactgcttgcagcagtaagttattccacgagtcatagtgtgatcaggttgagtgatctgcactacgccatacgatggcactggagctgtgaccgagtgcatactattgtgtgtgatgaacattagaaggatgagaataacttcgaatctctaaagttcgaataacgggtccatggccactactctgtccatggcaaagtgctgtaacccatgcacaaagtggttcccagtattaacagtcgtgcagttggccaacgtacgtgaggtgtgcttgggactgtgacaatgccatgcttgcgatggtttctgcgccataaagtgtaacagtaaacggtcatgcaactatttgctgcgacgcgcccattgggcatgtcgccttaggggggcttccacgcggaaattggttccccaggaggacaggactcacgtcaacgattgcaccgcggtagtcgtggaactggtggagacctaaagcttcgggagaattagacgatttacgacctttggtggctctgtactccttttaaacgcatccaaggagtcagttgccttcctggtacgcgtcagtgattgagcatgcccgctttcccaacccccaatttgtgcctccagcaacgggaatccctaggaaatcttttgttgctaccttccgcttggggaagagttccgccctaattttggcggattgtcccaattgggttatttcccgtttggtttgccccgttcccccaattagccactaagcgttgggaattgggcagggaagctttaaaagcttttagttggacgtctacttgaacacagttaaaaaagaactaagaagtaagccaagaattcaacagaacaatatgagaggtaagagccacagaatgcctgcaggcggggcgcattcctttaatgatccaagggggtgtccggacaaacaaaagcagatgtgtcatctgcaggcaatgggggcacaccttggtgtcactaagaaggtgtgtgttcccaattaggacccgacaaggttttcatttaggtgtacccaaagagttgtgttaaaccttttggccgcggggcaccccccttatatagtagaggtgtccggagcatttaagtttccgagaagaggccagaggttaactctggata

SEQ ID NO: 708534 - DNA, 229 bp, Homo sapiens
ggcgcttgcggcttcaagcgacgcggcttacttaggaacccgggtgatttgaacttaaaccttgcgccgcaccgagttttgcagtacggccgtcaacccgtcaccgctgcctccttgcggttggagaaatcaaggccctaccgggcttccgtagtcacctctctatagtgggcgtggccgaggccgggcgtgaccctgccggagcctccgctgccagcgacatgttcaa

SEQ ID NO: 708535 - DNA, 284 bp, Homo sapiens
ggggggggaacgggtgaggataatggggggacctgtacccatgaggaccttgaggggacccatgacggccacggggagacccatgactgcgctgtttttatgaccacgtaaggggtccagcccagtagcaggggtgtagggggcagagccggccacacttgcaaagaacctcctgccaaaacccggttaaagttcccccgttgcctttttccaaggcggtactggacggggaccctgggggcctccccaagccaggtgcaggcctaaaaattaactgtttccag

SEQ ID NO: 708536 - DNA, 331 bp, Homo sapiens
cacgaggggagtctcactctctcgcccaggctggagtgcagtggcgtgatctcggctcactgcaacctccacctcccaggttcaagtgattctgttgcctcagcttcctgagtagctgggactacaggcacgtgccaccatgcccggctaatttttttgtatttttattagagacgcggtttcacaaccttggccaggctggtctcgaactccttgtgatccacccaccttggcctcccaaaattctaggattacaggcatgagccactgcgcctggccttcaagcttcattttataattagtgacagtgtctactgattgtaaaatttat

SEQ ID NO: 708537 - DNA, 785 bp, Homo sapiens
gtcccttcttacaatggccactattcttaaagacattccaaccttttaccccgaaaccactcctggaggggttctctaccaaaaccctctctctcctcctaaggtgcagggcacccccacaccgcgccgcggttcaagtctccccactcgcagttctctctatgacaaagattgccccctcctctaagtctgacaagggtgtggacatattaacatatattgtattagaaatatgcatctctcgtaagtaaattaccacaaggatctgtagagaagagagacaggccatcattcatgatgcctcccgccgccacctccgcccaccagctttttcatgtgccaagtcatcaactctcgccactgtcagtctgtggatttttgtctttccctcggacatcaacaccacgcacgcatcggtgtctgtctctctcactctgctgtgagccgtccgcgcactctctcctctcacttaccatgcctctctctctcaccgacagcatataaatctcactccttctcttgcgtctatgtgtagttgatcattaatcaccgaggtgtattctctcgctcctccagtcttctctggtccgacgcgtgtgtatatctatctagaagaaaaagacaactgcacgcgctgcggtaaaataaaagaaaatatataacaccccaagctagtacatggtcgaggtgtttcgttctcgagcgtcaaattatctggtggcgagcagttgaacaataacaagagacaaaacaagatattcgaagataaaaaaacccacataaca

SEQ ID NO: 708538 - DNA, 189 bp, Homo sapiens
ccaagccaggggactcatgacttttgcccctccccttcagagcctcggtaacacaagggggcgagcaccacggccagcctgggactggcaagagctgggccaagctgcgctggaatcgcagcaggaaagggaagtgggctggttcttccaccacttccaggctctaaacgccggactaatttcaggaac

SEQ ID NO: 708539 - DNA, 202 bp, Homo sapiens
  misc_feature (2)..(2): n is a, c, g, or t
  misc_feature (66)..(66): n is a, c, g, or t
  misc_feature (91)..(91): n is a, c, g, or t
  misc_feature (97)..(97): n is a, c, g, or t
  misc_feature (104)..(104): n is a, c, g, or t
  misc_feature (117)..(117): n is a, c, g, or t
  misc_feature (127)..(128): n is a, c, g, or t
  misc_feature (155)..(155): n is a, c, g, or t
tntttttagaataggtgataggtgttgtaggtgggaggagaggtcacagtgaggcagggcaggggnatccccctctcaacacaacttaggngccagngcttacnggccaggtagagnaagggctggnncatgtagtgagcccagcatggggagangctgagggcccatggggcgccaaagccagggggcagcagcctccaaa

SEQ ID NO: 708540 - DNA, 932 bp, Homo sapiens
atagttgaatgcagggcagtttccaccatgctgttctgatagtgagtgagttctcatgagatctgatggttctgtaaggggcttatcccttcacttggcactcattctctctcttgctaccctgtgatgaggtgccttccaccatgattttaagtttcctgaggcctcaccaaccatgcaaacctgtgagtcaaacctctttccttgtaaactacccagtctttggtatttcttgatagcagcataataagggactaatacattacatcatcactttggagttaatggctggctgctacaagaattaatgaaagaagaaaagaataagactgggttcttggtcatctttcagaatgtcattgccttcttttgcattggaagtgttaaagtaaactatggcctgagaaggactctgtacttctatatttgagtccttgtggatgaactgtaacctagcttaatagacaaaattgaaaacctaacttggtagcatgtacctgtaataatagctgagtgttggccaatcccagcagccatacttcaaccactcatagactgcagaatgtgcaaactgcattcaaataaggcaaacaccgagtagtacccatttcactgtttctgtacctcacttcgatccctgtacatcactttacttttgtctattaattgtctgacacgagaaccctggagtttctataatctggtggatctgggggtgtcgatcggaatgtcaagccattaaatctttattaaaaaaaaagggggggttaaaaatcctggaggccagttacgtacggtttgtaagaggccaaggaggtaaagagaagggggtaaggaggggaaggtggatttgggaccttggggtggagcccaaagcgggaaaagtggtacgtgtgggtgtgatgattataatataggagaaattagaagaa

SEQ ID NO: 708541 - DNA, 196 bp, Homo sapiens
tggatctcccgggctgcacgaattcggcacgagattaaaagtaagtataaagcaccgagattgcaacaggtcatgcatgtgtcggaatcactggtaaacgcacgtgatcatggcaatccctccccttgcacttgcaaaaacactttgagcgctttaagagattagcctgagaaataattaaatatcttttctcttc

SEQ ID NO: 708542 - DNA, 866 bp, Homo sapiens
ggcggctcggcgctccgggcctggcgttgtggcgccgcagtcccttgccaccttccctgcacctgtccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctaccttgcgccgcctgcagggcctggagcacggatgtcctccaggccattgaccgggccatcgaggctgtacacaaacacagccattgcgggactggtggcaagctacaagcctggaaacaggcgttggagtcctccagaaagcttgatccaaccaacggacaagaagaccctgttcaactgcagaaggcccctttcagcccttccaagtgttgccaggtcatgaccttcaatcaaccagttgaccaaccaattggattgctgcttgccagccaaggcatgccaatggcggtgtgtcgaactgggttccgagcgtgcaagcacagcctaccccagttcttgaggcatcttgaggcgcagactggagggcctcttaaccagaattcctatcaacaggcctcgcacgaagcaagcaacccaatcaaaaacggaacccaaaccaaagttaagcacgccggaagaacccgacgaagcgcccccttgacattggccttcattggagaaactgtggatggcaccaaaagtatgccaattggcccatcacaggggagataaactccatggtgctccaacgcagggctccttcatgattaaggacagaaaacataccttgtgtaacacagcacatataacc

SEQ ID NO: 708543 - DNA, 234 bp, Homo sapiens
ccacaataaaaaaatagaaaaaagatgtgagactgtgagactttgtttaagatgaggctagaggggacagcaggagtcatcagctcataacggctctcataaacccatgttaaagagtttagactattatcctaagaagaacaggaaagccattgatgggcctcagtcaagagaaatcaatggctaacatcctctacatgttaaaataagcagatggggtactacgctttggca

SEQ ID NO: 708544 - DNA, 745 bp, Homo sapiens
  misc_feature (55)..(55): n is a, c, g, or t
  misc_feature (77)..(77): n is a, c, g, or t
  misc_feature (79)..(79): n is a, c, g, or t
  misc_feature (83)..(83): n is a, c, g, or t
  misc_feature (85)..(85): n is a, c, g, or t
  misc_feature (118)..(118): n is a, c, g, or t
  misc_feature (120)..(120): n is a, c, g, or t
  misc_feature (125)..(125): n is a, c, g, or t
  misc_feature (143)..(143): n is a, c, g, or t
  misc_feature (152)..(152): n is a, c, g, or t
  misc_feature (154)..(154): n is a, c, g, or t
  misc_feature (170)..(170): n is a, c, g, or t
  misc_feature (183)..(183): n is a, c, g, or t
  misc_feature (199)..(199): n is a, c, g, or t
  misc_feature (218)..(218): n is a, c, g, or t
  misc_feature (227)..(227): n is a, c, g, or t
  misc_feature (295)..(295): n is a, c, g, or t
  misc_feature (331)..(331): n is a, c, g, or t
  misc_feature (513)..(513): n is a, c, g, or t
  misc_feature (741)..(741): n is a, c, g, or t
acacagcacaagcccatccctggattcggaatacaatgaagaattaaatgaagangactctcaatctgatgagaaanancaanangctatagaaactgatgccatgatcaagaaaaananaaaancttcaaagccttcaaaancagaaaaananaaggagcccagaaaangaaaaggaaaaanttcgaagaaatgaaancatttttcactagcgacancactttttnctctccctcctgaccagtccagctggtctagagaaagccttgttttttcccagagcaaccatgttttngcataatgggagtgacctggtgtcccattataaatnaagggtggtatggctagaagggtatgagcagtaggcttatgtacacctcttatagaggttgatagggctgcttgggtcctccactgtcctctgtcaatctagttagacgtgcttctgaatgactgttgaattgggactagaaactacacctgggctttggagttagatttttgttaacaatnatgagcctgggagcagtagtactaaggcgtcttttgtaggcttgagagtttatcctcatggcctttataggaccaatgctgtgtttttttttaggctgtgcctattatgtggtgtgattttgttaattaatgtttatacacaacagtctccacctagaactgggtgttctttgtacattgtcagatatctctctcagtgtatatttggtatattaatgttccacatgngaaa

SEQ ID NO: 708545 - DNA, 235 bp, Homo sapiens
  misc_feature (18)..(18): n is a, c, g, or t
  misc_feature (135)..(135): n is a, c, g, or t
aggaattcgaggccagtntgggcaatgtagtgggacctccatctctacaataaaatacaaaattagctgggtgtggtggcgtgagccagatgctgccacggcactccagcctgagcgacagagtgagactttgtntcaactttgaaaaaaaaaagagggagagacatggagggaggttgcagtgagctaaaatcacaccactgcactccaacctgggtgacagagcgactctttc

SEQ ID NO: 708546 - DNA, 198 bp, Homo sapiens
aatcgcacgacaaggagctgagaccactgacgcgtaccaccacgcccagttagtttttcgtattttttttttggagatgaggttttgccatgttgcgcaggctgatctcaaacttctgggctaaagcaatctgcctacctcagcctcccagaatgctggggttacaggtttgaggccacttgcccctaggcctaaggt

SEQ ID NO: 708547 - DNA, 923 bp, Homo sapiens
  misc_feature (1)..(1): n is a, c, g, or t
ncggcggtacgcagtatagcgacacgattgacatgggtaggttgggactggtggtggtgccgccgatttgcccccccagctgggggtgatgtccttggccggcgttatgcacctcgcttttgtgggcaccaggtgtcgccacggaaaaaaaagcacggggtcacaacagaggccgggttgtgaagaaggagtccatgtgtacggccagaaggcgccgtggggacagttgaattcgggccaggctcgcagcgtgtgttctgcacagaacgacgatgttcaattgagatacaaacggggaaattaactgagagcgaatatctaccctcttcccgcgccatccagagcggtagggcacctgcaatgtgaaaactttgttgccccaccggagtaggagcatataagcggacgaagcaggagttttgagattttcccccgcgcgcgcccaatctcacgcctgtagggggggcaaaaatgccccacctccgcttgggggacagaccgcctggtgctcatttgtacaggcaccccccgccaaatggggtagtttaatccgggtggtcccccagccacaagttttgggagtccgctcaatgaggacaccacagggccacctttgcggtacacaacacaaagcagtatacgccccagtgccactctactctcccatatattttaacattcatggctttacccgatcctgagtgtgaaaaattgtttgtttttgccgcaacacaaaccacaatatagattgtttttaagtggttaacatacccaaaaggcaattccacacattcttgataaggacgaccctcgctttgagaatactattgagtagaaaaacccacaccaaaacattatgctaatttttttatacaacccaggaaattcttattttttttccccaaagaacaccccacataaca

SEQ ID NO: 708548 - DNA, 202 bp, Homo sapiens
ttagtgggattacgggctcttttatctgtgaattacagtacttactatatctaattttcaccacttgtagagctacccagacttcagaatgttggggtagaaatcatctaaccatgttcatataactatagcacctttaggtggtgggtataggaaataataggttagtagtttaaaaatggggataagctttctttgcata

SEQ ID NO: 708549 - DNA, 1056 bp, Homo sapiens
ctagcgggccggcccgggccagtgacatgcgggcggcgggcggcgcgggcctggccccgggatggctatgttccgcagcctggtggcctcggctcagcatgcgtgcatgccgccggccgggccggcgggcgtgtgacagcggcctggatggcgcatgtacacctgccccatctgcctggaggtctatcaccggccctgtggccatctggcagctgctggccacactgttcttgcgtgggatgtgtctccagccctgcctgcagtgtgccatcccctgctgtgcccactgtgcctgcctgcccttctgaccccagagaagggtggacaaggccacccacagtggatgaagcatgctctcatcctacaaatgcgccctgtcgaggctgcaacaaagaatggtgaccctggcaaaagatgagagtgcacatttcgtcctgcctgaatggtccagtgaggcatgatggccaactgacccaagttcgtccccgtggtgcccacatcacagcctatccccagcaacatccccaacaggtccaccttcgcctgcccgtactgtggtgcccgcaaactggaccagcaggagctggtgaagcacttgtgtggaaagccaccgcagagaccccaaacgcgtggtgtgccccatctgctcggcaaatgccctgggggtgaccccaggtacaaagagcgccaacttcctgcagcaacttgttcaacgaaacaagtactcctacgacacctattgatgggactaccagtatatgacgaggagggcggactaccaaggagaggatctggaccatgaactctctctgaggaactgaacgggaagcagagacagccgacagaagacagagagcaaggggaaagtccccgagaaccatggagaaccgacacatgaaaaccaagaacaggagaaaccaacgtcaacaggagataacacgcaacaaagacagaaacacggaaccaaaagcaaaaaaggcgaaaccgggaccagaaccaacgaaacacaaaaaagagagcagaacgcaagacgcaaagaaagagcagccgaccccc

SEQ ID NO: 708550 - DNA, 215 bp, Homo sapiens
tgctctgacgctctctcttgcttcgggctaactcacagcttcgggcactggctgcttgaacctgactggatggtgacttggcttgggcatatttcctgtgatggtgaccggtgggaccagtgggtaccatttggctcacagctccagaggcagaccatctgcatgggagtctgagaccaccatttcttggctctgtgttgtgttcctgcctttgg

SEQ ID NO: 708551 - DNA, 149 bp, Homo sapiens
ccctgataccacctcaccacaatgtactgaaagcaataacatacgaaaagatgttggcaaggttgtagagaaaagggaaggcttatacactgctagtgggaatgttaattagttcagccactgtcaaaagcactttggtggtatagcct

SEQ ID NO: 708552 - DNA, 378 bp, Homo sapiens
ttgtgcctgggtaggctggaaggggggttgggagaaagccaggaccagatggggagggcaggggcgctgagaaaaaatacacgccacccccagtgtcctccaagaccctcttccctcattgtcctgtgctccctccccaatgtttttttctgtttcagataggtgggggtcaggcgtctccatttttgtccctacatcaaggggctctcacccggcagtttctccttcccatttagaattaggaccttagtatgaatttgcattcgcaaattcatcccaagacagggtgataggttaattaaaagcaaatattccttgaatttgagacacacaataaatggcagcacgtgcagaaaaaataaactcccagacaacagc

SEQ ID NO: 708553 - DNA, 349 bp, Homo sapiens
  misc_feature (7)..(7): n is a, c, g, or t
  misc_feature (49)..(49): n is a, c, g, or t
  misc_feature (67)..(67): n is a, c, g, or t
actgtgntacccacgtttgtggtgggaggacatccgagctggtgacttngcctcacaggcctaatangagtttctctgacacatcatttttatctttttctaatgcagggttaggaggctctagccagatgaccctgcatcaattgtggcagtggcttgtgttaagcaagtgcctgctggagggggaagatgagtgcagtgtaccctcctcagctcacatgccagtgagtctgtgagtgtctcctacacttttttttttttttttttttttttttttttttcttttggctcttttttgtttttaaattggaatatattcctcacccagaggggttctatattccacaag

SEQ ID NO: 708554 - DNA, 326 bp, Homo sapiens
gcggcccgcaacgctcggagtgttctcaatattatcatctgcgtggagtggagctgaggtttggaagtggtaagtgagctgacgctcggaagtgtgtcttaacattctcatccgctgacggtggaagcggaccccgcagatgctcagcaggtatcttgatattatcatcggctgagggtggagctgagtgttggaaggtaattaagcttgacgctcgaaatgttctcttgaaattatcatccggatgagggtggaagcgaaacttgagatgctcgggaggtgtcttgatataatcatcgagggagggtggagctgagggtggaagt

SEQ ID NO: 708555 - DNA, 250 bp, Homo sapiens
cttttggattttttttatggtgtgaaaacccaaattggtattttttaagtctttggttccccaaaattaaataatttaaaaggattttttggatattttaaaataaggagtccccaggcttccctttaccttttatgcctgccttttaaaaccgttttttcccgataaagtagtaataagttggattcctaaaaaactggtttgtgttgcctttccaaataaactggggtgtgctttgcctgggttttta

SEQ ID NO: 708556 - DNA, 393 bp, Homo sapiens
cctagaggatccatggagaccaggctgagggcagtggcttgtctcggctcacggcaactccgcctcctgggttcaagcaattctcctgctcagccccactatagctgggattacaggcatgtgccaccgtgcctggctaatttttttgtatctttagtagagacaggtttaccatgttggccaggctggtcttgaactcctgacctcatgatccacccgcctcagcatcccaaagtactggaattacaggcgtgagccacagtgtctgggccccatttcttacaaaagcaggaatgcctgaggtctcagactgtgacacaggcatagcctctgcaagtttccctggtgcccaaccccatgcaggtcctcccgaaaatggtgcactgtgccgac

SEQ ID NO: 708557 - DNA, 212 bp, Homo sapiens
  misc_feature (16)..(16): n is a, c, g, or t
  misc_feature (18)..(18): n is a, c, g, or t
  misc_feature (28)..(28): n is a, c, g, or t
  misc_feature (57)..(57): n is a, c, g, or t
  misc_feature (68)..(68): n is a, c, g, or t
  misc_feature (82)..(82): n is a, c, g, or t
  misc_feature (94)..(94): n is a, c, g, or t
  misc_feature (107)..(107): n is a, c, g, or t
  misc_feature (126)..(127): n is a, c, g, or t
  misc_feature (130)..(130): n is a, c, g, or t
  misc_feature (148)..(148): n is a, c, g, or t
  misc_feature (154)..(154): n is a, c, g, or t
  misc_feature (156)..(156): n is a, c, g, or t
  misc_feature (158)..(158): n is a, c, g, or t
  misc_feature (160)..(160): n is a, c, g, or t
aattttttcaactttncnttccccctcnagctgggggttttggtcccaagggtcagnttttttccccnggccctcccccccntcatttgtaaancaaagcccaggcngttgtgtgccttggggccnnggnaccccccctccaccttanacaggncncngnatatgggttttggggatgccccccccgggggaataaagggccccaattttta

SEQ ID NO: 708558 - DNA, 1169 bp, Homo sapiens
  misc_feature (292)..(292): n is a, c, g, or t
  misc_feature (772)..(772): n is a, c, g, or t
gatgatcattgctattcacatgcctatcatttgataaagcctcttgccatcaactcacttttgtgggtgtgactcggcgagatacttctctgattgacacgtgccgtcccgtagccctctgtgatttacaatgtctcgctccatccattagacagcatcgcttcatgacatacgtgcgctagctatatccaatagaacaacatattcccatgagtagcactagctgtaatggctactgaatgctacactccgtagaaacaggcactatacctactgggtctcatctcgaacnacaaaccaatacctgatacgcttttaaaaaggtcacatcttctgagtgagcaggggatttaactacacataatgtttttatcaccatgctaatatatgtttctttcaaatactgtacgcattggttttatttttgcctaggaagtctcctttttcttatcttcatctgcacaaggcaaatcaagacacgctaagacagcactccacaatctaaagcgttcgttggtcaaaccactggcttgcgctgcgagaccccgtgacaattggttcaccccccttttataattactttggacctttggaaaacttggcaagctccatttttaacggaacatattcttgatttgacttcttttcctacaccagaaatttcccggcgatacttgtattgcctctattcgacttagctacttttttttcctaagctttaagcagtttatccaaaacctttgccctggtgggaacttgaattaatttgcanagttttgccggaagttacactttcatattccgttgagacggctccactggggaaacaacatcaagacagctacgaagcgggataaggggcgcggtcccatccttatggttgccgtagaagagttccttaacctaacagtcttgactggggagagtttccttcccctgaggagcgtttccacgagcggggcctggctatgcgactttaccatatgggtgtgccataacccattttaggttagcccaatttcgggaagtgtaaagcctggcatacttaaaagacaaggttgtctccagtgcccgaaacggggggcaacaatccttgctaagaaatcggactcttttaatgcctgtttaatttacgggtaacaaaggtgcagcttgactctgtatatatg

SEQ ID NO: 708559 - DNA, 133 bp, Homo sapiens
tggtgggggctgatcgcgggccctcccgctccaaacaaaaaagtcccacacggaacaaagaactgaatgggatgtatttaaacgccatattggttctctctcacactctcccttggtgttctttcaccatcta

SEQ ID NO: 708560 - DNA, 360 bp, Homo sapiens
aacatggagtcattcaggcataatatgtcagattgggtacaggattgaaatactaacatttttaagtgtcctggtttcaatattaataaatacaaaaacaagtataacaatatatacaaccagttgataacgcactgtactgcagatgctcagaaagtataatctcgctctcatatgtatgcaggtatgtcttgagtgtctggatatctgggtagcttcggctggtctataggaagaagtccaggctggtgagatgtacaatgtcacgcaccctagctgtgtgcatcttcatgagttcttctacccattttgattcgtcctctgagctattgcagctctcctcgttgtcaggccggtgag

SEQ ID NO: 708561 - DNA, 121 bp, Homo sapiens
ctctcaggagctttgcttacttacccagtgtgctaggttgtatggcatccatatagtcactccagtgttatggagggttcttctactaatatagttacttttcgcttcgaagcgaaggctt

SEQ ID NO: 708562 - DNA, 333 bp, Homo sapiens
ggacaagaagcggcggagtgcctatcttcctccgtcttcgagctattttaaatttcttctattacagcactttgggaggcaggctgaagcgggcggatcacgaggtcaagagatcaagaccatcctggctgacaaggtgaaacgccgtctctactaaaaatacaaaaagtagccaggcgtggtggcgggcgtctgtagtcccaactacacgggaggctgaggcaggagaatggcgcgaacccgggaggcggagcttgctgtgagccgagatcatgccactgcattccagcctggggaacagaacaagactctgtctcaaaaacaaacaaacaa

SEQ ID NO: 708563 - DNA, 839 bp, Homo sapiens
ggccgcggcggcctcagctgccggcccgaagaggaccagtgccgccgtaccccagctgagaggcatgcatgcgcgtgaggagcggcagacccagcatcggcggcgccatgaacctcctgaccgtgttaactcctcacggacaacgggctagctctactgccggacttcaaccagtgaccacgggatgctatggcgatgtggcgctggacaactgcgatccggagtctataacacgtgattccactaaaacgaaacaccgagaaacaacgaactttctacgacaggagcgagttggccagtgtgtgaacactgtaactttcggctgccaacgtattctacgctttagctagcgtgggtggcacagaagagccgcaaatacccatcccaacacaagtacatcgatctggagattgaccgtgaagacagacagacctgtaacttgcccatagacataggctaacagaagctcagcggaagtcaacgctgcggccgagatacgcaatagtgcgaggtacatgggacgtccattgattcaaggtgttcacatttcacgaggacaatcccgcatcagttggcacagtgttcgaaacctggctataacccgcaaaggcctctagtgtccttggtcccaatagtaacaactaccctactggcctttccgggacacgcacacgggccatgtgcagcttgtggacctggccaagaacggagaggccaccggggaacattcctgcaccacgagggtgtaccggagctggcatggcactcaacctggcagggaacaggattgcaattggatccgacaacggggccctataagaatatggagacacaaaagg

SEQ ID NO: 708564 - DNA, 158 bp, Homo sapiens
gataccacatacaaaagacaaatccacaatagactaatacagcccatctatattgtagtcaaggaaatgcacatgcacatcactataagtcactgtccaccagagctggcaaaaatacaaaagtagtgaaaacaacaggatggttacttcgacgctga

SEQ ID NO: 708565 - DNA, 294 bp, Homo sapiens
  misc_feature (226)..(226): n is a, c, g, or t
  misc_feature (247)..(247): n is a, c, g, or t
  misc_feature (266)..(266): n is a, c, g, or t
  misc_feature (280)..(280): n is a, c, g, or t
  misc_feature (293)..(294): n is a, c, g, or t
gctggtgtagcacataaagaagggtccccaggttgggcgagagcccaagttgagaacaataatgaacaattattgtatgaacaattgttagagacagctaatcacaaacaacctgcgggctcaatgacctcattccacacgtagcacccttcagcaggaccctataaaactttcctccagcccttgcctctttgcaggtagccccgttctctagctgtagctgccncactgcaagcatattttcacngaatttctctaataaatcntgcccttctttacnctacaacgtatcnn

SEQ ID NO: 708566 - DNA, 190 bp, Homo sapiens
gtgtatgggcaaaaaactcgaggactgtacttgtgactaactgtatcacaggttatttacgtttctgttctgtggaaagtgtaaagcattccaacaaagggtttacatgtcgattttttttttgcaccccatgctgttgatggctaaatgtaacagtctgatcgtgacgctgaataactgtcttttcttt

SEQ ID NO: 708567 - DNA, 213 bp, Homo sapiens
ttatccccagcgtagacacagagcaggtcgacatctcccatgctgatcagtagtgggattgcacctgtgacctagccactgtcatctcagtagtcaacatatttgaacctgtctcccagaataaaattttcaaataatattaaaaccatattatgggctgggcatagtggctcacacctgtaatcctaccactttggaaggcccaggccagaa

SEQ ID NO: 708568 - DNA, 93 bp, Homo sapiens
cacagtaaatgttgatctccatagtagagcaacccacaaagacagaactgagtcggcccattctgtttagaaatatattttaaatgtttagta

SEQ ID NO: 708569 - DNA, 615 bp, Homo sapiens
cgtggtggctcacgcctgtaatcccagcactttgggaggctgaggcaggcggactgcctgagctcaggagttcgaaaccagcctgggcaacatggcgaaaccccatctctactaaaaatacaaaaaattagccgggtgtggtgacaggcacctataatcccagctccttgggaggctgaagcaggagaatcacttgaacacgggaagcggaagttgcaatgagccaagatcatgccggtgcacttcaagctgaatgacagaacgagactgcctcataaaaaaggaaaaccgtaacggccaaatggtgtaaatgatccctagcaacaattttttcccaataaagaccattacactattggggccaacggcaaaaaccgaaatggagcatatggttagaatggcagaaggcctccaaggtaaacggttacttggaggctctgatggctgatagtgagaaaaagcccctggtttgaggaaaaaggcctctacggttacaaatagggcctatatgcaaacaacgttaaggtggtgtagatacgctatgggcccatactgtgaagttctcagagttatcgcccattctattacttcaacgccatgcacattcttggggcg

SEQ ID NO: 708570 - DNA, 172 bp, Homo sapiens
  misc_feature (26)..(26): n is a, c, g, or t
  misc_feature (28)..(28): n is a, c, g, or t
  misc_feature (43)..(43): n is a, c, g, or t
  misc_feature (45)..(47): n is a, c, g, or t
  misc_feature (51)..(51): n is a, c, g, or t
  misc_feature (68)..(68): n is a, c, g, or t
  misc_feature (76)..(77): n is a, c, g, or t
  misc_feature (86)..(86): n is a, c, g, or t
  misc_feature (98)..(99): n is a, c, g, or t
  misc_feature (112)..(112): n is a, c, g, or t
  misc_feature (123)..(123): n is a, c, g, or t
  misc_feature (168)..(168): n is a, c, g, or t
ttagagtatcccccgtgtctagcagngntagtgatgttctggnannnctcngtggacatcaggcgcangaaggtcnnctggatggncacatcggcagnntcggagccctggncgccatactcnaactggaatccatcggtcatgctctcgccgaaccagtcagcattnacca

SEQ ID NO: 708571 - DNA, 507 bp, Homo sapiens
  misc_feature (2)..(2): n is a, c, g, or t
  misc_feature (39)..(39): n is a, c, g, or t
tntgctttcaatcgtgtggcctttgggaaccccgcgtancactgccgcctccttctgtcctcgccatgttcctcactcggtccgagtacgacaggggtgtgaatactttttctcctgaaggaagattatttcaagtggaatatgccattgaggctatcaagcttggttctacagccattgcatccagacctcagagggtgtatgtctagctgtggagaagagaattacctccccactaatggagcctagcagcattgagaagattgtagagatcgatgctcatataggttgtgccatgagtgggctaattgctgatgctaaaactttaattgataaagccagagtggagacacagaaccactggttcacctataatgagacaatgacagttgagagtgtgacccaggctgtgtccaatctggctctgcagtttggagaagaagatgcagatccaggtgctatgtctcgtccctttggagtagcattgttgtttggaggagttgatga

SEQ ID NO: 708572 - DNA, 262 bp, Homo sapiens
catatcactatagagtggaaggactgattgagaatgtccaagtccaaataaaatgcatcacaacttacaaatgctgctcattgtagtgagtactaagagatcaaattaatctaacatatggaaagccttatgtcctccaaagatgagtactagggatcatgtgtttaaaaaaagaaaggctacaatgactgggcaagaagaaagatggagaaactgaaataagcagataatcagcatcattggaacctggggacgagtgacg

SEQ ID NO: 708573 - DNA, 130 bp, Homo sapiens
ggggagcggatgatagtccggcaatctcgcgcagtctgatgcgtgccaggtctgtcttcgaacgccgggcgtttcatcgccttgagcactttcgggctggcgtgctggaacgggatatccaggtacggca

SEQ ID NO: 708574 - DNA, 278 bp, Homo sapiens
tgactcagaggatcccgtcttaccacaggcaggggtaattgagaaacgggcacataacagtattcatccaggagtctcaggttttttaagagttttttagttttttttgttgttgttgttgttttgttttttttttggaaatgggctctcgttctgtcgcccaggctgaagtgcagtggcgtgatcatggctcactgcagcctcgacctcctgggctcaagtgatcctcccacctcagtctcccaaagggctgagattacagatgtgagccactatgt

SEQ ID NO: 708575 - DNA, 131 bp, Homo sapiens
gcttaccagcacaccccagagcaatcacagacccaagcagcacgcacctcagggtcagcctgggtgcccctgcccagggcactgtgaccgcagacaccaggaggccaggcctgttgctggggacccccctt

SEQ ID NO: 708576 - DNA, 306 bp, Homo sapiens
  misc_feature (4)..(4): n is a, c, g, or t
  misc_feature (11)..(11): n is a, c, g, or t
  misc_feature (21)..(21): n is a, c, g, or t
  misc_feature (34)..(34): n is a, c, g, or t
  misc_feature (55)..(55): n is a, c, g, or t
  misc_feature (271)..(271): n is a, c, g, or t
  misc_feature (304)..(304): n is a, c, g, or t
cccnttaaagnaacttgactncaactacaggggncctggggaagatgcctgggtncccctaggggccttgccaaggggacctgttcgcaccccaccactccactgggctcgcacaacgccaagggccgccaggagtgttttacatcatgtcctgaggcctacctttcccccaaattctggggcccacagcctagggagccaggtgatcagggcctcggctgtggggccagggacaccatggccctggggtactacgtgtccacacatgctncagaccctggggcaaggtaggccaggggttttnac

SEQ ID NO: 708577 - DNA, 238 bp, Homo sapiens
gacagattgcttgaactcaggagttcaagaccagccttagcaacatgataaaaccccatctccataaaaaaatacaaaaagttagccgggtgtgtggtgcactactgtagtcccagttactggggagaggaatgtatgcactgtagtccagctactggtggggtagcggggagttgggaggccaaggcagctgaggtggaggatcactcagccaagaggtcaaggctgcagtagctga

SEQ ID NO: 708578 - DNA, 369 bp, Homo sapiens
tgcatgtatgccaggcattacagaatacagctataaacggcgctcccaacacctgggctctgactcacccacacccacttagtgtccactaagtactccaggatgactcagtttcagccacatctcaggtgagagtcactctgcatataccttggcttacctgcaaatagcctgaacttgaatctcacatacagggaaaactagtcatcactcaccaactcattgactaccctcaggacgtcctgcagaactcaggcgtccttgaggagaacaagtggatcataacaaaaacagggttacaatcccttctgcttcagagtactatcagtcagactaaccataaattacgctacagaaacaaccaacccc

SEQ ID NO: 708579 - DNA, 236 bp, Homo sapiens
gagtaaatgtcacagaaagaaagggcaagagacacttaacctcttgtggataaactgcagtataacgagagaaacttcatatagatcgcctccctggctgcatggtcaccaggtgatgtgccacactcaggcactgaagacagggaacgtggggatcctatcagcaagcacctcatcatcaactcccaggatagaatgggcaatgggcaaggctcaaggagtcctccaccaaggct

SEQ ID NO: 708580 - DNA, 243 bp, Homo sapiens
aattattaagagttagtggtgaggaattttaaatttaatgttctatgatatagcacaacacagatttatttatttattatgaaatgggatcttgctctgtcacctaggctggggtgcagtggcgtgatcttggctcacttcaacctccgctcttggtgcagcatcctcctgcctcagcctcctagtagctggattcaggtcctcactcaccagctattttgatttagcaacggggtcccacct

SEQ ID NO: 708581 - DNA, 100 bp, Homo sapiens
cccccccgggttttgcccgggggggggtttttcccccccccccccggcttttttaagggggtttttttcccttttggggaagggaaaatttttaatggga

SEQ ID NO: 708582 - DNA, 718 bp, Homo sapiens
tggatagctgttccagaggatccctcaacgctgctcacatcggtctgacccaaagtcccacacgcagggtgggatgcggagatgaaggtcctgccagtgtcacgtggcggcttagatgacaggtttgaggggccttatcggcttggtcatggtggcctcgctgtggcctttcgtatagaaaaatctgcaggtgctcattgttctctgagtgactcactggaggtaacagcctacatacatgagcataaatgtggtcaaacatcccactcagaaatattcgtcataagccaaggcgtggtggcatacacctgtagtcccagttactcaggaggctgaggtaggggaatcccatgagcccatgaccgaacccctgcgacaccagcctgggtgacagatggagatccggtctcagaggaaacacatcagatgtatggtgtagctggaaaccgacaagacctttcaatgtccagtacgggataaagaaacttgatagtcattagaatgactacagcagtcagtgaaaatttgcagtcatgtgaaaaaggctgatgtgaggtcaggacacttctgaaaccactgtaatcggagctaggctgtgggctgggaggggaagatcctttgagctcaggagctcgaggctgcagtgagccatgattgtgccactgtactccaggctgagtgacagaagcagaccatctcctaaaaacacaaaatgttt

SEQ ID NO: 708583 - DNA, 348 bp, Homo sapiens
  misc_feature (118)..(118): n is a, c, g, or t
  misc_feature (121)..(121): n is a, c, g, or t
  misc_feature (221)..(221): n is a, c, g, or t
  misc_feature (242)..(242): n is a, c, g, or t
  misc_feature (248)..(248): n is a, c, g, or t
  misc_feature (251)..(251): n is a, c, g, or t
  misc_feature (266)..(266): n is a, c, g, or t
tcagctcggtacactcggagagtgcaagtcaggaatatcttcatgtcacaagtgaatggatctattctgtttttctgaaacagtctcacgtctatctttgcttttcccaccctttttnttnttttttaaaacagagtctcagtcggtcacccaggcgggagcgcgggggtacgatctcggctcatggcagcctcggcctcccgagttcaagtgagtctcangcctcagcctcatgagtagcnggggtnacnggtatgcacaaccangccgggctaattttggtattttaagtagagtcggggttcatcaggtgggccaggcgggtctcgaacccctaacctcagggga

SEQ ID NO: 708584 - DNA, 171 bp, Homo sapiens
gcccgagacacaatgtaccctttatagccaccaaaacggatattctgttctcgtatcccgaccgcagtgactctagagactgacgggagacattcacttgaactcgtaggcggcggtttcaatgatcctaaattgcaccattgcactccagcctgggggacaagaacgaga

SEQ ID NO: 708585 - DNA, 976 bp, Homo sapiens
  misc_feature (5)..(5): n is a, c, g, or t
tgttnataatactacagtatatagctggtgcggaagaaagagagaacaacgcaacgatcagggtccgcatgtgtccggtatgttgtgtgtacaaagagtccgccttattgtgcggtcttgttttctttagcgccctgtgtttcgcgaccacaatataagacgggggcccacactcttaattctgggatactgtgatatatctctacgcgtctacaagggttccaagaaccggctccgaatgtgaaatgtgtaaatgcccggcgaatctgcccggggacccccagtgtagtggatcaacgcgtgcaacgcgccccaaattgtcgggaccctgttgtctctcccccggggtcacacctgcatcgtggatcacgccttgctgacacagggaccccgagggcttttgtcatcaaccgcggtcgttgtcacgccccctgagcagaagtcccgtcgtgtgggcgggacactcttcggcttattcaaatagtggagaagatttccttacaaacccaagagttcttgtggcgcgcaacactttgtgacccacgcataatggtcagggggataacttcaacgatttatcataagcctcccctctaggaagcttctcagatacatctcagatactagtcataagtgcctcccgtaatttctgccatctctgatttaagccactgcagatggtatagtatagacacccttgatagcccactcctgtagagtagaacgttttccccgaatggtacgcccgcgcccatcgagcgctgccgtcgacatggaatgagatccccgtgacctcctccgtgagcccactggagagacagtctcattgccgctatgtgaacgtctttgcggaaaggcagggacgtctgttcaaacagaggctgtttctatgcaggtgcgtcttacggagaaaccaacagtcttaatcgcgcaaacgggcgaaaaaaaaataaagttctttctgaaaaacaagaca

SEQ ID NO: 708586 - DNA, 254 bp, Homo sapiens
  misc_feature (85)..(85): n is a, c, g, or t
cccggggggcccccccccaagcccggttttgggggttttccccccttttttttcccaaggggtgggcgggggggggggaaaaggntggggcccttcccgttttccccagggggggggcctttcccggggggatttttgttttaaccccaaagtttcccgggggttttttgtttcagccattttcccttttttttttttttggggggggtttgggggggggttttcccaaaaaaatttgtttttggggcccccca

SEQ ID NO: 708587 - DNA, 1238 bp, Homo sapiens
gatctgtgcgttggtgcgctcagtgtcatgtgtctgtgtccctcatgccgtttgtgtgtcgtcgcggatgttcttcccggtctggggtccataattcgccagcctcaccctttttggccgcccgggggggccccctgttatccccgctttggtttgtccggttccccgtgcgttgtgttttgttcatcgacagcgtttggggatttttttcccagtgtgtactttttatttccggcaaaaagacccccctggggatacataggttttggttttgggctttgagtctccacctggcttttcttaggggttttcttccgtgtggtgccacagccccatatatgttgtcccactattggacatttgtagtgtttgtgtcttcctcggggcatatgtgttcgagcagtccgtggcgtttcgccgttgtccttccgctttgtctgtcgccacccgggcgttctcaaagttttttttgtcctggagctttgccacccccgtgccccgggggacgcccctttagtgcaaattgatttcttcttggcccaggggcttttttggggccccttttgggatttcaattcgggtcgtgttttccccgccgctatgggtgtgccctgggcttgggccatttgttaattggcgcgaacgtctatccactttgaacactttcgttacttaccacggaaccacagttattttacgttgtttagactccacatttccgcctaagtagtgccctgatcccaattaaagggaactcgtgattgtgcccattccactaaggaaggcttcaattcacctgaattttccccctattttctccagggctaacccctctatgagcccaacctataccccccaaatccactttcacctattcaataatttcaatccgggcgtaaaaattttaaaacttttttcccaccaaacacctctttctcgcgcctattccggaaatggccccgaacgcttatctcgcgagctaaccccgaatgcactacacccaccactgtgaaccactcctattcacattctgtataggctcacattacttttttttacacgcacgtgtatattaataattttcactgagatttgagggagccttcgctttcgaaagcgaaaagtcctaaatatgtatgagagaaccctccactaaacacctggaggtgaactaataatggagatgccccccaccctaccacacatttgaagaacccgtatacattaaatttagacca

SEQ ID NO: 708588 - DNA, 879 bp, Homo sapiens
  misc_feature (54)..(54): n is a, c, g, or t
  misc_feature (79)..(79): n is a, c, g, or t
  misc_feature (84)..(84): n is a, c, g, or t
  misc_feature (92)..(92): n is a, c, g, or t
  misc_feature (95)..(95): n is a, c, g, or t
  misc_feature (124)..(124): n is a, c, g, or t
  misc_feature (135)..(135): n is a, c, g, or t
  misc_feature (150)..(150): n is a, c, g, or t
  misc_feature (159)..(159): n is a, c, g, or t
  misc_feature (166)..(167): n is a, c, g, or t
tggaaaatgaaaggttccccatcataggggattcttaagcacgttctccacgtntgcggggtgctagcgggatgtcttngggcntaatggtnacncgttgggcagggatagcacacaggtgggngtcttcaaaanggccaaccagatggncctcacggncctccgnncaaagcaccgatagcggcgctcgggaagcgcagactcggttttaaagttcccggagcaatttctcgcaccagacgcgggaggggaagtggcgaactcaaaagtcaggggactctcggactaacgctcataaattcagcggagcgccacagtaccgggcctgtaacgagtgaggtttctcacccctccagtagagggcggactctggcgaggggcttgtggtagccagtggctctccggggtggcttaaccaccggtcgatatgggggggcagtctgggttggtaacgagccagggtgacagagacctcctgataacccccagttctccttcggcggggagctcggagagcaaaaggggggctgggtggaggaaagagggaagaatagtctcgagtaaagactagcgaaaaatgcatcacaaaggagtaaagagacacccccagaggggggaccgaacacccttcgagggggagaacacgacccacggcgcccacatgggaagtgacccaccacaaagaaggttattgagacagggagaccccgcaagacagcaaaacacaaggacagagcagtatgacgccccaagaattaccaccaaaagagaggtggaaccacggacatacgcgactaaggaaagcggcaacaactgggccaaaaggaacacccgaagaccggaggaacccgcaaggaacagagacagtgcccagatgct

SEQ ID NO: 708589 - DNA, 156 bp, Homo sapiens
ggctcacttggttgcctaactcagcctcctgagtagctgggattacacgtgcacgctgaccacacccagctaattttttttttagtgtgtgtattcgagtagagacagggttacagcatgttgcccaggctggtctcgaactcctgagtctgcctg

SEQ ID NO: 708590 - DNA, 91 bp, Homo sapiens
gctcgacttttttttttttaatatggagtctcagtctcttgccagtctgaagtgcagtggtgcagtctcgggctcactgcaacctctgctt

SEQ ID NO: 708591 - DNA, 683 bp, Homo sapiens
  misc_feature (69)..(69): n is a, c, g, or t
catccaacaacaaccaccctgtccccaaaaggccttcggataccgggatatatccccactgttagttancctccacgaagtgttttttcttcccacaggattttttctgagcctctttaaccacactccacgccctatgcccgctatgccccccccatttataggaagggcacactggcccgcccaacacggcactcaccccgcctttaattccccctatggagaagtcccacctccgtgtagcaccactccgctatttatactcgcactacacaggaggtattcacatcgaccctgaggggtgcacccacatatggtgctataatatgagaaaccacacccggagacccacatatatttcacagcacctgcttatattaccacagtttactgggtctctattttaccctcctacaacgcctcagagtacttcgagtctcccttcaccactttccgagcggcatttatcggctcaacacatttttgtagccaccacggcttcccaccggagcttcacgtcattaattggctcaaatttcctcactatctgcttcatccgcccactatatttcactttacaacccaacatcactttgggtttgaacccccccctgatactggcattttgttaaaagtggtttgactatttttgtaagtctccatttattgatgagggttcttta

SEQ ID NO: 708592 - DNA, 286 bp, Homo sapiens
  misc_feature (3)..(3): n is a, c, g, or t
  misc_feature (186)..(186): n is a, c, g, or t
gangcctcctttgtacctggagcagtttctccccgcttcctctccccgtctgggcggagagacaggaggcctaccggtcgcatgctcagcaccattcctttcagactgtaggctggaccagtgacccaacacgacccctcacctttagggcctgggagggtggaggagggtctgctttagactganttctttttggttcaggcttgtgggttgtgctgggcatcacagacaggcttacaatttgagactgacgaaagcaaggaaggagaaaggaacagggaaaaca

SEQ ID NO: 708593 - DNA, 563 bp, Homo sapiens
tactattgctcaaaaaaaaaaaaagaagctcagtgccaccctagttgtaaaagtgtgcattttaagttcctctagttttatgtcattggtatagtatattctctgggactataatctgtgtttaaacaaaaacagcaaggaggtacctcctctttcgcctttggacccccctgctctttctgtctctgtacgagggagcttctcccgttctttctccctttcctttcttgccttatttaaacttctccacttcctttaaaacccacttccacgttgttgctccgcgttcatttttttctaatttggacattgaggacccaagaaccccgggttttccctccactttatcagagcccttatcattttgggttgtgtgggccgggaaaaggaaatttcaatcatcagacgtggtgtgaaacctcggaatttattcttgggacctcaagccggagaggatcacccaactcatggttttttgaggattcaaccccatggattgggctcggtttaaaggtctatctgagatgcctgatggaccagagtttcatcaaagccaattcaaa

SEQ ID NO: 708594 - DNA, 342 bp, Homo sapiens
gagaatgcatcaccgcactccagcctgacgacagagcgagactctgtctcaagaaaaaaaagaatggtagagtaaaaagaaccctttgctgagtaaacgagcctaatattttgtgtttttatgagagtgaattagaatacccagcgataaatatttaccacaacctgtgtccaatcagtgggacattaaacacagattgtacaatgtgagcttgggagttaatggcccagattttactagtcacggcagaaaagagtccggagtagtgtagtcttgtctatcactgaggaagaacgcttgaacatgatacaactaaatctacatattacgtgacacaaagct

SEQ ID NO: 708595 - DNA, 408 bp, Homo sapiens
ccccaccatccttatccaaaagcagccatccctagtaaatgtttgcactaaaaatacaggacacacttatttatgactttccaaacagcttattaaataaataaataacactgagctttatttaaaggttccagccaggtgcagtggctcatgcctataagaacattttgggaggccaaggcgggagaatcatttgaggccaagaggtcaagaccagcatgactaacatggtgaaaccccgtctctactaaaaatacaaaatttagccagacatgggggtgggcgcctgtaatcccagctactcgggaggctgaggcaggagaatcgtttgtacccaggaggtggaggttgcagtgagccaagatcacgccagtgcgctccaggctgggtgacagaacgagactctgt

SEQ ID NO: 708596 - DNA, 110 bp, Homo sapiens
gtaactggggtctgtaagttttaatccaactgttctattgaaaaatacactatcttgcaactgcgcttgaagctagcacaaaaatacagtttttacaaggaggtaataaa

SEQ ID NO: 708597 - DNA, 232 bp, Homo sapiens
tgacgtgtatgactgagtcgtattgctgtacagtagaaattgacagaacactataaaccaactataatgaaaaaaataaaaatcattaaaaaaatttcacactcatattttgggttctcaacatttagaattaaggcacagacaagaaaatcttctaggtcaattatctccccaacattcaaagggatttcatgtccccaacgcttcgtttgggtttcccttgccatgctgg

SEQ ID NO: 708598 - DNA, 625 bp, Homo sapiens
  misc_feature (625)..(625): n is a, c, g, or t
ggtggttggtctgtctggtctcggcctgtggacactcagtcacgttcttggggtgctgcaggcgtctcatgatatccgaggaccgtggtcttcctcacgcttgccactgagtgctccgtattgcgaggggtgtagcctggtcttgtcgaagtggagccgttggggttgggaatgagcgaggcgatgagcgccagtatcaggtctgttgtacatgtagccaggttaacgcagggtggtgatgctggctgatagtgatggtatacatcaggtggttgatctggtagaccgatgggttctggatgttcagggggtctgtgtcactccggttcagggctgtgttgtccagcgccaccacagcgttctgcattctgtggtcgtgcctcttgacgtgtgcggagtgcatttgtcatggctggtaccctcctttcgctcatctcgtcctggttgggaaacactgagtatgtctgcaccagcttcttaggatacctgtcattcagccgttctaagaggtaggaacccagtccagagcctgtccccccagcaatggagtgacacagcacaaagccctctagactgtcactaacatctgcctcccggtctatgatgtctaaaatggtctcatggn

SEQ ID NO: 708599 - DNA, 488 bp, Homo sapiens
cacgagatttggtatgactcagatcgtggtggactgagagtccaaaggatcgttgtgtatcttatgtaatgtaaaagtaaaaacgtgtaagaaagaggtagtaaataagagaggtgtgaaaaaatgcatacttaggcaaaaaccgcgtggtgaaacatcttcgattagaattcactttctgccgggaaagctgctgcataggcaaagtgtcctttccaacgcttagggccttgggccccaagaccccgaagtcaaagcgatcccggctgtgttgggataatttgttccacattttatccgggggcagtccccagcagaccccatccccgacctgcactagtcctgcgctctgatgcttcttcactgtccacccttgaggtttattttgaagccaaaagaaaaagacagctgggcatgttgatgtctgctgactatgccacaggttgaggggagaggcgatctcaacaatccccctgtaataacatcaa

SEQ ID NO: 708600 - DNA, 343 bp, Homo sapiens
  misc_feature (270)..(270): n is a, c, g, or t
tgaaggagtttttgctcgtcgcccaggctggagtacagtggcgccatctcagctcactgcaacctccccatcccgggttcaagtgattctcctgcctcagcctccacagtagctaggactacaggtgcctgccaccatggctggctaatttttgtctttttagtagagacggggtttcaccatgttgggccggatgatctcgatctcctgacctcaggtgatccgcccgcctgggctcccaaagtgctgggattacaggcgtgacatctngcacccggctcgtgttttaaggaaatagctacctaaggtattcttattaaaacaaatgaacaaaaagttttcc

SEQ ID NO: 708601 - DNA, 415 bp, Homo sapiens
  misc_feature (86)..(87): n is a, c, g, or t
tccccatcccccccccccttcttcccaccaaagctccgtgttaatttaattttggggaggttgtttggggggagaggacccccccnntccccccccccctttttttccattaaacacaaatgtgggtgtgggttcccccccctttttttcccccgggtttaagcccccttgaagaaggggccccccccaaaaggggtttttttgaaaaaaaaatcccccccccttttataccccctttttttagggtgccccctttattcccccccccccgggggccctccccccccccccaaaaaattttttggcccctttttttttttccccccccgggggtttttttaaaaaaaaaagggggggaaacccccccttcccgggcccattttttttaaaacctttttcccaaatggggggccca

SEQ ID NO: 708602 - DNA, 284 bp, Homo sapiens
  misc_feature (76)..(76): n is a, c, g, or t
  misc_feature (131)..(132): n is a, c, g, or t
  misc_feature (222)..(223): n is a, c, g, or t
tgtccttctgaaacacaaagtaacaatgaaatgtccccaccacagaagacaatcaatcctcagtggcctcccactnggcaccgctttatttggatgaccatgcacgcctaaacagcacagtgtcccagcannatccttgcctgaatgcttgatcacgtggtgatcctctagatgtctgaccttgcatgtgcatgcaatgccttgtgcacttggcctgtctgnnttttacaactgtctgttgacttgtggaacaacccctgtgctgccccccccccccctccccc

SEQ ID NO: 708603 - DNA, 319 bp, Homo sapiens
aacgaagtgcaatacagattttagtagaagacagatctggagaaagtcatattactatagtgtctcaacaaggtgcatacttggataaaaagaacatactgcattaattaaaaagaaaaatccaatgtggaatagcccactaacaatacgtttgtaagaaacagaaataagcgtttacatgctacaaatatttctgcattgatatcacatataactgtgacaactatacaactaaactgatctgtggaatttttcatggcatcatttttataattatgtttgctcacctatactgtccaaatgtggtacttcgtttcgc

SEQ ID NO: 708604 - DNA, 361 bp, Homo sapiens
ttgtatcactgagcatgagtgtagcagagggatcttactcaaagttgtcactgcaaatcagtgcatatcaaagtcacacgtctgtgaacgaagtataaggcaatctgcagccacatacttttaaaactatgttagagttacaactacctaggagatgtcatatttcccttctggtcttcgtcaaagcttttctttgctgacagcggtgaagctgagctgagcgtggtggctcaggcctgtaagcccagcactttgggaggctggggcaggagaatcacttgaacccaggaggcggaggttgcagtgagccgagatcccaccattgtactccgcctgggcaacaagagcgaaactccatctc

SEQ ID NO: 708605 - DNA, 233 bp, Homo sapiens
  misc_feature (150)..(151): n is a, c, g, or t
atggtagtgaccaaggaggtggaggagaagggaagttggatgcggacagactgaccatggctgaacatcggcgtccacagggcagtccatgcacatacccctccggttgcgcacactgcatgcctgggaaaggccagcactttatggacnntggggaggccccaccccctccccacacccctgctccccactgccgctgctgcctcaataaatctgctgatttgcaaaaaaaa

SEQ ID NO: 708606 - DNA, 118 bp, Homo sapiens
attttatctgaaggctgctaaggaagagagaatacagttttctagagaataagagtgcagtgtatggatctgctgcaaaaccctttcctgttactagctcctatgccttctactactt

SEQ ID NO: 708607 - DNA, 314 bp, Homo sapiens
attcgagctcggccccccagcggctacaagatttagcaattaataattgctatttgttaattagcacttattagccgcttttgaatggtctgagggcttccggcctgaaggctgaccgcaggcagcaatcgcctggctttcctgttggatgcaaataaagtttcattctaacgcgaacgattttgctggactggctgggaagcaccctgcccggcctgcatctaaagtttcatcctaatgcctagcagcggccttcaaacggtctgaaaaccacggagccatgcaaatatagtttcatcctttcctgcattttg

SEQ ID NO: 708608 - DNA, 212 bp, Homo sapiens
gtagaactctaaactgctcttgaggttgcagcagtaactcaggtggaaagcactagcttaggttctgttgcctctcattcagtttcagtagtaacttggacaacctgactcctctgtacagtctgtaaaagtgatctttaaggacctcactgccatattctcttgttctcaacagggatcctccttccactttcttggtagcatagaactag

SEQ ID NO: 708609 - DNA, 190 bp, Homo sapiens
cacgcccagctaattttgtatttttagtagagataggtttctcccgttggccaggctggtctgaaactcctgacctaagtgatctgcccacctcggcctcccaaagtactgagattacaggcgtgagccactgcgcctggcctgcctctgcattttcttgattgtgctcctggtcctctttgggtttagg

SEQ ID NO: 708610 - DNA, 1330 bp, Homo sapiens
  misc_feature (154)..(154): n is a, c, g, or t
  misc_feature (427)..(427): n is a, c, g, or t
  misc_feature (767)..(767): n is a, c, g, or t
  misc_feature (1129)..(1129): n is a, c, g, or t
  misc_feature (1330)..(1330): n is a, c, g, or t
gatacatccatggcgggtggttctgcttcaatgcgaggtggtgcaattgcggcgactaggatgcgcgcagcccacgtgcaggtcctgccgagggccttgccggagcagccacggtctctctatctgatcccggggacgcacatgacacgtctgntgtgtccgcttaggattcagcctcgcgtcgatcgtgacgttcgcctgtggagaattggagccaggccggccggcgatgttggtcggcagggtctagcgctggcctgagaggggcggcggtgagaggctgagagagacgtgcacggcagcgttgcgtcgggaccacggatacatacgggtggcatgctcttcgttcgcgctagagtaattcacgggacctgtagcgaaggaaggtggaacgtacgtgcacgtgcccttggcggtgttgtacctnctcgccccgggagacgcgcaacagtgtggccactgggaaaacagcatttgcgaaggcctcccccatcgcggggaacttggcccaggaacaggtttgtaggatggccgttgctttccacaaaagtccggggccttccgttacactactttagtcacgagacggggtacgcgtggggcggcatccacaaggggctcggagattggcggtagagtgtcgcttgggcacaagactcgggaggaggctcccaggattggcgcaaccagtagatacggcacttgggaaaccatggtcgggagccatggggattatcagacgcgaactggattctatgaagcttctnttgaaagaggtaccccaaaagggggcaaccttatcgaaattgacaaactgtggacatcccgagcaaaggaatgacatattgcggttccttaatttcaaggtttgtaccgatattcccttctagcccaagcggtgaacagccgagggaacaaaagcaaagactttaatcaccccacattttgcgattgagagtcccttgggagaagcacaattggtgggaagaggggtctggaggacagcagcagaggagcccacacgcggatagcgcgagaggggtgagcaccaaatacaggcagcggaggcgaaagacgataccccacaatgtgtgagcttcaccaggaaacgccacaggtggcgcgagtncgcataaagcaacacggcagtgtcgccagccagatatagaaagctataggccgccaaacccgttgtggaacacagagcaccaattcctagtggagcccatttttccgtgggggggagagaatccgcggagagactcagaggaactaggccacagggtgagactagatcgacaccaaacaacacattgtgcaaccattacan

SEQ ID NO: 708611 - DNA, 374 bp, Homo sapiens
gcatccagagatcgaagaaaagcctgctggtttaaaggtaacctctaggtgtagcactacgacgcaggaatgaagagaatacagacctggaaacaatgccaaacctaaatctagactcatgttagacctgtcagtaagttacctagcatctctctaagaataatccgcatccaggtataactatggagaaaacggaatgaggggcatactctataagccaaaggctggctaaaaatcacctttgtaaaagaatcaataattctgaatatgcatttacaacatgtatttacttcagtaagagctcttttagaaaccattaaggacggtaagaatatctgtacacacagtcatgatatagaaggaaattcagacaa

SEQ ID NO: 708612 - DNA, 348 bp, Homo sapiens
gaaaaagaatggaaaatcttgaagccttagaattaggtaattgtggccgggcatagtggctcacccttgtaatcccagcactttgggaggacaaggtgggtggatcacttgaggccaggagtttgagaccaacctggccaacacagtgaaactccatctctactaaaaatacaaaaaattagccaggcatggtggtgggcacctgtagtctcagcctcccgagtggctgggattgcaggcctgcgccaccacgccgggctaattttgtatttttagtagagacgaggtttcatcatgttggtcgggctggtctccaactcctgacctcgtgatccaccagcctcagcc

SEQ ID NO: 708613 - DNA, 1737 bp, Homo sapiens
  misc_feature (646)..(646): n is a, c, g, or t
  misc_feature (883)..(883): n is a, c, g, or t
cctaggtgtccgagatccattaccccttagaagccagtactgggggatcgaagttgagtccatctccatcccttgcttggtgcgtactaggtagcaagcttccatagcgtggctggagtccgactccagtacatggtgcagtcgtgagtctgaataaagtgccgggtggcattcgtgcacagaagtgaagcagtcgtcaagacaagtctggagcaaggcagtggcatgttcgcgctatggctacagcgggttcctctcaaacgctgatagccttgcgcgatacatccgagatgcacattgcaaggtggacatgtgaaacgtgggtgatccaagcatcatgagatacgtcccgtgtgggtcggcacatctaggagagcgcatgcgaatggtgatcttcattggtgggacttgatgcaattttggatagccgtcgatgtgagcgagcaaggcacgtacctttctaatttcgacgatataaacgactcggagggtaaaccccgcggtgtacctacttctgtacaagggcggacattgaagcttgcttgtccttgctcctcatacggactctagttttcggtctgtgggcctttggtggtgggcttcctcgtgcttgccaggaagttatggtggcaccaagtgcgtgggnggtcatttccttttctccaaggagtggcatagtagtggggggctaaggaacgcctcctggaacgtaaaggacctactgcggtcccccattttgcctccgagttgttttgacaacacgggacttgtcgcgaggttcgtttcgcaaaacaccctccgcgctactatatgttggttctgcgcccatggtattcggaagatgcgatgtaggaatttttggtggcagcttctccgcaatgantgagaatgtcccgattttctgctgtaattagttaccacgttacaacgcaagaggagttacttggtaagggcgtgggaagggtgaagaatcgaaagggggggaaaaggggtcctacgaaggaggcgtttaaaggattataagagagaaacagaatttggaggcaattaattaaaaaaataacggtggagttcactatttgaatattaaaggaaaataggatagaccaaaaaatataaacgtttgggggtttatggggcaccacgttggtgttttgaaaacaaaaattatatttgccctatggggaacagggagcgagacggacttagaaattcaaataaattgtgcaccgttatgtgatgatacacaaactgtggtggcattgtgtgtgctaacaagagttgaggtgcgcgggccaaaagagggatttgtgggacaacatggcgccatagtatgtgtgaaataacccacatgagaatgtatatgtggtacaggggtgatatattgtgtaacatagtgaagttcgatataacacactggcgagaacaatccagtctcctacaaactgtgaagtgagaggacccatcttttgtgggcgcagtggaacaacacacgccaacagggacttgtctgtacagcagtgacaagtataggggcgaataggtagaaacactagtacacacagcagtagattacgaaagaagtgacaacaccaggggcgtagtacactaaaaccgcctgtagtagagggtggtgctactgtgtttgtagtccatagcatacacgaaatataacgagaagcgagaacagagtgtgtgcaaccgacagcatgacacttaaaagaaaccactcgcggc

SEQ ID NO: 708614 - DNA, 1336 bp, Homo sapiens
gatgagagtgagagaggtatgaaggttattgaaaaccgggccttactaacgatgaggaacacgatggaactccaggaacactccaactcaaagaagctaagcacattgcagaagaggcatgataggaagtatgaacgaggtggctcgtaagttggctgatcacttgagaggagagcttggaagcgcagcagcagcgtacacgagcctgacgcctggccagcaggtcccggtctgccgagcagactggactgacgcagacttacgacctgactggaccacgaaacctgcacagctgctctgagctgctgcctgcaagaaaaaggtacatcatcaaccacacagcaagactaacagtatgcacggaagagaagtccaagcacttcttcaacctgactaaacaacctccaaagcgcaagcgccagcaaccaccccggatgccctgccgactccctgccgagcaaggacgcactcaggcataagcccgcaaagaccgtaggcaccatgacaacccaccaacacatctgacactgcaccgccatgggatcaacccacttacacaccctgacaaactggccagccaacacacgaaagcgaagccacacaatcaatgctaagcaacacacacggaactggcttgagcacccaagaagccccaatgcttactcgaccccgtggcgaacttgccacgcatcgctaccgcaagaccggcccccccccaggcttccgcaaccgcccttagccttgccttggcctccccttcccccttcctggcaccccgtaggtaactcccggccctttgggcgcgccccactgcccttggccggcgcgcccacgctctgcaaccccgtctctgtgagagcttgggacacgcgggctaggcactgctttatcgacgaaccttggggttacggcgacttggcctgctattcgctgccccttagttcacgaagccaacccgcccgcacttacgcttttcccgcctgggtgctacgtatatgcaacaccgcccccacacacagcctgggtacttcctaggccctgtgcttttcaccccgggcacgcagccttcccacgcgccgcggcgcgcgtcctaaccgcaagcggccctcggcagcgccagccccttcttggcaccacgccgcggcgccttctctcaccggcgacctccttgtcgcagcgcccacccctgcgccctctacactgcggctccgctgctcgtcacatcagtgccctctctctcggcgccgcttgctatcccgccccgctctgtcgcgcgcgcgctctaccccgctctctccttcgcgccagacgatccacgctatcgcggcacccccat

SEQ ID NO: 708615 - DNA, 265 bp, Homo sapiens
cgtggacggatgtggtggttggcgatgacctggtcgcgtggcaccgcacggataggctgaggccatcagtggagatgtggatggagatgctcatgtccggcaaatgcgaaggttgctcttcgctccaggaacggtacgccaggtgcctttgttgggcggcctcttttcattccagcgatccaccggcaacgccaggtctacggtccatcatggcagcactgattgactgtgcttcccatggctcacactgcgctgtcgcgatgtt

SEQ ID NO: 708616 - DNA, 290 bp, Homo sapiens
gtagattctagaggatccctgtggctggggaagagggctgggctgggaagaggggatcgaagttttccttttgttctagttgcaatctctttggacttctcaactggagtgaggacgatggagccagcctgcccatgagacactttcctcatggtcattcttgcttccgtgtcagcgtagccctattgggtgacgttaaggctcgccagtggtgcaggtgacagagactgtcggcctcgatccctccttacttgtggtgtgtgctccatgtgcagcaggggactggcgtg

SEQ ID NO: 708617 - DNA, 447 bp, Homo sapiens
  misc_feature (73)..(73): n is a, c, g, or t
  misc_feature (271)..(271): n is a, c, g, or t
  misc_feature (343)..(343): n is a, c, g, or t
  misc_feature (365)..(365): n is a, c, g, or t
  misc_feature (382)..(382): n is a, c, g, or t
  misc_feature (417)..(417): n is a, c, g, or t
  misc_feature (420)..(420): n is a, c, g, or t
  misc_feature (426)..(426): n is a, c, g, or t
agaagtggatagatgcaagaggcatttagaaagctaaactgtcagatgtgaggatgaattggaagtgcgggtngcggaaggaaatgtcaggtgttgacccatttttttaaaggtaaaatcatgaccttcatacaccatataaaataaacacgtcaaatattttatttaactcgataatgaatacatcataagttgttacaaattgtttaaagaatttggccagatgcagtgcctcgcgcctgtaatcccaacactttgggaggccaaggcnggaagattgctggaggtcaggaatttgagacccagcctgggcagcatggcaagaccctgtctctaccaaaanaaaaaaattttttttaagaaanaaattagccaggcatgntgacgtttacctgtggtcccagctattctggaggntgnggcaanaggaccgctccggcacgggca

SEQ ID NO: 708618 - DNA, 574 bp, Homo sapiens
  misc_feature (2)..(2): n is a, c, g, or t
  misc_feature (40)..(40): n is a, c, g, or t
  misc_feature (511)..(511): n is a, c, g, or t
  misc_feature (531)..(531): n is a, c, g, or t
  misc_feature (547)..(547): n is a, c, g, or t
  misc_feature (551)..(551): n is a, c, g, or t
cnctcacggtacctcaagtaattcacccacctcgtcctcntaaaatactgggattacacgtgtgagccactatgcctggccgggatttttacgtataagatcatattgtcaacaagtagaggcaatttaacttcttttttttctattacaatgccttttctttcttcctcttgcttagtttttctgaataggacttccagtactgtgtggaaaagaagtagtgagaatgaacattcttgtcaggtccctcatctttaaagatttcagcatttcactcttccatatgatgttagccatgggcttgttctgcatgtcctttattgtgtttaggtacattccttctatacctaatctattagtagttttgatcacgagaggctgttgaattttgtcaaatgcctcttctgcatctattgagatgatgatatgacttttgtcctttattttgttaatgtggtgtatcatatttattgacttgtatttgttgaaccatccttgcatcccaaggatnaataccactgtatcatggcnaaagattattttaatntgtngttgaatttcatttaatattttg

SEQ ID NO: 708619 - DNA, 346 bp, Homo sapiens
  misc_feature (18)..(18): n is a, c, g, or t
  misc_feature (21)..(21): n is a, c, g, or t
  misc_feature (63)..(63): n is a, c, g, or t
  misc_feature (88)..(89): n is a, c, g, or t
  misc_feature (101)..(101): n is a, c, g, or t
  misc_feature (103)..(103): n is a, c, g, or t
  misc_feature (110)..(110): n is a, c, g, or t
  misc_feature (114)..(114): n is a, c, g, or t
  misc_feature (116)..(117): n is a, c, g, or t
  misc_feature (158)..(158): n is a, c, g, or t
  misc_feature (163)..(163): n is a, c, g, or t
  misc_feature (177)..(177): n is a, c, g, or t
  misc_feature (195)..(195): n is a, c, g, or t
  misc_feature (197)..(197): n is a, c, g, or t
  misc_feature (243)..(243): n is a, c, g, or t
  misc_feature (248)..(249): n is a, c, g, or t
  misc_feature (254)..(255): n is a, c, g, or t
  misc_feature (285)..(285): n is a, c, g, or t
  misc_feature (337)..(337): n is a, c, g, or t
  misc_feature (339)..(339): n is a, c, g, or t
  misc_feature (342)..(342): n is a, c, g, or t
  misc_feature (345)..(345): n is a, c, g, or t
caatggcgctcaatattnctnatctgcctcttcctacacatcgggcgaggcctatattacggntcatttctctactcagaaacctgannacatcggcattntnctcctgnctcncnnctatagcaacagccttcataggctatgtcctcccgtgcagnccaanatatcattctgagngggacacagtaattacanancttactatccgacatcccatacattgggacagacctagttcaatgnatctnnggagnntactcagtagacagtcccaccctcacacgnttctttacctttcacttcatcttgcccttcattattgcaggcctagctggcncnccnccnc

SEQ ID NO: 708620 - DNA, 214 bp, Homo sapiens
ctaggttttcttctaaaattttatagttaaggtctgaatttttgtatatggtgagaggtatgggtccagtttcattcttctgcatgtggtcagccagttttcccagcaccattttttgaataaggtgtcctttccctattgtttatttttgtcaactttgtcaaaaatcccttggttgtaggtgtgcagctttatttcaagggttctgtactct

SEQ ID NO: 708621 - DNA, 184 bp, Homo sapiens
ggcagataagcacgcgtcgacgacatcccgcgtcaccacaggtaactcgccccaggcgtgatcggagtcaccgcccagaagggtatgtccaagtcgaataaagccaggcgcatagcagatactcgcggaccagtctgtaccacggcgtccagcatacggtcataacaggagagtgcacataagg

SEQ ID NO: 708622 - DNA, 110 bp, Homo sapiens
agcggatatacatactggtatggatgaaacttgatccctagttcacaccatattgcaaaatcatttcctgggctcaagggatcctcttggcctcagttcatcctgagtag

SEQ ID NO: 708623 - DNA, 116 bp, Homo sapiens
tacgattattgttttctgagatcagagcaacttagaaattggaaatatgtttgaattatggcttactatggcttagaattatcttacacttaattaaattacattttaaattaaaa

SEQ ID NO: 708624 - DNA, 161 bp, Homo sapiens
cgacccccacctccgcacgaacacgagagactccatggcatgctgagcccctgcagcctcctagtgctccagcactcgcaggtccattcttctgcacgagcccctctgtccagatccataagcacggtcagctcagggtcgcggagcagtacgaggacaag

SEQ ID NO: 708625 - DNA, 177 bp, Homo sapiens
tcacaagagaagagacgagatgaagagatagtaatagccctgttttgctacttacagtaatagaagactttaaaaaataatcactgcacaaaattgtatagggtggggttatgctgtgatattaattttcctcaataatgtttttcttgactgttcacctaacaatttagagtttcc

SEQ ID NO: 708626 - DNA, 308 bp, Homo sapiens
ccagttacaacagctctagtttttttttttgtcttaggttgttactatcttcgttccgtgaaaacactccccaaaacccccctttccagttacaattagcatcgggatccaggcagggcccatatggaagaggaatcgccatttactcggaaaaaatgccccttacaggagcacgcgtaagttaggcaggaaccggccggcctatatcaaaaataacgccagcttgcttgggaggcatcagggttgctcctttggcgctttttcttgcagatgggccaagcccggtgtcggttccgattttccccttg

SEQ ID NO: 708627 - DNA, 194 bp, Homo sapiens
  misc_feature (151)..(152): n is a, c, g, or t
catctggggcatcactgcaggttctctgaagtattcatcagtttttggctttggtaatggggttctttcctcctgggtactggtcccagggaaaataacccagaagaaatttccaggctggcttttctcaagtgcagtgactacagtcccnncctctaaatatcatctggcttcatacttatctcacatttaaa

SEQ ID NO: 708628 - DNA, 638 bp, Homo sapiens
gcccggataagactagatgataagggaacttcaccgctagaaagcgtcccactagacacatactagtgcggccgctgtggctataagcctaccaccttcagaagccgacctgtggcaaacgtggctaccatgtcaagcgcaagagaaagtataactgtaatggcaatgctaaatgacgaactaccaccggaactggtcgaacgagccacctaaaaattgctaaccgaaattcaggcatggatatcgtgaaggaacaacacctatacccaagagggcagctgttgcagtatccagttcatcttacgaatgtcaacgattattcatgcaataaatgttctgctttcaaaaaatataagtggatcaactgacaaattcgtgtgggccgcctagtcccagtcgactctaaactcgcgcatgctcaatcatcgcgccgcaattggtgctcacttggccaattcacccataagtgagtccaatacacttcaatggccggagctatacacccttgcgaatgggaaaatcattgcggttacccaacattaattgcctcgcaagtgtctacttctgtccacatgcctaatgaaggagcccctcacctatagaccttctcaccaataggccctcttaattgccgtccg

SEQ ID NO: 708629 - DNA, 782 bp, Homo sapiens
  misc_feature (652)..(652): n is a, c, g, or t
  misc_feature (661)..(661): n is a, c, g, or t
ctgagattgggtggttctgcatgtgtgatgaatctctttcacacaaatagatcgaggaggatgtttaggtgctagatgagcccagattgtgcttcgcccctccgatctctcaggggagacaaagaacctccttcctggaccagggaggtgcggccaagttttctagcccagtgcacataaccagtccgttatacgcatgacattgtggaagtgccccgggtctcgctggcgatccctactcactgtcccacctgctagtgctcgtctgtggctcgtggaccctggcctagggggttctaagaagctagctttggaatgttgaagcatagatgcaaacgtcacttgcctgatcagtcttggtatcagacgtgtgactcacatggttaaatagacctggaatgtatgccaaggcagctgcactatctagttcattggttcatccgttgggatgatgggtgatgggcatgtgtaaaggcggagatccaggacactacagccctcggtgatatgactatggcctgaactgttgcaaacacggattatatggggggctgcgttccggctagctcggggtgtctcggtggaatacccgagagcggctgcattgcctactgaggcgagaggagatacctacagttcattccacctcctntgttggtgncctgctacacttgttacgatgactcccagaaattatactgcttcagtcttgggttgaacagaaggctcagtggtgtaactggtccgcttgctgtacagtaggtgaacatgtgtatggccga

SEQ ID NO: 708630 - DNA, 341 bp, Homo sapiens
  misc_feature (53)..(53): n is a, c, g, or t
gtctagctcgccagtggctcatcccactctactgtgccactgtgtgtgccctntgtacagccaagcccaatcaagtttctcttccagactgtgtggcctttggaaaagccaagcccaaacagtgtctcttccaggtagtcttccctagggactccaccttccctcagtgccctctcctgtgagattttggaacataacttggtttgtgctactcatgggtttgttctcagcctgggctgccagcaagtggaaattcccactcctgctagatttatagtatttcagtctttgtcgatcccagccctcttgtgaaaacctgagatctcatgtgaccctgcccc

SEQ ID NO: 708631 - DNA, 137 bp, Homo sapiens
caaggtcttcagtcgcaattcataccttgcccaacatctgataattcatgccggttgagaacccttataagtgtgatgattgtgacacagcattcagtcaacattcacacttgtccacatcacagattccatacttg

SEQ ID NO: 708632 - DNA, 513 bp, Homo sapiens
aagacttcggacactggacaccctttttcctttgcgatccccgcccatcgctcggcgccgtgcgtcgcactctttaggccatcaagaaccgtcttccgcatgtagactatccttacctgtttgatgccatctataggccggcacctagctatcatgtgctctgactgtgatacgactgcgctatctcaacaagctcaaaacctaaaacgaccacagaatatagagtgccttaacggcgaaagggaatcctttagagaaaacaaattcgctgaggatacggctacctgacaaaccagctcccataaaatcaccgtgggcactggctaacgtatttgcgaactcggtcttcacctgaggaagtggctaaagtgcaccaacttcgccttggtcgtaccaggatgacaccaaaggtttaggtccctcaagattacgacagaaagagctcagctgtctccccacaagcctgaacttaacaactaccggatcgccgctccaaagactcattgacttgag

SEQ ID NO: 708633 - DNA, 822 bp, Homo sapiens
gagtctatcgctgtcgctgtatgtgagcctagtggcgctggattctgtggaccggaaccttaaagatagccgcaatggatgaaaatggtgataatgaaacgatagttgccctggaggccataatctgccatcaaatgagtattattatcggcgacttcaatttgccactgggacaagttcctacaggaacagcatcaaaactggatgaacgcgctgggtacctttcgagataatgcataaacattcaacgaggttgaaccgtctaacaacagactttaatgtaattgtggaagcattgagcaaatccaaggcagaactcatggcaaatcagtgaagataaaactaaaatcagaaggtctccaagcaaacccctacctgaagtgactgatgagtatacacaaatgatgtaaaaaacagatctgtttatattcaaaggcttcccaagtgatgcaactcttgcatgacatacgaagaatggttagaagatcacggtcaagtactacatattcagcatgcagacgaacatatgcataaagcattttaaggggatcaactctggtcgcgtcgctaagcattgaactcctgggtcagcaacattttgtcagcaggaccccccctggccccacgaaatgttactaaatgacaaccagaaccttggctaaataacttattcaagggacggattaccctttttgggcccaaacaccaactggccgacacggcaaagcagaacaacaggtggcacgctaaactttaaggaagctaaaacccgtgagcccagcaaaggcaaacacagttgacacagtgctgcctgactctttg

SEQ ID NO: 708634 - DNA, 193 bp, Homo sapiens
  misc_feature (9)..(9): n is a, c, g, or t
tagtactgngtggatagaggaagaggaaggcagtgtgatgaagaactccagtagcgccgcgcatgtaggcagagatggtggcgtaagcagataagatgatgaggtcagggcctgcaggaccgagcatgtggaacttgccatgaaggggacacaggcagggcgcaggcctttgccttcccctccttggaagctc

SEQ ID NO: 708635 - DNA, 544 bp, Homo sapiens
acaaaaaaattttgcaacctctggcataaatgagttaagaatgattagagtgtagtcagttattcaggatatagatactaaaaaaaaaacatgtaaatgtgtcatgaaacaacaacaaaaatgtaaaacaggataaaataaatggtactattttgtctgataaaccacagggggatttctaatgtttgtttactacagtagtcttggcatccacaaaacaacaaaaaatcttacattagagaattctaacagagtatataatttctgcccccaaattgtcttagcgttagatgaagcgtttaatcaaattttctatttctgaatacagggctcattcagtaatagatctaagccaccactaacgtgtttacatctttcttcttcccgtgttcaaaatttttttttttttttgagacagggcctggttttgtcgcccaggttggagttcagcggtgcaatctaggctcactgcagcctcaccttctggactcaagcgatcctcctgcctcagcctcccaagtagctaggactacagggagttgcc

SEQ ID NO: 708636 - DNA, 236 bp, Homo sapiens
  misc_feature (167)..(167): n is a, c, g, or t
  misc_feature (221)..(221): n is a, c, g, or t
ccaagagtcagcaacaagctatttagcgtgtgccccaaccgttttcctcgacgccctaagaacccccctcctaatactaactacctgtactcctacccctcgacaatcatggcgagccaacgccacttatccagtgaaccactatcactgaaaaaaactctagctcntctagtactaatcgtccctacaacatctccctgtaattgtaacaattcacgagncctacagcaagcgta

SEQ ID NO: 708637 - DNA, 363 bp, Homo sapiens
  misc_feature (342)..(342): n is a, c, g, or t
aggcattgggtggatgcaaagttaaagagctaaacatgaaggccgggcgcagtggctcatgtcacgtctgtaatcgcgccccactggctaaagtttttttaaagttccctaaacaactctaatgagcaacctgggttcacaaccacttctttacatgcatcttcttttccctttcttccattgttttcttggtgaatatagggttggggtttatttccagatgggaaaattaaagcataaaaggttgaatagttcacccaagattaaatagctggtaagggatgaaacgaactgaacccagttgtgcttgactcttgggcccattgtgctttacatgatgcncaatacaacacacttattcac

SEQ ID NO: 708638 - DNA, 1100 bp, Homo sapiens
tgtattgtgtggtagttttattgtgtgttttgttattatatttaagaggagaaaatgtgtgtggggaatgagttgtttatctatcgggggtgttgtgggatgatattgtatttttttttatcatcaggaggggggatgagaagatgggtgggtggctaacacggttggaggagtggagagaaaagaaggatatatgattttttgacggggggtggggggagtggatttttgttcttctttcgatgtgttaggtgatgaacgtgtctctcggatcagcgggggtgagtgctctcgtcttgcgtgtggcctcgtcgcggcggttgtgggtggggtagactctgcgcgtgtgtggcccctcttcctgcacgcgcgcgccacttgatctcggccttctcgctcctcgggtttgtatcccgccactttgttgtttttcttctgttctctttctagacacactctctcattattacgaacacacgctctgtgctgatagatagtgtggtcacactacacacactgtgttgtgtgtgtgttgtgtgtgtcgacactacatgttgtgtgtatagagagtgaggcactctgggagaggttgtgtgtgtctctctgagatagatgtgtgagagattcgcctctcctaagtgccactaccatctctcgcgtgtgtataattatccccccttatgagagagatagtgtgaggtctctctctcgccgcgagtgtttctggcgcacattgatttctagagtgagggggtaaagagatagcacccatgtttcgcctctctctctcacacagagagagtatagggcgcctccacactggaattttttgtatttgtagagaggagctccattgttgtggcagtggacctacagtatagtctcccactcacacagagggtgttgtggagtgactacatgggacacccagcgtgttgtgcgaatgtatggtgggtagcggaaccccctccccttaaacattcccctcgggccctgtgtgatccacggtgtgcgcgcccccatactccgcttctcctccccggtgccccaattagaacaaaaatgtgtgggtgtgttttttttttataatataaataaat

SEQ ID NO: 708639 - DNA, 194 bp, Homo sapiens
agcggccgcctttttttggcctgggacaagatctgagggtgtcggacaaggtaaggttgttctccatgtaactgttcctgttccaacgcatggctggggggagggcgcagcttccaaacccacagttctccctccaccacctcccaccagatgctcctacagtctttttttttttttttttttttttttttttt

SEQ ID NO: 708640 - DNA, 896 bp, Homo sapiens
  misc_feature (4)..(4): n is a, c, g, or t
catnctaatcatagaaatgtgaaaacgtaacaaacagacgcggcaccaatgtgttatatgtttcccggaatcattgtcgtccctccaggattgtaccaaggattgattcttaggactgaatatcaaaaggatcaaagctatcaagcaccttggtgccatatcgccgccgtggatccggcttccgtccgtgtgtttctgtctcttcccttcattctgcccgtggtctgcccctttaggtgcccaccgttcacacactgaactaagttgcttcgttggtagcacaaagggtgtgcgcccccttggtggttaaaagtcgcggcgggcccccaatctttaggctttggtgtcgcccccccccgtgatgggggtttcccgcgcccactcgttgtgcagccttttccgcatgcaggcacacgtcgcggtcaccttgcagttgtgcactgtaagcaccccccgtgaatcacggggtgtgctgctatccctgggcccgtgccacagcataagtctctcggtaccttgctaggtgccccaccattcgcgccccgcaagaatatccaaatagggatacccacagtttcattcctccgaaatgtccgcccaccccatgatctaaaagccatggttgaaaggagccctttcaacatctcatgcagggccacctgggccaattaaatcaatggtttctaaaaatcggtgtccaggagcaccaaaggagatctgatgcccctcctcaatggtgaaacgtatgaaactaatctagggccccctattgagctatctattttgactagtgaggcccgttccatagtggacagtagtggcttataaagccgtagtttttagggaccccccttgggcccccaatttcgccccgatttgggacccccacatagaca

SEQ ID NO: 708641 - DNA, 805 bp, Homo sapiens
ccaaggcgcaatacttagagcttttcagcccgcgagtcgcccctggggccccgacccctcccccatacaggtaaggcccccgccgcattcgcagcggggttaaaaaaaggcgtggggccaccacaaagagggtaggcccccaaaccgtgtcttgaactgggaataagcccacaaaaggggggtctgacgccgcacattgcaagcgataaccaaccggggaagtataccacgataaaggtaacggagtacagataatggaggcccaagtctccgcgctgaaaataggaagggcgcccccacaaaggcagttcacacctttaacaagacagagaaatccgcacaacagaaatccttcacaccccccgggagtgcggcttaaaaaaactttgtacaccctgcaaccacagaggagcgtaagaagtctttcacacagagattaagactccccccgctccatatattaataaacccacaagaagggggactagaaaccacacagagagagaattacaaacacggtggaaaacccctggtagagtatctaaaaggaactttatacgaattctaaccgctgataccacacgaaaatgtccacagttgcaatcgacaaaatactagaaagaatgcggcacattacacttttttctataagaacctgctgttataaaatatgtttccccctttcttttaaaaaggagggaattcgtgcatatcaaaaaggaatttttagaatattagagaaagtccaccacaccacagggaaacacttaatacccctcaaaaacagaacccaccccaacaaaac

SEQ ID NO: 708642 - DNA, 763 bp, Homo sapiens
agaacaggtttccagtattcaattcttcacgggaagaaaatgaagttctaagtgaactgtatctcccaaggttttaaaattgtcaagagttattctgtgtgtataagaaataagaaacctctttaagcaatagattttgctgggtttgatttgttaaaagcataatattgtgcaggtaaggcactgtaaaagttttaattccttcgcagaagaaccagtggaagaaatttaaaggttgggctacgatcaaaaactaggtgaagttagtagaaataatgatgtctaagagctataccaacgaaaagaaccctcagcagaataacaaaaattttgctcaggacatttgaggtcagaagttgacagacggaaaccggaaaccgttttcttgtaagcccctagaggcagatcaggtagaagcatacatagtagcagggacacggcgagatgtggacgctaacactcaatattatgcggatgtatgcccattattgtttacgcactttttaaaggtgtgggtctttgcaggctaggtttgggtacgattagatcttagtatagtgtaaattacctgggtggattcacgttctaatattaaaggctacaattaatcttaaagctggggagacaattaattcctgttgcctgtggtatttttaaacaactttgaattttccaaatgttcacggtgaattcttttgggaggtccacaaggggtaataatgatttgtcctgttaaaaacttcggacacaatatattagggtg

SEQ ID NO: 708643 - DNA, 1018 bp, Homo sapiens
  misc_feature (1018)..(1018): n is a, c, g, or t
gtcaaaggctagaattatcccagcgtgtattattttgatctttggatgcaagtgccttaatgaagctctcaaaatattttaggagctgctcagggacgactgttgggatggaactgttggactacatgtcctactcttagattatgtgattttgtgggcactggcaaaaggtgtgtgtgtgaatgtgtgcatgtgtgtgaactgtgtgtgtgtgtgtgtgtgttgtgtgtgtgtgtgtgtgttgcagacatgcaaaactgcagctgacataataccttagatttctcaggtcaagtctttccacatttcacataatgggtaagcagtagacaccagggccgggtatcaattattgcttgctgtggcaacccaggccataacaatccactttctcagatcatccaccgaactaattaaatattatgccggaaactcctccttctgtgagtataacttccctgcagatccctaataggcagataagattcttcagaacaggtgctcctaagtgcatcactcccgcccgcttgattgtacaatattccgctttctcctctaagtccacagaatcgacagattgacgctagtgtattacgctaagcacaggcaagtgtcgatggagaagaagttgactctccgtttgtaccaacaggccagagaccaatcacccagaacagggtgggagataaatagactgtaaaatgtggcgttatggcttacaaacaaaaaccgtacctcaagcagcaagactgggaaacaggactacggggagaaacctatgacagagagagaaacaagaggtgggacgaagagacaagacatagcaccctctcaactgggaagggaccacaaaaaaacacgaatggagacgacgcgaagcacacacagaaggaaacaaggggacagaagcagacaagaacgacgaaggaaaaacaaaaaaaagacagaccgagcaaaagccaacgtacaagacgacccaagtcaaaaccggccgaccaggcgagccataaagcttagn

SEQ ID NO: 708644 - DNA, 210 bp, Homo sapiens
ttgcatataacacttatcttcttcttattcggctatggaatatcttttaagttttaaaaaaactggaataatatatatctatcttttttgccgtaatatattataggggttatagttgataaaatcaagtcttggtatgtggcttgctagaattaaatatttatgagatggtgcatttatagagtatagtagaacaacgacaccgatatt

SEQ ID NO: 708645 - DNA, 192 bp, Homo sapiens
tgggccgtgcccaccctcctccggaatcgcccttccctttctggccaagaaaggcagggtcctccccgacccccagtttgggcgcttttgggagggctctttcggtgccggcactcccccttgttagtgtctttccttgaaggggcgggccccaggctaggtccggtgccaataaatccttgtggaatttga

SEQ ID NO: 708646 - DNA, 763 bp, Homo sapiens
taccactacccctctctcacctgccacaatgtgaagaaagtccttgtacccttcgccttccgccataatggtaagtttccgtgagacctcccagtcatgcttcctgttaagcctgcagaactgtgagtcagttaaacctcttttcttcataaattacccagtctccggcagttctttatagcagtgtgaaaaggtacaaatacaccaccacactgaatcagatgaccaagataccagttcaagctatagaatcgaaaatacggattttatatgcatgtatgtttaatactgtaattagttacaaaagaacccagaaaccttttaacccatagttatgctgtaggattttttttacgccattttttaaagctgcatagatgcatcttcacatatgtgcatgtatgtttcagaaataaattatttgctaagaagtcacagaaaagacccagtattggaccactctaacagttatcacctattatagtgcaaaacacactgtgttgatcacatcaacacaaccaggtacctaaccaagctaaacattgggcagacattagttcctgaatgtaccaatgtgcaccattcatctacttaattcacgcaatgtggtgtttacacttggatggtgcgtatactgcccgatccgacctgattggaagagacttggcataaccacatttgtatctgacacctactttgaagaaacattctggaggcctggatgactatatcgcatctggcctccacaaggtccattcacacg

SEQ ID NO: 708647 - DNA, 264 bp, Homo sapiens
gaatttaactatcattgatttgcaaattaaaactagtacttaatagtatggcaatgaggttaactggtcagagatggtttacagtgcatcacaggagtgattgtccaggaatttcaaaaagagaaagataggttaggaggcaaatatagtagcatctgcattggatgacaaatgccttaaaaaaagggacagcaataggaaaaatgtattctgttgcaggcacatgatatgtctgtccatttattccagtcttttttcaaaggc

SEQ ID NO: 708648 - DNA, 156 bp, Homo sapiens
tgtgctctcgtgggcgtacggcggacatcgcgctggcacaacggtccggcttgcctgtgcgatcgcggtattctggtgaacccacagctgcaaaccgctgacccgcacatctcggcaattaggagaatgttgccagtggggcgaactacacttttg

SEQ ID NO: 708649 - DNA, 198 bp, Homo sapiens
tttttgtttgtttgtttgtttttttggaaaagaggaaggaattctcatgtatgatctttcaatgtaagctctccaagggcatggatctttatcttgttcattgatatagccatccccagagcctagagcagttgtctggtacatagtaggcatgcaattatttttgaaagaataaatagtataaaagctgtaaaaaaa

SEQ ID NO: 708650 - DNA, 782 bp, Homo sapiens
gacagaactactcacgaggtaccccgcaggagatgggtgccccctatccgggttactgtcctttgggcagcggacatcatgtctcccaaagaaggatgttcccgttacagaaatcaccagggacctccatctccaaaactgatggtatggccaggaagtagcaggggctcctccagcgcaagaacgaggagctgagccagctgtcccccagggcccttctagaaaacccatggagcctccagatcgtatctctccagagagtgggtgatcggaggtttaacaaggaggcgagctggaggagttcgaaggaggccttcgagctgtttgacccgagtgggggatggaaagatcctgtacagacagtgtggggactgtgatagagggccctgcgtgccagaagcggcaggcaaaggccgaggtgctcaaggtcctggggaaccccaagagttgatgagctgaagtcgcggcgtgtggactttgagactttcctgccatgctccatgcagtggccaagaaccgaggcaaggcacatatgaggactacttggaggggtcctcgtgtgtttgacaagggaggggaacggcatagtcactgggagcggagcgtcagacatgttgctcgaccaaccttggagagaagatgactgggaggaggtggtgaccgttcgtggcaggacacgaggacgccacagggtgcatcaactaacggggccttcttgaaccaatgctaagcgtctgaatgctgctatccaagagcggtccgaaatggccgcgcggggaaag

SEQ ID NO: 708651 - DNA, 977 bp, Homo sapiens
  misc_feature (251)..(251): n is a, c, g, or t
  misc_feature (306)..(306): n is a, c, g, or t
  misc_feature (332)..(332): n is a, c, g, or t
  misc_feature (334)..(334): n is a, c, g, or t
  misc_feature (413)..(413): n is a, c, g, or t
gtatccgccggaagctactgcaatgtgcaaaccgagatgtggacgtgtcttttgaatactgctgctctttcatcttctcatgtgcgtcacctgacgagctcatgcatcccatggccttgaagcttcttgatatccatttggcgtaaccaattggaaggtctgtatgccactcctgtctcgagcactgtcattctcaaagctccgtgcgagcactcacgctcgctgtcacgtaatctacgcaactatctggntgggcacgacactatgttgggatttcatgcaagattccacatacagactggcatncatgaatgcgtactgtagcgtactgnanactctggcatatcgactctctacaacgtaatacacgagttaaccatctcagtgacatcggtaaggaataggtcctctgnacacgcacagatatctccagagttggtcgttgtcttcatacatggtaccactcgtgagtgaaagtactagctagaaaccatccttatggggagacagaagtacttgttgttcccagaggatacgatccatatgggatgatgctgagaccatagtcagtcttggtcaattttcataatcacgtatgacttccatcgattccagggctgctacaaaaattacctaagaacagaacaatctgggcaaataattgtgccaacgaaaacaccctccgagacccaaatttttttgcgaaagctgaatggtgggacaagacgagcacccttttcccttttgtgaggaagaacgtgcgatattcaaaggtcacttccccacactagcagctggctaaaaagatgggaaaaacacaaagcacttactgaatagacggcgctgttactgaccctaagggacaactaccacgatgaccttttcaccagcaagcaagaccttttagacatgggagcgacctccggctacttcctggacattctttaatttacacgtgggaaatttaaatggagccc

SEQ ID NO: 708652 - DNA, 115 bp, Homo sapiens
tgaagaccctgatgcctaaagcaacaagtgatggatgtctggggctcatgctcacactagagcttgaacttgaccccactgaagcaaaagaagtggctgcatgataggagggggg

SEQ ID NO: 708653 - DNA, 180 bp, Homo sapiens
gctcggcctccgtgtagattagctctcttccatctggctgttccagcagctgtgtctttacaataaactgtaatagcgagcatagctgaaccctaaacaacgtaggggttagggtgctgaaccctaacaaagttgaagacccgcctataccttatagtggactctccttatctgtgatcc

SEQ ID NO: 708654 - DNA, 101 bp, Homo sapiens
ctcaggactttggcttgctattgaaacttctaaaactaggcctaggttctagaggtgtcaatcctagttttagaagttgcaagtagcactatgtggtaccg

SEQ ID NO: 708655 - DNA, 635 bp, Homo sapiens
  misc_feature (549)..(549): n is a, c, g, or t
tctagcagctgcccttggtgcgatgttggagcgcgaaccagagaaacacagacacgcctcatagagcaacggcgtctctcggagcgtggagcccgccaagctcgagctgagctttcgcttgccgtccaccactgcccaccactgtcgtttgctgccatcggagacctgctgctgacttccatccctctggatccggcaaggtgtgtgctgtgctcctgatccagcaaggtgcccattgccagtcccgattgggctaaaggcttgccattgttcctgcacggctaagtgcctgggttcatcctaatcgagctgaacactagtcactgggttctacggttctcttccatgacccacggcttctaatagagctataacactcaccacatggcctaagattccattccttggaatccgtgaggccaagaaccccaggtcagagaacacgaggcttgccaccatcttggaagcgacccaccaccatcttggaagtggcttcgccaccatcttgggagctctgtgagcaaggacccctgtaacacaaccgaggcnctctggggtattaaggaagagtatagttaggcacttagaatgtctcgtatcaagtgcactgtaaagctctgtgtctacttaatatc

SEQ ID NO: 708656 - DNA, 381 bp, Homo sapiens
ttgttcttgctgaaagtgtttttaaaaaaagccccccttttttttttaaagcttttatatattaaaaaacgtttcatgccccacctgtgaatagctcccgcttgcccaaaggacccggggaggggtcccgaaaggctccccatgcaactttggaaatgactgttccaaaaagggggcaaacctggcaaagcgcccctggcgcctgagactacccccccctccgttcctgccaaaaacgaccctttgtggccgatgggccatgggggcccctcccacccaactcacccagtgttgggactggctcaaagcccatgggggttggaggggggcagctgggactttggaattttttttataataaaacccttccggccaacccta

SEQ ID NO: 708657 - DNA, 176 bp, Homo sapiens
ttccctggataattaacccctcttttccacacttcagttctcaaacactttgccacaaaacacatctctgttttcaagcccttcccaaagaaagtgcatttctgagaatttgcatatatgtacatcttacaagccacagtttgatttagtctgcttaagcatatttctgtcgacgc

SEQ ID NO: 708658 - DNA, 1304 bp, Homo sapiens
gcttcaagacatgggttccagaccacaaggaatttggtaagccagtgtccatcacaggactatgatgttatacctgcaagttgcaatttgcacctgctgacacctcccccaaatcgggagccttcacaatgggaggatagtagtatagacaatggctgtgtgtggtttttaaggtggagaaacaatctgggaagggacctcgatttgcacatagttgcacaggcagggctggatgggatggagcagcaacattttttcagaagccatcaccgagtgccccctaggtgatcatggggacacacccaggcagaggacccacttcaggggtcagattagcccagtgtagcctgtcctgggtcaggtttgaggcacaagtgcacaggagggggcagtgctcttgctccagggccagctggggcctgagtcatagcaggaccttgaagccagaagtttaagggcaagtggtgcccacagttgtaagacaatgacaggtggtggttgcctccccaccagcgcctgtccccagggcaggtcctaaggctgtgggggctgaagttagggccttgtgaatacctgggggagcacagggctgttctggccgcagggcctttggagctgggaccacaagctacttcgaagcttcctgtaggaccccacatcggtatccagggcctgttctaggtgctgaggcagactgaaagctagagctgtccactccagctccttccaataggtcccaccgagggcagtgggtccagccagtggtagtaccttcctgaggccctgaggagtcagggaagcctctagcggtgctcctcactctactgaaggggatcaggaagagtgtaactggggtcaagaaaggtggtgtgtgcacccttaagagctctagctgaggccagcaatggcaatgggggtcccctgcagtgatgctaaggcacccggggctgaggggaagatgaaattgctggccctacctgagtctcctggcctgaaggtctggttcacccgctcacagcctgaactgcacacagcagtgcctgacttcaggcggatccctgctgggcttcagtttcctcacctgtgataggtggagttgggcctaactcctggctccaaggctttgaaagttgggcctgccattccctcacctgcctgtcagccaaagcttggagcccaccccaggtactccggcttgtgcctgagaagggggttagttgggcatgggggctggacagggaagggtgcagggcccaggtcttttctgctgccggcgccgctggctcaggagtggacgcggccgc

SEQ ID NO: 708659 - DNA, 188 bp, Homo sapiens
gctctagcaggatcctcattaactatttgtagagacagcagtcttgtttgttgcctaggcttgtctcagactcctggctcaagtgatcctcctgtcttggctcccaaagtgctcgattataggtgtgagccgtggtgcccagccgacaaccagaactttccgcagaccttgtgcctttgtcgtctgct

SEQ ID NO: 708660 - DNA, 849 bp, Homo sapiens
attaggctaggagggccgcgggttaatcggccgaggggagaggccggaggagtatgaagaaggttataacgatggcgaggtagatgacgaggaagatgaagaagagctggtgaagaagaaaggggtcagaagcgaaaacgagaacctgaagatgagggagaagatgatgactagagtggaaataaccgtattgtgtgagaaaattcctagttgtgaatttgactgtttgtatacccagtagtccactctcgtacgggctgccgtcctctccaataccgtgtcactcccgtggatatctctccattacatgtatttggtaagagatgactagtgcgtaacgctgaggatgggtgagagacgtgtattggggaggtaggacaggagaggaggtggacataggtgaggggtggaggtgtgaagatttaaaatcaagtgattgtaatgaaatggacgcgagtgcattgcaatgaggtatgtcacacttacatttatatcttggatgtcacctggtcgtaatggatcccccttttgaaaattagccgaattagggggaaaggtcaaaacaatgtatatggatttaaaacccttgtggttattcctgcagcccgtcgattggaatggatggcagtagagagtagcgaacatgtcaaagtaagtccaaggggggactttccccctaaggggatccaaccggaggcgaggaaagggaggcggaccgtggacgttgtgtaattcaggtatgggggaatctagaaaaaagtcaccaagtgacgggggcagatggaagacaaccaagcaaataagaacaaggaggagggggggaacaccaaaacgggcatgcagacacag

SEQ ID NO: 708661 - DNA, 1636 bp, Homo sapiens
tccaaaaaaattggtccctttatttatgacataggaaaaactccaaaccccggggggggaggagagggatgtggccccagtcccctccacaaagggaaggggagaaagagaaaatgtaaacctattctgggtaacataaatgttctcccacccaccacgcccagtcctttggagatatttttttctcttatattttcttatttctccaacacttctcacagagagtaacacacacacacacacacacactccactttaacactgtgtgtcgtccaacaaacacacagagcccatatttctcacacaccagagtggagagacacacctatcacacaccccacaaaccccccaaatatatctcaccatatagagccctctctccgagcgtctctctctatatagtgtgtcgtcgcgacagagagtgcgcgcgtgtagcgcgccgcgcgtgagagagaggagatatagtcgccgccacgaggggggagaggcgtcgtgtgcgagagtgtcgcctcctcccccacacacgaaaaaaaacgcgccacagagagcctccccagcgcggagagagagagaagcgccccacaagagcgtctccccaaaaagagaggggagggccccccgaggggtgcgccgccacagagagaggggagaagacgcggcgcgcggcaccacccacacaacttcttccccaccaataggacaacaactattatactcacgccgtctgttgtgcccctcctccataaataggacgcactaattcttcctcactcctccttattcttcaagagggcggcgcaactcatccttggatgaccagaacgagcaggggacgaaacaacaagggggcggccgcccatcaggtgttgttgtactcattatcactccccgctgtgggaggagcagaggagcggccacccgctttgctagaaaaactaagcgggcggcaccacacaccggactccaagagaagaaaaatgtttctgctccaccaaacaaaaaagaatgtcggcgacaggcgacggcgccaaccaataatgatatatataacaacaccaacgttcgtcggtcgtcgtgcggagttagacaacacatgagtgttcgtacgcgaccggtgggaggagggtcatttcccaccccccaaaggcgggggggggtggggtcgccccccccctaattaataaagagggagtggggtcgacaaccacagaagatatatgttgccgacacccaccttgtggtgggtcgtcacccccacacaatgatgggtggtcggtcacacccaccgtctacaatcacaaacagcagggtgggggggagggaggaggaaggcagacaatcaaacaccacctcacagggaggcacgaaaccaagccgggcggcaggaaaggagggactgtaccaccccgccggagagagacaactatactcaccaaaacaagacggggccccgcacaaaaaaatgcaggggggggcacgagagcaaccccataaacacaagcacgagaaaacaaacatcctcccctcgatagagaagaaaaccccccacaacaaaaagcggcggcgagcaaataaacaacacacatcaaccgaaaggggaggcgcccgccagtcgagaacacaccacacactacgg

SEQ ID NO: 708662 - DNA, 173 bp, Homo sapiens
  misc_feature (1)..(1): n is a, c, g, or t
naagattagaaagaacagacttgctgattcttccagcctttatctttctcgcatactggatgcttcctgccctcaaacatcagactccaagttcttcagcttttggactcttgggcttacaccagtggtttaccagggtgctctcagtgccttccatgcacagactagaagac

SEQ ID NO: 708663 - DNA, 172 bp, Homo sapiens
ataaacattttcttctaaagaaaaaaaacctaaaatgtaaatacctcccattctgccacataagactgtatacattatttacatctatcaaataaaacatattacagattttctgacattcagtgtttcctttaaaataacaacagtgaaacaactttgatcaataactaat

SEQ ID NO: 708664 - DNA, 228 bp, Homo sapiens
aagcttctcaacgagcaaagctgaatcacaactcaaccagtcacggacaaccacagtatcgtcagtcgatattgctgtatctacgagcggactgtgctcttggtccagatctgccttgatcagctcgccaggtcttgaccgcattcttggcattcgctgcgactactcaggcctgtcgcagtcagtcggtcttggatcctggattagaccggtccggatcctatgttc

SEQ ID NO: 708665 - DNA, 244 bp, Homo sapiens
gaacaatgtctggtgcctagcaaattctcagtaaatttcagctagtattattacagttagtattacttcactatgctccctgataaaatttttatactaaaatggttaatgactcagcattgaggtctgatctgacttagtgttagcataacgtaagttgcagttcatgatcttagaggcttggtcacaggcggagtggagcacgcatgctaatctgggatcagagttcactcaatcggacctg

SEQ ID NO: 708666 - DNA, 809 bp, Homo sapiens
aaaaagacaaacaaaccacttcttttcttcagtaacactggcatctctgttaaccactctccttagggatggtatctgaaacaacaatggtcaccctcttgagattcgttttaagtgtaattccataatgagcagaggtgtacgcgaaattgtgttatgagtgatagccttcagtacaaaaagataggatgacgtggtttaaagtgttctatttgtaaatcattccatttgagtctttctgatgaacttggtatagttgaaatcgtattttagtgaggctccaaaatgagcaaagctaggccatgattagagtagagtgactatataaaaaaaataactttctaggagctataaatcaaagtttaaaaagatgtttgatatatttgagtattctgatcatgaaaaagaaattgcctggctactacaggacagactgatgggcacatatgcacctggcacttcaggtttcaagcagagatgctgtaaaaataagggtctcgatatcatgcaacgtcccagtcaggaatctcctttccaggactagaaccagtcctggttggagagttaacacagcgttgcaaggacaacgactcgcagcaccggacaagtcgccgaacacaactccaatacagagccgtgataaagacagatagctcgaaccgggactgatgaccccgaccgctaccccccgggagcgacacgaggccagtcaagccacactgggaaaaaactggacccgcccgaacacaacaccgcaggcgatgaagacgcagcacacaccgagccagccgcccaaagaccaacagagg

SEQ ID NO: 708667 - DNA, 548 bp, Homo sapiens
cggacgggcgtgggctagttctagatcgcccccacctccaaaaaaaaaaaaaaaaaaaaaaaaaaaaaaaaaaaaaaaaaaaaaaaaaaaaaaaaaaaaaaaaaaaaaaaaaaaaaaagggggggcggcaaaaatttccctgggggggcccaatgggacccctttgaaaaagggggccccaaaggggggtttaaaaaaaggggaggaggccggctgtaaaaaaacagtgtgctgtcgggggaaaaaacttgtgttctaatgggtggggtatcttcttgtgatagaacagagaacccattttgttgtggggggggaggaacaaatcttggggcacaaacatatcctaacgaaaaaaaatattaagagcctcgcgagggagatcatttattacaaatttatgaagggcggttaatatgggtggttgcacaactacgtctattatttttgtgggcggctggaaagaaatactgtggctgatacgatggcatatatatatttgttcaagaacaatttttttacacgcgggagatgtgttataataacggtga

SEQ ID NO: 708668 - DNA, 161 bp, Homo sapiens
aggccggatccagatcgcataacagccttttaccaggcactgtagaattctctgggtggcgagaactcacgatcccgcatcgagactggtgttacattatattactctctggagcactccacggattagctatacctccttctcccgggctctggaagcaa

SEQ ID NO: 708669 - DNA, 440 bp, Homo sapiens
tgccctgctctctctcccttgactgccaagctctgctcgttgggacctttatgagtccattctccaccgggatcccagtcttctgcgctggtgccaggtcagcatcaggcctcctgttgggctgaggctccaggagggcacggtgcctggcacagcagctgggtcataaaatgtattgaatgaataagtggatgatggtgccaactgggaaggagaacaggatcacgtggcatggaaagctgatacttctgatgttgtggtcaggcaggaagaaggaggtgtgtgtgtgtgtctgtgtatgtgtgtctgtgtgtgtggcttagcagatgcctctgaattgaaataatctcttcagaagagagaggaagactaaggagactctggagactgaaagaatccttcagtcgaagcggccgcgaatttggtagtagtagtagtcg

SEQ ID NO: 708670 - DNA, 458 bp, Homo sapiens
ctgatgtttgacgccgtgcactgtggtggtgagcgctgtacgagaagctgaaccggagccgaggagaatcggtgtgaagcctcgtggcctgtacatcggccaacatttggccccacgggatcagacctcgtgaactacctgcgcatggtagagtatgatgggctgaccgggcgcgtggtctgagtttcaagccagacgacataggtgcagagaacgctagagctacatgcctgcgcaagtcctagacagcagtcccgtgtcagggccaccgtgagatcggggtgtggtactctaaccacgcaccctggtcatgaatgccatcagcctggacatcaagcatggtctgcagagactggctcaaatcaagaccctgtgtggtcgactagaccatcgcgtggagaaccgcaatacgtctatgcgggccggccctaacattcctaggctcctgtcgggcggaa

SEQ ID NO: 708671 - DNA, 692 bp, Homo sapiens
  misc_feature (319)..(319): n is a, c, g, or t
  misc_feature (333)..(333): n is a, c, g, or t
  misc_feature (454)..(454): n is a, c, g, or t
gctaagatagaaaataacatgattgttccttattaaagtttcccagcgtatgaaattctaagctgggtggggtggctcacacccgacgtaatcccagcacgtgtgggaggccgaggcaggtggatcacttgaggccaggagttcgagaccagcctggtcaagatggtgaaaccccatctctactaaaattacaaaaattagccgggtgtcgtgacacacacctgttatcccagctattggggaggccaaggcaggagaattgcctgaacccgggaggcggaggttgcagtgagctgagatcgcaccactgcactccagncactccaggcctgnggtggacggagcaaaggactctctcacaaaaaaaaaaaaaaacaaacaaaaaaaaaaaacttgtgttggggccggacatcgcgcccctagaaagaagttgcctaaacaaaccaatgcggtnggggggggcgcgggggccccaaggaggggtatggacacaatggggccaaagcttcggtcccaaaagagaactccggggcgctggaacagaggggcgggggttctccaaccaaataaaaaacgcgccggggggacaccgaggtgttttggacaaaatcccagatgggtctcggagacaccaggttgtaatcacacaggagcaaagcgggtcgaaaaaatagcgaggggggagtagatga

SEQ ID NO: 708672 - DNA, 504 bp, Homo sapiens
  misc_feature (404)..(404): n is a, c, g, or t
  misc_feature (407)..(407): n is a, c, g, or t
  misc_feature (415)..(416): n is a, c, g, or t
  misc_feature (419)..(419): n is a, c, g, or t
  misc_feature (425)..(425): n is a, c, g, or t
  misc_feature (431)..(431): n is a, c, g, or t
  misc_feature (434)..(434): n is a, c, g, or t
atgaccactgactacgtagtaaatgatagctgtatgaggttttgctaaacaactttcaacagtttctgcggacgccgtttcagctccagcttggtcccccctccgaacgtgtacggataaccactccactcctggcagtaataagtggcagcatcctcagcctccattcggttgattgtgagagaataagaggtcccagacccactgccactgaagcgaaaagggactccaggagccacgttggatgtgtcataaatcaggagtctgggggaggatccaggcttctgttggtaccaatatatgtaacgtatacttgagctggcactgcaggtcatggtgaccctctcccctggagatgcagacatgattgctggagactgggtgaagctcaatgtcagatccgncancgccaganncanctccgnctgaancgnctccacatgaggagacggtgaacgtggtcccttgggcccacaagtcaaagtagcgcctatagtagtcccc

SEQ ID NO: 708673 - DNA, 377 bp, Homo sapiens
caaagcattggggttcaggagatgctacagactcagtcacgacctggcatttcattatcaacaagtcccaaggcaatatatgacacctttctttcgtggatgctatgaataattttaaatggactacatcggaaggtctctccttcaactagctggtcctcagcctgccagtgaactgtgaatatgttcctatgcacagcacaatgctgtagttgggtgctattcatggtaatgacaggattatctcctagatattggaaagaccctattaggctggaacctttggtggtgtggcacgatcttgttcctcttccctgctcagagtattactccatcaagttgcttgttagtcttctgctactcacctgcacgctgat

SEQ ID NO: 708674 - DNA, 540 bp, Homo sapiens
  misc_feature (70)..(70): n is a, c, g, or t
  misc_feature (440)..(440): n is a, c, g, or t
  misc_feature (443)..(443): n is a, c, g, or t
  misc_feature (451)..(452): n is a, c, g, or t
  misc_feature (455)..(455): n is a, c, g, or t
  misc_feature (461)..(461): n is a, c, g, or t
  misc_feature (467)..(467): n is a, c, g, or t
  misc_feature (470)..(470): n is a, c, g, or t
ggaacctggcgcctttattcagagaaacatcgtttatccttgcaggcttgggtaaaacccttgtgctgtnttagcgtaagataaacaactttcaacagtttctgcggacgccgtttcagctccagcttggtcccccctccgaacgtgtacggataaccactccactcctggcagtaataagtggcagcatcctcagcctccattcggttgattgtgagagaataagaggtcccagacccactgccactgaagcgaaaagggactccaggagccacgttggatgtgtcataaatcaggagtctgggggaggatccaggcttctgttggtaccaatatatgtaacgtatacttgagctggcactgcaggtcatggtgaccctctcccctggagatgcagacatgattgctggagactgggtgaagctcaatgtcagatccgncancgccaganncanctccgnctgaancgnctccacatgaggagacggtgaacgtggtcccttgggcccacaagtcaaagtagcgcctatagtagtcccc

SEQ ID NO: 708675 - DNA, 526 bp, Homo sapiens
  misc_feature (426)..(426): n is a, c, g, or t
  misc_feature (429)..(429): n is a, c, g, or t
  misc_feature (437)..(438): n is a, c, g, or t
  misc_feature (441)..(441): n is a, c, g, or t
  misc_feature (447)..(447): n is a, c, g, or t
  misc_feature (453)..(453): n is a, c, g, or t
  misc_feature (456)..(456): n is a, c, g, or t
gtaatcaggaatagaggtttaccagtacgttcgggaatcacaggtcgcgtggtatatagatccaggataaacaactttcaacagtttctgcggacgccgtttcagctccagcttggtcccccctccgaacgtgtacggataaccactccactcctggcagtaataagtggcagcatcctcagcctccattcggttgattgtgagagaataagaggtcccagacccactgccactgaagcgaaaagggactccaggagccacgttggatgtgtcataaatcaggagtctgggggaggatccaggcttctgttggtaccaatatatgtaacgtatacttgagctggcactgcaggtcatggtgaccctctcccctggagatgcagacatgattgctggagactgggtgaagctcaatgtcagatccgncancgccaganncanctccgnctgaancgnctccacatgaggagacggtgaacgtggtcccttgggcccacaagtcaaagtagcgcctatagtagtcccc

SEQ ID NO: 708676 - DNA, 515 bp, Homo sapiens
  misc_feature (415)..(415): n is a, c, g, or t
  misc_feature (418)..(418): n is a, c, g, or t
  misc_feature (426)..(427): n is a, c, g, or t
  misc_feature (430)..(430): n is a, c, g, or t
  misc_feature (436)..(436): n is a, c, g, or t
  misc_feature (442)..(442): n is a, c, g, or t
  misc_feature (445)..(445): n is a, c, g, or t
gtaccgactatagtagtcgtcttccagacgttagaaatgaatcctgatagcgtagctaaacaactttcaacagtttctgcggacgccgtttcagctccagcttggtcccccctccgaacgtgtacggataaccactccactcctggcagtaataagtggcagcatcctcagcctccattcggttgattgtgagagaataagaggtcccagacccactgccactgaagcgaaaagggactccaggagccacgttggatgtgtcataaatcaggagtctgggggaggatccaggcttctgttggtaccaatatatgtaacgtatacttgagctggcactgcaggtcatggtgaccctctcccctggagatgcagacatgattgctggagactgggtgaagctcaatgtcagatccgncancgccaganncanctccgnctgaancgnctccacatgaggagacggtgaacgtggtcccttgggcccacaagtcaaagtagcgcctatagtagtcccc

SEQ ID NO: 708677 - DNA, 136 bp, Homo sapiens
tctacaggatctccccagctactcaggaggccagctactcttgaggcagtaggtactattcttagactattcacagccaaggaaactgaggctcagagacctgaatccctcgttcaaatgccacagcaagtggctg

SEQ ID NO: 708678 - DNA, 231 bp, Homo sapiens
gctgatcatcctaaacatgtgggtaagcattcattgtcacaaatagaggcaatcaggcttaactatacatagtataaggatttacccgtctactatattacccggcaactacaaagttataatcactcaggatcatattacacaatcccctaggaattgtgtaatggaatccgacgggttatacctatgttgtttacccagagatatcgatgcaagatctctcatactgct

SEQ ID NO: 708679 - DNA, 790 bp, Homo sapiens
gtaagaggcactcagccactgaggactttgatgttggctggatcagggggatgctggagcagctgaatgcagagctgggcttgtgatgccacgagataccgctcaaaatccccgtgatgctccacccctggggcccgagatccattctctggtagccagtacacgacccagaatgctcagcgccgtggcgaggagcctactgcagccagccgtttgacggccaggagctgtacggcatcatgtcatgcggcttcattggctaggaggtgttgctgttctccttcctgttgcactactcggactctgtgtgtgctggggcggatgttgtgcggtgaacgctgcgctgtcgggatgcgtacgctattccgacctctcttgccgtgccttgctcgtgccgtgcatgtccttggggcacatggtagccatctaccatgtgtccttagggatctgggtgttctacatagtgtcttgtcaagattagagtgtggtcccgagttggcgggttgatgtgtgcatgcttggatccatgggggcgtcagcgcgtcaggtccctttcgccgcacagggccctgctgccttttggccttcgccctgtctctcgatactcttattacttcctttactcacttactgtgcccgaaggcgcgcttggctggctcgtgcgcccgtattctgtgttctcctgccgtaatctcttcagtggtgacccgttgtgtcctgccttcttgtccgcatcgattgataccccagcgtggcgtttgccctgagcgtccgcaggggcggctgttat

SEQ ID NO: 708680 - DNA, 297 bp, Homo sapiens
atgacatgaaaatgtgtgcatctgtgctgtgatgcccctgccaacatgtgctggtgtgttgggatgtgcctctcttggcctggatgtggtggtggtggcagccaatgtccagccactcttcacctgtgctccctgctctgggccctgcaccagagcttgccaccctcttctttctccccagccttctcatttcctgcctctccagccagccctcttccccatgcccagaagaaacaaaacatgcaaatcaacctccaatggggccatgcccaagccttcccctcttccccagcccag

SEQ ID NO: 708681 - DNA, 233 bp, Homo sapiens
ggcaaatcaacagtgctttcactcctgctgaggttgtacaaccctacttctggaactattaagcttgatgggcaaaacattcctcaagttaacccagttttgcttaggactccaaaattgggcaaattagggtaaggaccccattttgttttcttgctctattgctgagacacatatgcttatggtgctgatgacccctcctctgtgaccgtctgaggaattccagagagtgg

SEQ ID NO: 708682 - DNA, 870 bp, Homo sapiens
cttggcccatgcgagtgccagagcggcggccgcctggattccgggattttgccccgtcctccggtgtgggaccgggtgccgttctcggtcctgatgcgccacgaaagcggcgagtttgcccagaccccggcggggccaatttccagggggttgcgagttccaaacgctgcggcccacccgggagggtgccaggaccgggctcccgccacacccaaggtggcgctttcccccccccctccgggaggggagacttcttttagggtggcgcgcgaaagaaatttgtgggggatccccgctgcggccccgttgagcctcccccccccagagggatttctgggatcccccagaagggccccggcatctccgctcccgaccccaggctattcccccacggcgaggagcttcaccaaagggcgtgatcccccaatccgagttgtggtgtaagcgcctggggcccaggacagcttgtcttccccatgccccggactgtatcatgggcggcctggaatgtatctccatccccgcagcacccccattccacacaccggcttccccccccggaaggctcggaagctgtgtatgggagaggaggcctgcacttggacctgacctcaagcctcagctcccgtgggaccctgtaaatgctccccgtcagagctctcccgaatatgcttgtttggagatccctccgcccctaagggagagttttcccccttacacaatggcctttgcttgcaccccccactggaaatgggtgtgcccccaaaataagactttgcattttttacaaaaggggaactacaggggcaaccctggcctaggccccaactttgttttgagaaaattaatatttgtaccccccttctatta

SEQ ID NO: 708683 - DNA, 1138 bp, Homo sapiens
  misc_feature (386)..(386): n is a, c, g, or t
  misc_feature (397)..(397): n is a, c, g, or t
cgaccgtccatgatccgggatgtggcgtcattgctaaaaacaaaaggttttttttctcgaagcaaaagcgagcaataaatttatatctgtatgtatactcccgaagcactattacggagagcggtacgtaataccgagtgagtatatagccaaggcggttgtgtggccttttcctaacatagaaactgggtcgtggcaccaccagctcctattcataaccccacacgttgtttatgacattcaaactggaggagtgtatgctcatagtaagagactgccgcagccatccaccgctgttgttcggccatttcgacagcttgagacgtcatatccgcgacagacatgaccaccagacagtcagcgttccctcatgtggtggcgggagntcttctgggcnatagatgatatgatatacgacttttacggactgcaggcttatagagcagtgacatatgctggacacaaagtgttcgggtctgtatctcgcctcgtatttttatttggtggactcctacttcacgtgatccggcctacggttctgacaataacattaccacccctccgcataatgacatagagacccatcacccgcaggtggaaccggatagtaaatgagccctgcgcagcacccacaattcataccgccaagagttgggaccttcataggcgttaattcatatggcgagcggagccgacggggtgagggggtatgatggtggaggggcgcgctcgtcagcggggtttcagcgctatgataaagatcggaagtgcggcgcgcgcacgatctatcgattgtttctgctaatattgcggtgtgagatagcatgcgcaccaaattaagaggtagattacgctggctgatttactctatgttaaagaagactcgtgctttcacaataggttctagaggacatccgctatcgatctatcgcgatacgacctgtcctgaactcaatgaccgtgatggaggagggaattgaagttacctcatgctagttggtggtgtgacttactcgcagaaagctgtcattcatccatctctgtcggcactgtaggagcggaccacgtgggttacacgataggaggcaggacgagtggggttgctggggtgaggagggggatgggagaggacgcaggg

SEQ ID NO: 708684 - DNA, 319 bp, Homo sapiens
ctgcgcggcctcgcatgatgctggcagatcaggccagagatggaaagcgtgaggtggtgaggggggagacgtggcagcgagggctcactcaaacgcctcctgcctatactggcaagactcacaaagttcacaggacggagacctcaccctgtaccagtccaatagcatcctgcgtcaccatgggccgcacccttgtggctctatgggaaggaccagggggaggcagccctggtggacatggtgaatgacggcgtggaggacctccgttgcaaatacgtctccctcatctacaccaactatgaggcgggccaggatgact

SEQ ID NO: 708685 - DNA, 296 bp, Homo sapiens
tgagccggttgtaaagtgatcagacgccggaccccattctgtgggcccctgtggttgggcttcccccctggttcttacagggagctccagggctatgtcttagcccaaggtgtagaggtgaggcacctcaagtctttcatgccctgggaactggggtgccccagggggagaatggggaagagatgacctgcgccctcagtaggaacaggggtgagatgaaagaacgacagaatgagggattttcaggcacgggggaaggaagggtggttttggggaacagaccgtagctgactggt

SEQ ID NO: 708686 - DNA, 119 bp, Homo sapiens
cgtgactattacagtgttcctcatcacccaactaaaaatacaaaaaatcagctgggtgtggtggcgggcgcctgtgatcccagctactaggactaatcagtttagagtatcagtaaagc

SEQ ID NO: 708687 - DNA, 178 bp, Homo sapiens
attagacggatcctccagaggacaaggaggaggcgactggtggacatgagccctccctgctcacaagcatatgcccgggagaccggatagggcagtttctggggccagggacatggcttggaagagggggagactgggacagcatctggtgggtgctgagaaccccaaccttaaggac

SEQ ID NO: 708688 - DNA, 100 bp, Homo sapiens
tagtcacaatctatgtaacctgtagacttcccttcacttctctggctctcctctcctgctagctttgttccttattacatcttctgccactccactagct

SEQ ID NO: 708689 - DNA, 464 bp, Homo sapiens
tttctctcaccactcctattcaacatagtgttagaagttctggtcaaggcaatcaggcaggagaaagaaataaagggtattcaattaggaaaagaggatgtcaaattgtccctgtttgcagatgacatgattgtatatttagaaaaccccatcatctcagcccaaaatctccttaagctgataagcaacttcagcaaagtctcaggatacaaagtcaatgtacaaaaatcacaagcattcttatacaccaataacagacaaacagagagccaaatcatgagcgaactcccattcacaccccttgtaagttgtatttctaagaattttattgtctttgtagcaattgtgaaactatcatcagagtgaacaggcaacctacagaaggggagaaattttttgcaatctatccatctaacaaagatttaatatccagaatctataagaaacttaaacaaattataaga

SEQ ID NO: 708690 - DNA, 129 bp, Homo sapiens
cccccccgggggggggggtttttacccccggggggggggggggggccccccccccccccaataacccggggggggccggggtttttttcccccccccccctttttttaaaaggttttttccctttttta

SEQ ID NO: 708691 - DNA, 825 bp, Homo sapiens
  misc_feature (53)..(53): n is a, c, g, or t
  misc_feature (778)..(778): n is a, c, g, or t
ggtgaaaaaaaaaaaagcatggtgtcctggcctgtgtgtcacactcagcattnggcattggggcttgaatggcaaagatgaaaccaagaatgcaaatatcttatccagaaaaaatatatggcatgaggcctacttgtctgcactaagtgtctcaaggggcatggcttagtcaaaccaacaactccatggaaccttaatgaagcagagcactttagctgaaacagagaaaagaagaaagaaaattaaagaaggaacggaaacggggaacaaaggaactgttccagtcaagcctccaaggacctccatggatgtcaaatccatgttgctaaattcaaggagaatgttctttccttatctcagttggtgaacggtagaatcctcacgaatggaattagtgcccttataagaagaacttacaagagaaatgatctctttctggaccataagaggatacagtgtaaagacagacctctgcaaggagagccgtcactgagaaaatgaacctgttgccctcctgatcttggatgggccagcttcagaactgtgaacacataaaggtttctggtttaagccacccaggcaatgatatgtcgtatggcaccctaagctgactaaggacagctttcttcctcaatctcattcatgggtcctcaggactactgaagttggcactattttcccatcagcaatgctgaatataaatgcctttggtttaatttgctgggccctcgcaatttttaagctctagggccagaaatttgccctttgggttccaatnaggaggtgggtaatggcactctgtctaaccatttatcaacacggtat

SEQ ID NO: 708692 - DNA, 476 bp, Homo sapiens
  misc_feature (46)..(46): n is a, c, g, or t
  misc_feature (70)..(70): n is a, c, g, or t
  misc_feature (98)..(98): n is a, c, g, or t
  misc_feature (170)..(170): n is a, c, g, or t
gaaggtgcatttgtaaggtcctagcctgggcccactgggaagagtntagctgcctagcgtcttagaaccnaggtcgctagtagcagccacaatgcgcngactttaaagtgtttatttgcccgagaacacctcaatttctaaatggttgctatattagtgtggggagttcntataagagccaatttctggctttttaataaatccaatatgtggctacgtaggtcaacatcctgaatggccacattgactgaagctgagtagcagctagcagtttggacagaatatgggttctccagtttgccatagcctcactgcagcccacttcactcatttctgttattcatgtggttactataagcatttgtttgctaaaaaatatcttgaggcatgtttttttttcctctttttttaaccagccccctcccttcccaataaaaaaagaaaaagaagccatgaaacttgggggtttaaacagc

SEQ ID NO: 708693 - DNA, 93 bp, Homo sapiens
  misc_feature (19)..(19): n is a, c, g, or t
  misc_feature (25)..(25): n is a, c, g, or t
tggggccgacgtgtgaggnaagccngttccgaacacaaacaggatgatgacacagcaggtagcggggaccaggtagttgagcatgtcccacac

SEQ ID NO: 708694 - DNA, 949 bp, Homo sapiens
  misc_feature (53)..(53): n is a, c, g, or t
  misc_feature (902)..(902): n is a, c, g, or t
ggtgaaaaaaaaaaaagcatggtgtcctggcctgtgtgtcacactcagcattnggcatttgacttcttcacactcttaaaagctattgaggcagttccaagatggctgaataggaacagctccagtctacagttcccagcatgagcgacacagaagatgggtgatttctgcatttccaactgaggggcttgaatggcaaagatgaaaccaagaatgcaaatatcttatccagaaaaaatatatggcatgaggcctacttgtctgcactaagtgtctcaaggggcatggcttagtcaaaccaacaactccatggaaccttaatgaagcagagcactttagctgaaacagagaaaagaagaaagaaaattaaagaaggaacggaaacggggaacaaaggaactgttccagtcaagcctccaaggacctccatggatgtcaaatccatgttgctaaattcaaggagaatgttctttccttatctcagttggtgaacggtagaatcctcacgaatggaattagtgcccttataagaagaacttacaagagaaatgatctctttctggaccataagaggatacagtgtaaagacagacctctgcaaggagagccgtcactgagaaaatgaacctgttgccctcctgatcttggatgggccagcttcagaactgtgaacacataaaggtttctggtttaagccacccaggcaatgatatgtcgtatggcaccctaagctgactaaggacagctttcttcctcaatctcattcatgggtcctcaggactactgaagttggcactattttcccatcagcaatgctgaatataaatgcctttggtttaatttgctgggccctcgcaatttttaagctctagggccagaaatttgccctttgggttccaatnaggaggtgggtaatggcactctgtctaaccatttatcaacacggtat

SEQ ID NO: 708695 - DNA, 489 bp, Homo sapiens
  misc_feature (28)..(28): n is a, c, g, or t
  misc_feature (302)..(302): n is a, c, g, or t
  misc_feature (316)..(316): n is a, c, g, or t
  misc_feature (332)..(332): n is a, c, g, or t
  misc_feature (354)..(354): n is a, c, g, or t
  misc_feature (396)..(396): n is a, c, g, or t
  misc_feature (408)..(408): n is a, c, g, or t
  misc_feature (438)..(438): n is a, c, g, or t
  misc_feature (454)..(454): n is a, c, g, or t
aaggaaaagtgggcgcaggggacccgcntgcagcatacggaggacccgcgccggcaccagcctctgagttccctcagtatttatcgatcattatcgggcatttctgggagagcgggatgtggcaggacaatagggtaatagtggggagagggtctgcaggaaaacatgtgaacaaatgtctctgcatcataaacaagttagagaaaaaagtgctgtgcttttgatgtgcatatacataaacatctcaatgccttaaagagcagtattgctgcccgcatgtcccacctccagccctaaggcgnttttcccctgtctncagtagatggaatatnacaatcgggttttacaccgagnacattccattggcccggggacgaggcagggacacagatggcnttcctctttatnttcaattgcaaagagggctttcctttcctnttttaattaatcctcntcagcacagaccttttttggatgttggggttgggt

SEQ ID NO: 708696 - DNA, 995 bp, Homo sapiens
  misc_feature (27)..(27): n is a, c, g, or t
tctcgatgcacgttgtgagagtgtatntggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataactgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgagatctaaatcggaaggtagcacacagacatatgccagccaatccagctcagaaggcagcactcagacatatgccagccaaaccagatcagaaagcagcagtcaagctgatactagcaaatccaaatcagaagatagtgctgaagcatatactagcagatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatcaatttgcaaa

SEQ ID NO: 708697 - DNA, 992 bp, Homo sapiens
  misc_feature (5)..(5): n is a, c, g, or t
  misc_feature (40)..(40): n is a, c, g, or t
  misc_feature (56)..(56): n is a, c, g, or t
  misc_feature (59)..(59): n is a, c, g, or t
  misc_feature (82)..(82): n is a, c, g, or t
  misc_feature (100)..(100): n is a, c, g, or t
  misc_feature (120)..(121): n is a, c, g, or t
  misc_feature (126)..(126): n is a, c, g, or t
  misc_feature (171)..(171): n is a, c, g, or t
  misc_feature (189)..(189): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (258)..(258): n is a, c, g, or t
  misc_feature (263)..(263): n is a, c, g, or t
  misc_feature (281)..(281): n is a, c, g, or t
  misc_feature (316)..(316): n is a, c, g, or t
  misc_feature (319)..(319): n is a, c, g, or t
  misc_feature (328)..(328): n is a, c, g, or t
  misc_feature (334)..(334): n is a, c, g, or t
  misc_feature (336)..(337): n is a, c, g, or t
  misc_feature (350)..(350): n is a, c, g, or t
  misc_feature (401)..(401): n is a, c, g, or t
  misc_feature (407)..(407): n is a, c, g, or t
  misc_feature (413)..(413): n is a, c, g, or t
  misc_feature (424)..(424): n is a, c, g, or t
  misc_feature (426)..(426): n is a, c, g, or t
  misc_feature (429)..(429): n is a, c, g, or t
  misc_feature (437)..(437): n is a, c, g, or t
  misc_feature (451)..(451): n is a, c, g, or t
  misc_feature (459)..(459): n is a, c, g, or t
  misc_feature (464)..(464): n is a, c, g, or t
  misc_feature (466)..(466): n is a, c, g, or t
  misc_feature (470)..(470): n is a, c, g, or t
  misc_feature (477)..(477): n is a, c, g, or t
  misc_feature (492)..(492): n is a, c, g, or t
  misc_feature (506)..(506): n is a, c, g, or t
  misc_feature (509)..(509): n is a, c, g, or t
  misc_feature (513)..(513): n is a, c, g, or t
  misc_feature (521)..(521): n is a, c, g, or t
  misc_feature (523)..(523): n is a, c, g, or t
  misc_feature (533)..(533): n is a, c, g, or t
  misc_feature (539)..(539): n is a, c, g, or t
  misc_feature (545)..(545): n is a, c, g, or t
  misc_feature (559)..(559): n is a, c, g, or t
  misc_feature (567)..(567): n is a, c, g, or t
  misc_feature (578)..(578): n is a, c, g, or t
  misc_feature (593)..(593): n is a, c, g, or t
  misc_feature (595)..(595): n is a, c, g, or t
  misc_feature (606)..(606): n is a, c, g, or t
  misc_feature (610)..(610): n is a, c, g, or t
  misc_feature (646)..(646): n is a, c, g, or t
  misc_feature (662)..(662): n is a, c, g, or t
  misc_feature (694)..(694): n is a, c, g, or t
  misc_feature (702)..(702): n is a, c, g, or t
  misc_feature (739)..(739): n is a, c, g, or t
  misc_feature (802)..(802): n is a, c, g, or t
  misc_feature (805)..(805): n is a, c, g, or t
  misc_feature (841)..(841): n is a, c, g, or t
  misc_feature (860)..(860): n is a, c, g, or t
  misc_feature (912)..(912): n is a, c, g, or t
  misc_feature (917)..(918): n is a, c, g, or t
  misc_feature (922)..(922): n is a, c, g, or t
  misc_feature (924)..(924): n is a, c, g, or t
  misc_feature (978)..(978): n is a, c, g, or t
caagncggcccagtacagaggaaaaacccgaacacgacanagaactgaggagagtncangcctgggctggtgggggccacanccgcgggccctggttgcngggaggcatggggctcaggnntgggngcctcgggccggggtctccgggcctcacttggccggccgcgtgangaagcgcgtggagaagtngaacaggtcccgattganctngcgcaggtngcgcacctcgtcctccagctccgtcacacggacgcgcantggtnctggccgccgagcacgcncttctccatggtgctgcacaggacggcctgcagcngcnccgtgcggnccaggnanntgggctccgagcnctgctggtggaggcccaggcgcagagtgaggcccccgtggcgcggctcgtncccgtnctcggngcccagcaggngnttnttgaagtngggcagcggcaggntgggcctnaagtntnatcncagcatnctgacgggcgccacnggatggcggcattngtnactnggcctttnanggccaccgtncggatncactgnttgctctgcacgtnccagaggngcacggtctcntcgtgggagcttganancagcacgctgncgtnagttgacactgacaggcaagtcacctggttcctgtnccctttgaagaccttnccggcgtcctgctctgggtggaagctcctctncctctgtncgggccaggtgaagaggtcgacctggaagatggagcnctcactgcccccgcagaacatatggtgctcagccaggtccatggtcactgccatgatggacangtnaaagaggacggagagcagcagctcccccgaggaganctcccatagcttcaccgtntggtccagtgaggaggtggccacccgggccagggggccccaaagccgcagtncaggnncgtnanggggagcgtgttgtgagaccagaagtgccttggcgccggaattctggaggggtnggcctgcagcacgc

SEQ ID NO: 708698 - DNA, 956 bp, Homo sapiens
  misc_feature (27)..(27): n is a, c, g, or t
tctcgatgcacgttgtgagagtgtatntggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataactgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgagatctaaatcggaaggtagcacacagacatatgccagccaatccagctcagaaggcagcactcagacatatgccagccaaaccagatcagaaagcagcagtcaagctgatactagcaaatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatcaatttgcaaa

SEQ ID NO: 708699 - DNA, 247 bp, Homo sapiens
tagagtcgaccagagctccagtcttacgatatttggaggtcagcacgatgactcacgtgtcgacggaacttgtacagagaggcatgcaccgcagatggtgaatacacgtcgaccaggctgcatgtatacgatattgggaggtgagcacggatctcatgtattgaaggaacttgtataggaaggtatgcaccgcagtggtgaatacacgtcgagctggaggacatgcatgcatggtcgggtcactgga

SEQ ID NO: 708700 - DNA, 596 bp, Homo sapiens
ccggcgtcttaatgaggctgtgagagtgcgttagagctcctctagaggatgtcatcaacggaggattgacgctctgcagctcctggtcagaaacatggatcttgacgccagacttgggggtgaattcggggacctgcacagactgcaggaatgtggccacagcagctcggtcctgagagcctgtcagcccgtaggtctgggcaaacaggttggcagcagccatcacatagtccagatgcaggggattgttgacatcaaaggtgagcgggtgtggacagcgtttgggcccagaccagaacggcgctcctgagcttgtgagctggtcaggagggaaattgtgcagcagatgccggatgttgtacgagtactgggttgtgccagtggtggcaggcccaggtcacgcagtcagcccaggtctgtggtcgctgcagcaccaggctgcgctgaaaagcctccagcacctccacaggctgagtgcctgccagccgcagtgttcgctccacaaacttggggtctgtgaggtactggttgacattttctgctgactgcttgaagaggccttcaaatcatccgaggccatgcaggtgtgctcgtga

SEQ ID NO: 708701 - DNA, 930 bp, Homo sapiens
  misc_feature (623)..(623): n is a, c, g, or t
atggcaggtgctgctgcttgaagcctgtgagtgggttgtggatatgggactggtgaggacgagtgaggactgttaggaaagtgtgtatctatgaataagggcagttgaatgtagaatttttaccagtccacttgagcttcttcttccctaaccactggctcttgagccagcttgggatttccctggccattgccaatagctggccatctggcttccaatatgtacacgttggctacatcagcgttcaatggagaatgcaacattccaagactcctggtgactgttactttccgcagagccaaccacgtagtgcagtatgtgaaggggaatcgtgggcttccgaacatgaatggattccttaatgaagcaagggaagataaagatctttataatagcaaggcaacatacttgggaataatagtaaagatagatcgggatcttccacgtgataaatggaataggcgcgaaaaaggtggtttgtggtttttgaacaccctgaggtatgtaaggggccagtatatggatgtgtgcaatcctaagttctctatacaagtgtaaaccactcggtatatttggcgtgcgtggagtgagacttggcagtgtgttcgccctggaaatatgangtgtcccaggtcgtcagcggtggttccgaaactacttcgttgtttggtaaaacgttgcgcgcacctatcttatattatggcccattggcaacataaccttttatttaggctgataatcacgccattataaaatgattcttctatgacatttaagaagttccggcgtcaacaggagttctggaggttccttgcgaccctccccgaatacgtgggtatatgcttttgaaacccgcgggttataagggataatagggcccttgaacaaattaccttgggggaaatcccccggtgggtgagggcggaaacc

SEQ ID NO: 708702 - DNA, 303 bp, Homo sapiens
cccccccccccttggggccagccaggaagcccccctggccctcagtattttttgcccccggccgggccggccctgggcccctgggctggggcctgtttccccagggttttagggcccccccccccggggggcctttcctttccccgcccgggacaaacaaggggcccaggggcccccttttttaaaaccgttttctgggcccccccccccccccccccggtttttgtgttgggttttcccgggccaggcaaaggggcccgtccccgttttttttttggccggggaaaaaaagccccctaagga

SEQ ID NO: 708703 - DNA, 642 bp, Homo sapiens
gtatccgcggaccaggcagagggactctgcaagcaatggctagcagcgcgcctggcaagagcggcgcctgctgctgcgggagccgcgctacacgctagctaggtggccgcctgcctactgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagacatggttatcgtgtacatctttataggggtaagtactatgccacccagccgaggcactgacataccgcataggcccagaacatctattgctgtgactctaccgtggcatacctatgctgctagtcttacttgatactatacaccagagctgcaaggtacctccacttcgtactatttatctatcatagtgctgcgcctcttaccgtgtccacatccatcttatgtgctgcggctcttcaatgacccagatggccatggtgctagctcttcctcagtataacctcctgctggaccagagctggggctgggggtagctgcttataacagccaggcagactcgtgaaatgatgtgtgttctagcccagg

SEQ ID NO: 708704 - DNA, 1109 bp, Homo sapiens
caacacccacttactatcatgctggctgctccatttccttctggaccaccaaataattcccccaccacctcccatatgtccagattctcttgcatgcatgctgcatgctttgggcaagtcatgttcaatttcatggtacatgagtggctatcatactggctcattatatgggttttcagcacaaaatcaaaaagaaggaaggtgctcacattccgttaccattcaaggcagcacatgctggcatagagcagcactaacatgacaccactaaagaaacgatcagaccagatctggaatgtgaagcgttcatagaagatcaactggcctcatttcttcaccaatatcaagtgttgggcaacgcaaaacaaggaagtggcaatgggtcaactcttcttgcattcaacaagttcatgtcaataaccaaatgcaatgtgaaatattttcactggcactctattttgaaaaaccatctgtaaaagactgcaggtgggggtgggaggccagctatggtggtgaggcagttgagcaaacatttgaatgtaggattagatttatgcaatgcatatgggataattataggtaattttatgagctgtgagaagggtgttgtagtttaataaaagcctgtctaaatttgcgatacttaagcagtttaggaatgaagtgtaagagtgtcttaaaatgtttcaaatggtttacacaaacatgtatgtgaggcagatatgtggcaaaaatgttacagaattctaactggtggacatgggatggatcagtagtactggtaaatatcttatcttactatactgtttaacaagtatttacttaaactctttcacttacattaaacttcaaaaacattatgaacaacagaggcgggcaccgaacaagagacgagcatcacgacaggaagagaggcacccaaggtatgaacagcaaaccacacggctagacatgcatcacaaagagtgaacaccaaatcagcaacacaacacataccaagaaaagaccaagagaccacaggcaacaaaaagcaagtgcagatgacaaacgcgaacacgctggagaagctgtgacggacacccgacccgagagatgaaacaaacagagca

SEQ ID NO: 708705 - DNA, 169 bp, Homo sapiens
  misc_feature (137)..(137): n is a, c, g, or t
tatcttgatctatatagcgttaagcatctctcgtagatattactaaatatgaggcactaaaaatggtaagagatcccatacagtagttgaacatacaactgtaagaagtagtaggaaagaccataaattcttcatangatggactatgcgtggccgggagatcctctag

SEQ ID NO: 708706 - DNA, 869 bp, Homo sapiens
ggcaggagcgaggccgggtgttaatcggccgaggcttgcaagcgcagaatgctattgagcgttgttgccaaatcagcggctttgattcagcaagccacaacagttaaaaacaaggatatcaggaaattgttctggatggtatctatgtctctgaagaaatggaaatgacatctgagcttgttgcaaattcagcgcgacttgatctcagcaagccagaacagttaaaaacaaggatcatcaggacaattttgggatggtatctatgtctctgaaagaaggcaaagtgttcagcaggctgatgaataagatctacgagttacctggctacagaaagaagatgccagatgacacttaagacctacttgtggatatataacaggactgcaagtaaccagaccgtatgactattgggaccttctctcttaagcaagaaaagaaaagcagaacaggcaacacaaagaacaagagcagaaaaaaccaaaaacaggagaacaaaacaacaacacaacgcaacccaaaacagactgaaaggaaccaaagagagaaagaacacaaggcacaggcgcaagagacacaacaaagcgaacacaccacaccaaacaaccgaccatccaagcatcccaacccagacaaggaagcacacacgagaaagaccaaccacagaagtgcacataagaccagacccaagagcacaaatagaaacgaaaaaaaagaaaaaaaaactgaaaaacagacgcgagcaaaaaaccaatgaagcaagcaaccaagacccacataagaccaaagaaaaagacagagcacagtacaccaccagcacaacgaagcggacgataagaccaacgacgcaccaccagcgaacaaccacaccc

SEQ ID NO: 708707 - DNA, 1012 bp, Homo sapiens
ggtgtctactgtgtgtgtgtgtctcggatctgtagtgtgtatttgtgtctgtgtgtgtctatgagtgtgtgtgttgtgtttgtgctgtctctactgtggtctcatgaaggagaggggtcagggtagattcggggaggagttcctattggtagcggggtgactttgtagtgatttatgcggcgtcgacttagtagctccttatctggtccgttccatcgtgggttggtgtatctgtttgtcccggagattgctccggggcgaggtcgcgtccactgtgcatgccgtgagctcgtgcgtgggtcggatggcgctgggccggacccgggcgtccgaccgtccgcgttttccttgcttggtgtctgggcctctggagggtcggactgcatccgtggggtgtgcctgatgattgctcccaggggccgagccggtcctccttcccggtccactcttccagggccaggacggctcccgcggagccaggccatcgtggctggtgtggtcccgagggtgctggaggtctgctggttagcctctgttgcccggagattgagtcgaggcgcctccagtcctctcaggcccctgacttgtcaagtcctttcaagtccttgtgccctgaccaagtgatgaggacaagagggctgagggcctgtcggtggggtcggcccgctcggtgccacctgagagggtctctcctccccgggcgtgatgattcgacttggcgggtcatcttggtccctcctgaggtcctcaatcggtcctgagttgagtctgccgcgatctgatctcgtggtggggccatgctctagggttgcctgtgccgtgctgtgggattactgagtgctggaaggccggacgtgggacccgagtcctccctgctgatgtcggcttgcttggtatgatggggcctgtgccgcctctggggagggctcgggcgtttctgatgatttgagttggagtacgtgtagtttgtggcagcgtcgtgtctggacggagtggtgggtcggctcgtggg

SEQ ID NO: 708708 - DNA, 338 bp, Homo sapiens
ctaaagtgctgggattacaggcatgagccactgcgcccggccaacccggaacttttcaaaagagacatagaaagttgcaagagagaactgagaaagttaaagactcaaggacaagtagacaaaaatataaaatgatcatcaacgaaggcctctgtgaccgcatccacctgtgtgtgcacatcacaacctgctgtttttacttagggcattctttaacttagggctgtcaactacaaacagtgcttcctcgatacacttcatctgcacactaacctgcatagcttgatttgcaaactctaagcctgcagacccaaaccaaggcataggaactcccccac

SEQ ID NO: 708709 - DNA, 1499 bp, Homo sapiens
  misc_feature (573)..(573): n is a, c, g, or t
  misc_feature (1269)..(1269): n is a, c, g, or t
gatgcccttgaggcagccatggctagtgcttctgctgagggggcaggcggagcattgtagggagagacctgcagataatgtatccctgctcgtttcgacagagatacgcagattaatacaacttacgttaaaaaatatcgttccagtaaggttacgtaagtatattgccttagccgtctacaagtttcccagaccgctaagttttacaatcagctttatacgactttcggaactagcagacactatcgagggaccttagaagcacgtagcaatagagcgaatgcgccaccggcataaccaggttctctccttaaaaaaccacgttgatcgagcaagcggtctagaactgacttgcacacggcctttcctttccactgcgacgcttagagaacaaacacttgtacattttttcaacacactgcacatacacttcggcacggcagcaacaagagggaccctaaccaggaggtccccgctgtaccatttctacattaccccagggtttagcaccacgcgcggctatcgttggcccttgttctaagggcactttacacacacgttgcacacggcgtntggcaccttctaagcatcccaggccccttcttagatacggctttccacgggttctcttaccaccacggttccggcatacgccgcatgaactttaatccattacttaaagtttagctcgcaccatgagcgcgcacttccctcttctctcacgaccagcacacgcgagggcacttttcaacgtagtccgccggaacacgcgcgttggcagttccttagccccatgcaaccctcctttggtcaaacaccttcggccatttgacaacggtgcatgctgcgcaccgcaacacttcggcgcgctctcacttactctaacaaaggggtccccttaacggtggttgaaacccggcctgatgttctttaccctataaacacgccggcccaagaaacccgaaacacggctcttgcgcaccacacggaatctttccccagtactgggtgcgccgatgcttttggccgcaacgtccgtacgttgggaacaccatgtcgaaaacgtttcttgagcggcaccgccaagcagcgaactttacccaatcagggttcgcgcgcaccagcggtttgggcgcgcacaacacgcgtttggctcacaatgttccaccgcaggcaacaacggctaacccgggcgagacaataacgcggtccggccaactgatcatcaaccccgcctacaattctagacgcacgcgcaaccgctcaccnttaggtgcgcgcacccacggtctgacctgcaaccaggcaattccacggaccaccctcactttactcctatctatcaatcgaacacctatacgctgatggcggcgtaactaagcacgcgtttataacaccgccctcctcgcaagacgcatagcctctcgcgtgaatacggcgccgcacctctgtcgaggccccaagagaaccacagtgcctccggcgaactccacgccaca

SEQ ID NO: 708710 - DNA, 184 bp, Homo sapiens
tcccggtcttagatgcgcgttgcccaccatgatgcggcgggatctggcgtagaaagtgccgcaacacgcgagcaaaagttaagccgatcgcttcgttcaccggtacctgtacgatgccttcgaggtcgtattcgaccggctcctctgcggtgatcagtttcgaatcgattgtgttgatcttgcg

SEQ ID NO: 708711 - DNA, 553 bp, Homo sapiens
  misc_feature (9)..(9): n is a, c, g, or t
  misc_feature (11)..(11): n is a, c, g, or t
  misc_feature (18)..(18): n is a, c, g, or t
  misc_feature (56)..(56): n is a, c, g, or t
  misc_feature (76)..(76): n is a, c, g, or t
  misc_feature (103)..(103): n is a, c, g, or t
  misc_feature (108)..(108): n is a, c, g, or t
  misc_feature (137)..(137): n is a, c, g, or t
  misc_feature (162)..(162): n is a, c, g, or t
  misc_feature (173)..(173): n is a, c, g, or t
  misc_feature (201)..(201): n is a, c, g, or t
  misc_feature (220)..(220): n is a, c, g, or t
  misc_feature (231)..(231): n is a, c, g, or t
  misc_feature (240)..(240): n is a, c, g, or t
  misc_feature (256)..(256): n is a, c, g, or t
  misc_feature (259)..(259): n is a, c, g, or t
  misc_feature (263)..(263): n is a, c, g, or t
  misc_feature (279)..(279): n is a, c, g, or t
  misc_feature (299)..(299): n is a, c, g, or t
  misc_feature (304)..(304): n is a, c, g, or t
  misc_feature (313)..(313): n is a, c, g, or t
  misc_feature (326)..(326): n is a, c, g, or t
  misc_feature (380)..(380): n is a, c, g, or t
  misc_feature (382)..(382): n is a, c, g, or t
  misc_feature (385)..(385): n is a, c, g, or t
  misc_feature (410)..(410): n is a, c, g, or t
  misc_feature (413)..(413): n is a, c, g, or t
  misc_feature (418)..(418): n is a, c, g, or t
  misc_feature (427)..(427): n is a, c, g, or t
  misc_feature (433)..(433): n is a, c, g, or t
  misc_feature (435)..(435): n is a, c, g, or t
  misc_feature (437)..(437): n is a, c, g, or t
  misc_feature (446)..(446): n is a, c, g, or t
  misc_feature (460)..(460): n is a, c, g, or t
  misc_feature (476)..(476): n is a, c, g, or t
  misc_feature (482)..(482): n is a, c, g, or t
  misc_feature (488)..(488): n is a, c, g, or t
  misc_feature (519)..(519): n is a, c, g, or t
taatgggtntnaaaattntgtgaaaaatttttggtcaagttgtttccattaaaaantactgattttaaaaaataanaaattaaaaatgccaaaagcaaaaaanaaaancaaagtggtccaaaaaaaattttcctttncttttgaaggttttacgatgcattnttattattaancagttttttaataataaatttaaatggncaattgaaaaaaaaagttntgagaacgttnttccaccantgattaagagtggggnggnaggnattagggataatattnatttagccttttgagctttntgggnagaattggngaccttgccagcnccagcagcctttttgttcactgctttgatgaaacccaccgcaactgtttgtttnanatnacgaacagcaaagcgacccaaaggnggntagtntgagaagcnctcaanananatgggcttnccaggaaccatatnaacaatggcagcctcnccaganttcaanaatttagggccatcttccagctttttaccanaacggcgatcaatcttttccttcagcccagcaaa

SEQ ID NO: 708712 - DNA, 1666 bp, Homo sapiens
  misc_feature (1590)..(1590): n is a, c, g, or t
agagtatgatatgtcgaaccacgcctcgtgtcttagcgtgaggccatcagtgactgaactgcaagaggcgtggtctataagcaatggcataaatctaagaagaaggcctttaccaagtactgcaagaaatggcagcgatgcacgatggcaagaagccagctggcacgcaaggactatcagcagcatgcaacaagtactgccaagctcatccgcggtcataggcccagcagccagatgcgcctgcattcctctgccgccagaacgaagggccacctgactggagactccaggtgaacggacgcactgctgggccgagaagcgtggacatggcgcccgccgagcaggcttgaagcagcacggtacgcgtgtcgaagccaaaggatgcttacgcgcgcaagcgcactacacgacgtgagtacgaccgtgacagacacggcggacgaaccaacacacgggcaaaaagtgcgaacacaacacggagggagacaaaccaacgctccgaagcggacagccgaaagaacacctcgcgcaactgcacgaacccacaacgaacggaccgctagccacacaagcgggaagacaccccacagtaacttacggacggaggcaatagaggcaacatagctatgagctacgaactaggaaagcgcggcaaaagtgagacatgggaggaggcaacagcgcgcgacgggggcgcacgcacgaacacacgggcacagacaacgagacaccgacagaccgcaccgaccaaaccacaccaaagcgaaacaagaaccaaacacataaagaacaccaagtaacccgcagagatactaagacgcgaaaggttaaaccgggaaccaggaacagaaaggggactgacgtaacaacgcgaacacaaaccaacgcggacaccaccgacgacaaccacatgaacgaacgcactcaaccacccacctgcaccacaccagaccaagcacacactacacgaccgcccaaccacgaaccggacggggcaaccacacgcacaccgccaccaccaacactggcgacctgcacacaccatcgacacccacaagagcagcaacgcagacgcgaaccgaccacgcactaaaacccacgcggcactagccaacacgcacgcggagccaccagagaacgccaacacaaccgctacccataccacactctcgaccacccagcgacgcagcacgaataacgaagacccagggacaccggacagaacacacaccaacaactggacacacggagcacacgcaccgtaacagcccacactcgacaacacacgaccgaccaccacacgcaccacccaacagaacccgcacgaacaacccgaacacagacacacgtagaagagcgagaccgggagccaccaactcaacatgctggaacacaaacgagacgcagatcagaacacaccaagccaactccacgcgaagcacgcgtgaggacacacccccaggagacgcgcgggtcagagaacacaccatacgagaaagaagactgtagagaggaaagcccagaccagccgacactcaggcacaacagccaccagacacgaacctctccatccgagactcgaagtcaaanacaggaaaccacagcagaatcggatagaaccaagaccatgatagagcaagcgtcgaagaggacctcggcaaaatcg

SEQ ID NO: 708713 - DNA, 333 bp, Homo sapiens
tgattctctgcaggatcccgcacactttttgcaacctggctttgttgtcacttttcatctccatctttgcattctctgagaactcttacacgtttctgtaggtccattttatatctacttgactcaccgtattactttctggttgccacatgtttttctttcttgtcttgctcatcctattttactgctgtgcccttactgtgattgattttccaaactatatattacctggagcagcagttatagcatattatgccttcagtggcattctatcaaatggagtttccctctagcacagttctgtaagaagtgcgtttgagattgtgtgtatat

SEQ ID NO: 708714 - DNA, 280 bp, Homo sapiens
gaggatccgattttgcggctgcctttcctgaggcgagcctgtctcacgcaggttctcagcccgagaataggattgtgggtgggtgagggactgtcccctcttccaccacgccgggaggctcttagaaaaatgtcactggtgggctgagcccatcactcctaccccatggaaaccctctgggaaccatccagacaaaccagcaaggacaatgacagctccatgtgccctccctggtctctccagccaattgctccacgtccatgtccacttcatgctgggc

SEQ ID NO: 708715 - DNA, 254 bp, Homo sapiens
tttcccccttttttggggggctttttggggaaaaaaattccccctttttcccggagtttttcaaaggatttgggggggtaaaaccttccaaggggcaaaaagttttttttttttttttggggctttaaaaaaaccttaaaatttaaaaaaaggtgttttccttttaaaccccaggctttttttttgtttttaaaccccgtttttttttttgggttgtttttttccccctggggggaaaaaagttaaacggggga

SEQ ID NO: 708716 - DNA, 188 bp, Homo sapiens
  misc_feature (105)..(105): n is a, c, g, or t
tgagttattttactggctgatctatgtatcacgaggccagtatgtacagacaacagtgggaggttttatttcttggtctcttcctccttgtgatctagtcttgantgatctcctcctttcttgtgcctgagggcgctcttcacgtgcgcttgctgtgcttccgttggtcttagacctgcgtggcctca

SEQ ID NO: 708717 - DNA, 120 bp, Homo sapiens
ttatccacagaagaatcaaaacatatccttctattagttctccattttccctattattggagatgaaagagtagaaaagagaattattttctgtatgcaattacagctcctaaatattca

SEQ ID NO: 708718 - DNA, 1353 bp, Homo sapiens
  misc_feature (505)..(505): n is a, c, g, or t
aagcaacttaagctactatgatcctaattttacagatgaggaaaatgaggcacaaagaagtctgtctgcgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggtncatgatctctaagatcaagtaaaaatcataatttttacttattaaaaaattgcaacacaagatcaatgtccatagcaatatgatagcatcagccaatttgctaacacatttcttgggatttgcccttcctggggtataggggatcagaaatattgatccatgtgcacgcagataaaatggcttctgctaaacagactaaaatctttctctctagtctttctcactgtacaaacccagttgttttcaaaaaatcacagtagcaatgcaactcatcactctagaaaagcaagcttaggctacctgaaagattttccccttggaagtttagcgtatgttgactaacaaaaattccctacatcagagactctaggtgctatataatccacacaacttttcagcctgtgctcattctgtcccatgctggccataatacctagtcagcccattacccttatctcgaattgctccatctcctggtgggacttgtatcttgtctgccatatcagaacaaacccctgaagaggttctgattcgatttactacactctcaagccctaccccttttatcgggacgcttccagcccgcaaaatagaaactgaacgaggacacgggcgcacatctcgaccaatttaaatcccaacaatgtcttacaactttaattaaaagggtaacccctaaggaatctaaagacgcacattgcttgaccgggaccgaaacacgaccctactaacacggcaaccactacccacatcagcacgaaggccacatcctcaactccaacctagtcccccccatttatgttggccaccatgccgcacgatcgccactatcgctgcacatcgataga

SEQ ID NO: 708719 - DNA, 1571 bp, Homo sapiens
  misc_feature (723)..(723): n is a, c, g, or t
aagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctgcgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggtncatgatctctaagatcaagtaaaaatcataatttttacttattaaaaaattgcaacacaagatcaatgtccatagcaatatgatagcatcagccaatttgctaacacatttcttgggatttgcccttcctggggtataggggatcagaaatattgatccatgtgcacgcagataaaatggcttctgctaaacagactaaaatctttctctctagtctttctcactgtacaaacccagttgttttcaaaaaatcacagtagcaatgcaactcatcactctagaaaagcaagcttaggctacctgaaagattttccccttggaagtttagcgtatgttgactaacaaaaattccctacatcagagactctaggtgctatataatccacacaacttttcagcctgtgctcattctgtcccatgctggccataatacctagtcagcccattacccttatctcgaattgctccatctcctggtgggacttgtatcttgtctgccatatcagaacaaacccctgaagaggttctgattcgatttactacactctcaagccctaccccttttatcgggacgcttccagcccgcaaaatagaaactgaacgaggacacgggcgcacatctcgaccaatttaaatcccaacaatgtcttacaactttaattaaaagggtaacccctaaggaatctaaagacgcacattgcttgaccgggaccgaaacacgaccctactaacacggcaaccactacccacatcagcacgaaggccacatcctcaactccaacctagtcccccccatttatgttggccaccatgccgcacgatcgccactatcgctgcacatcgataga

SEQ ID NO: 708720 - DNA, 1562 bp, Homo sapiens
  misc_feature (714)..(714): n is a, c, g, or t
ggtcctgtcttacggatcgctggctgtttatgagcggagatggtgaggcacgtagagcgagctcgtaagccatgaagaggacatgagagtattaatagcatctaggttattagctaacatctggatcataacactatacttctatctagatctaatgtatgcagctcatcaagtactctgaatatctaagatggtatcttaaattccagttggaacgttctggaccgcaagtcattgcttcgcaggatcttcgcctctagcagactgagtctgtctgcgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggtncatgatctctaagatcaagtaaaaatcataatttttacttattaaaaaattgcaacacaagatcaatgtccatagcaatatgatagcatcagccaatttgctaacacatttcttgggatttgcccttcctggggtataggggatcagaaatattgatccatgtgcacgcagataaaatggcttctgctaaacagactaaaatctttctctctagtctttctcactgtacaaacccagttgttttcaaaaaatcacagtagcaatgcaactcatcactctagaaaagcaagcttaggctacctgaaagattttccccttggaagtttagcgtatgttgactaacaaaaattccctacatcagagactctaggtgctatataatccacacaacttttcagcctgtgctcattctgtcccatgctggccataatacctagtcagcccattacccttatctcgaattgctccatctcctggtgggacttgtatcttgtctgccatatcagaacaaacccctgaagaggttctgattcgatttactacactctcaagccctaccccttttatcgggacgcttccagcccgcaaaatagaaactgaacgaggacacgggcgcacatctcgaccaatttaaatcccaacaatgtcttacaactttaattaaaagggtaacccctaaggaatctaaagacgcacattgcttgaccgggaccgaaacacgaccctactaacacggcaaccactacccacatcagcacgaaggccacatcctcaactccaacctagtcccccccatttatgttggccaccatgccgcacgatcgccactatcgctgcacatcgataga

SEQ ID NO: 708721 - DNA, 116 bp, Homo sapiens
  misc_feature (63)..(63): n is a, c, g, or t
tgccgcaccaggcgcacttcttggaactttcagtcttcctttctgtaacaggctacttaactnttttacaaaattgtttctatcatgcatagctagagacccacctcctgttagaa

SEQ ID NO: 708722 - DNA, 371 bp, Homo sapiens
agcagtacatacagactcaaaaaagaaaaaaaaaaagaaaatcctacagtatgggacaatatagatgaccctatgaggacattatgttaaggtgaaatacatcggtcacagaaggacaaatactgcttaattctacttatatcaggtactaaagtagtcaaactcatagaatcagaaagcagaattgtagccaggagctaggtggaggggaaactatgaggaactgctaatcggtgagcctggttacaattatgcaagagaaactagttctagagatctgtgaaacattgcccctatagtataacaatactatattagtagcacttaaaaatctgtaaaggaggtagagctcatgtcaggtgtctggcccc

SEQ ID NO: 708723 - DNA, 396 bp, Homo sapiens
aaacaccttagaaaacccattagcctcaaatcttgtgagaactcactcactatccatgagaacagcatgggggaaatcaccccccatgattcatttacctctccctggtctctcccttgatacatggggattatggggattatgttgggaacaggcccccaaatctggccatagacaggccccaaaactggccataaacaaaatctctgcagcactgtgacatgctcatgatggctatgatgttcacgctgaaggttgttggtttaccagaatgagggcaaggaacacctggccacccagggtggaaaactgctaaggttgttcctgaaccaccaacaatagcatgagtgatctgtgccttaaggacatgttcctgctgcagataactagccagaa

SEQ ID NO: 708724 - DNA, 138 bp, Homo sapiens
ttagaggatcccggcaccattgtgtggcaaaagaagtgagctggagatggatcatagccgaaggagtcaggtgtgcaatgatgttagctgtggccacgtgtggatttttcgcaagaacattaataaactaaaaacttc

SEQ ID NO: 708725 - DNA, 792 bp, Homo sapiens
agaaacaaggcaatccagtgaccaaacaggcaattaatcattagtggatttgagaacacaatttcatacgtcagtgcaaagcttacaaggcagtatgaggggaagctggtagctctaattgatgcattctgcaagtccaagttactgaagcagaaggactttctgcaattctctttccccttctacatctcctacttctactccttacttggctcatttctcatcaagaaacattcatcagcagtgcagtgttcattttccgtatgtgttatcatcatctaacaaccaccacacccatcaccaaacgattggctcacacagttgcattcaccatccaacagcaatcgttttcagccttcatcgtattatgcaagctcactggccatcattccattagggatctcctcctcagggatttactcatcatcaacatcagctggaacatattggagattcactagcacacaacctcatagtttcacattctttcgtcaagcacacattccgatttgttccctcccaggttcagacagaactgaggttgcatgccaatttcagcctatcctgggggaaacgaagacctctggtaatcgggctatccttccaaattcaaaattctcatcccaaaaagcacgggacgggccccttttttaccaaccagcctttgggacttttaagcaaccaaggtacattcataggaggtaaggctcattgtaacacctcaaacgttggctccgtaacttttgggtatctctccccactatttaaggggagcttaatctattctaacat

SEQ ID NO: 708726 - DNA, 93 bp, Homo sapiens
ccatataggttggacgaaaattggattttatatgacaccactgacaaccagctcagctgttggactgagaagctccaaagccaaacttgcacc

SEQ ID NO: 708727 - DNA, 341 bp, Homo sapiens
  misc_feature (13)..(13): n is a, c, g, or t
  misc_feature (44)..(44): n is a, c, g, or t
  misc_feature (94)..(94): n is a, c, g, or t
  misc_feature (111)..(111): n is a, c, g, or t
  misc_feature (127)..(127): n is a, c, g, or t
  misc_feature (335)..(335): n is a, c, g, or t
  misc_feature (339)..(340): n is a, c, g, or t
ggaatgtcctganttttttaaaaaatggatatttagtgaagaantgcctgggcctacctatacattatgcattttacatgtgcctaactagaanttccacagtaaccatcntggtccatggcaggantcccattttatcactgagcaaactgggatttaaaaggattaggtaacttgttcaaatatcccacagttagtgggtggtagtttgtgaagctcaggtgttccatatttaagtttgctcatccctgtagtttgcttagatatttgacaatttatcagaagaggaacaggtgaaatgagaaacaaaatggtgagaagctacaggttattantttnnt

SEQ ID NO: 708728 - DNA, 207 bp, Homo sapiens
  misc_feature (91)..(91): n is a, c, g, or t
  misc_feature (102)..(102): n is a, c, g, or t
ccaggtcccttccgggcgcaggttgttggcagaatcagttcctggaggagttcccatcgtggctcagtggttaacaaatccaactaggaancatgaggttgngggtttgatcctggccttgctcagtgggttaaggatccggcattgcctgagctgtggtgtaagtcgcagatgtggctcggatcctgcgttccgtatattgcggtc

SEQ ID NO: 708729 - DNA, 1273 bp, Homo sapiens
gcaacagagggctcgtccggcgccagtgtctaccgcccagtctactcagaatccgtggactacgaggtgcttcggaacagctgcagggtgtttgctttcagaatgtatacagaagatgaagctaggaacaataggagtggttggctgggtgaagaataccacgcaaaggcaccgtgacaggccaagtgcaggggccagaagacaaagtcgattccatgaacgtcctggctgagcaacggttggaagccctagtttctcgcagttgaccgcagcaaatctttgtctaagtgaaaaaagccatctctaagcttgaactactctaagtttgagtattcagcatactaatacgaagagaaaaattggtagagcacagctgacacaatagatactgtatgttcttagagcactatgtatagctagaataatagtagcagagtagggtgagaagaggaactgtactagtatctgaaacgctaagcgactgtacgtgcgactagacaaatgtctgacacctgtaagataacttttacgtcacactatgtactgcactcaagccagaaacctatacgtacttcctaagaagttaagaagtgtcacttacatacatgaattgcgcacataaaacctcgaggaccgatcagagcgttcggcgctaggtaacttgacacaggagcaatgggccatggtgtgcaccgttgtggcaactgaagagggtttctcgggaggacccgcggaacttacacgcgtggcacatagaacggaggggaaaatttctcagacggagagactccccgctgtatagttagcgctcagaactcaacgcttgcgagcatgccccggggtatagaccctggattaaatgatcagccccagagactgggcaaccacggtgacacggcagacgcccctggagagccgcacgaaagcatgacaacggggccccgggaacaggcgctaggagacgaagagcacgggaacaatgggagagcacccaaggataatgggacacgaacaacccgacattgaccgcccagaactactcacgggagttacaacaggggacgaacagagctaccaagggggactcacagaccggtcgggacgcaccaaacaagcgcaataccacgaatccccagagagcccacacaaaaggagcaataaataggaagagaacacagacgcgaagacaacactatgaagagacaggtacagaccgcaacaccaccaagagcagaacacaagaaacggcggactaaattaacatacaataatc

SEQ ID NO: 708730 - DNA, 384 bp, Homo sapiens
gagttttgctatgctcccataaggtgcaagtggtgagcaagaatggtgcctcccttctcccaagtgtgcccaagtcctgacctgtgaatctgcacatatcaccttatttggaaatagaatcttcacagatgttattaagaatcctggctgcgctgggctcaatggctcacgcatgtaatcccatcactttggtgggccgagccgggtgcatatcgaggtccgcagatcgggaccataccggccgacacggtgtacccttgtctctattagaaataccacagcaaaatttaggtcggccgtggtggcgggcccctgaagtcccagctactcgggaggatgatggacgagaatggcgtgaatctgggccgccgagagggtacccgc

SEQ ID NO: 708731 - DNA, 102 bp, Homo sapiens
  misc_feature (63)..(63): n is a, c, g, or t
gatcctccattggagtggcccaatctttcctctagggcaatcctgaaagcccaaggcccttcncagtctggccttggcttcagctggagaagggtaacatca

SEQ ID NO: 708732 - DNA, 615 bp, Homo sapiens
ggtcttgaggtcgaagcatctgggagtgagagacttctgagccaagtgtgtgtcagttcctggagctgtgtcagagcccagaaggtggcttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgtacggctcctttctcatgcatgtcgggagattggaccatgtggaggtagggagaatagaatagtcgatagtccgtttcgactgaggccatgccggtgagcaacatctatccgaatagacatgtcgctaccctctcagttggggagcccagagaggacgtgaacgtgtgtcaagagtgaggacaggagaagcgcatactgtgcttgcctccggtaacctcgacgtgaccaagatcgatcgttccagacctctttgagggcactgctgagatggatagcaaggtgtcagaactggagaaggtggcattggccgggggtaccagggcacggaagcccaatggatgcgctatacgttttgtggcctgtgcgtgctggtagatcctc

SEQ ID NO: 708733 - DNA, 214 bp, Homo sapiens
  misc_feature (201)..(201): n is a, c, g, or t
cctctgcagctgaagctctgaccactaccgcgcagccctgcgctcctgcagccttgtgctgtagcaccagctcagacaacatcaaggtctctcttccgctaagggcaaggtgctggcccagtctagggggagtacatgtgagtgccatccccatcctgatggcacgccctgacacgctgtaatctttccaaccaagatgantccacgtcagagc

SEQ ID NO: 708734 - DNA, 320 bp, Homo sapiens
taattttttaggaacatctcaaccacaaaatacccacaagtggccgggtgcattggctcacgctggtaatcccagcactttgggaggccgaggccggcggatccgaggtcaggagatcaagaccatcctggctaacacggtgaaactccgtctctactaaaaatacaaaaaattagccaggcatggtggtgggcacctgtagtcccagctactggggaggctgaggcaagagaatggcgtgaacccagggggcagagcttgcagtgagccgagatctcgccactgcactccagcctgggcgacagagtgagattacatct

SEQ ID NO: 708735 - DNA, 195 bp, Homo sapiens
aatctggaaaaaggggggctttttccaaagcggcccccaggtacttaaaaggatttttttggattacggttttttccaaaaaaaaagggcataataaggccataaacccgcccttctctttcagcgggaagggttttaaaaatatttttgaaggggctgggagggcaaaaaagccctttagttcctttttgttta

SEQ ID NO: 708736 - DNA, 406 bp, Homo sapiens
ccctctgttcatacatgtacgatgcgtgctaaccatgtcacacataaaactaatgaacacaaagtccctcatgctacctttttatgcttacactccatccaaacctaattcatgccaaccacttatctcctatcagtatatagtttcatcatttcactgaatatgataaaaataacattgtattcgtcaatggttttcatacattatatataaataatgttatatgactttttattgctcgagagtatgtaagcttttggcattcatgtcactcagcaaattactcctaaggttaatatgcgttgatgaatagttgtttgattatttcttttaccaccatgtatctaaccagatgaaagtagtgtatatttgagagtagtatacatattggatgtatatacaagag

SEQ ID NO: 708737 - DNA, 201 bp, Homo sapiens
tgtgatgatggggtagggtaataagcagaactctgacgtggtagaaaaaatagacctgaattatgtgtaactttgaggaaggtttaatctgatatcaaaataatcattgaaatacaattccatggtaaagttgtacagaaagttatagagattatattgtgatgctggatctgggcgtcggcgcgcgcgtaccgagctcca

SEQ ID NO: 708738 - DNA, 574 bp, Homo sapiens
agtgtcggctatctgtatttcattcacagccagatcatatctatgggacaatagtattgaatagatttcatgcttttatgctggagataactggcatgtgagcaaactgtgttggcgtgagggtggaggggtgaggtgtgcgctaagcctgtgtttacgatttctcaggtaccccatcactaaaggcaccgaaggcttaagaggtaggacaagccatggagccttcctgtgtcaggagagacaagcaaagcgctattatcctaaggtcaagagaagtgtcagcctcgactgatttttattagtattgaggacttgcctcaagtccgctctttctggagtgaagcttccgaaggaatgcttgtaagtacccctgggcttctcttaacatttaagctagctgtatttatagcagctcttaatattacagcccatatctctagcggtgcttgaaggggagggacagggggaaagcgggcagcagtattccctaacttttccagaagcctgttaaaagcaaggtctccccacaagcaagttctctgccagatcgtcaccccgtgcctttggatctagc

SEQ ID NO: 708739 - DNA, 822 bp, Homo sapiens
tgcagcaaggagaccaggaaggggtgagtacaaggaagtcggatgtctgagctggagaaggccatgggtggccctctatcgtacgttttccacctaatattctggtaagggagggtagtacaagcacaagctagaagaaattccagaaacctacaaaggacgctcatacaaacaacagacgctttcccacttttactttacgacagagacacatttcaacacagacggcacgagacgagataaaagaccaacacataccacaaaacacaccactaaaccaacaagacaaaacagaccagacgacacaaaaaccaaccaaagacaaaacacaaaaccaaaagagaagccacaagagagaagcaaccaagccaaggccagccgacagaacaagagacagcacagacaaagacaatataacgagaaacagcaaggcccaagaagccaaagacccaaagatagagcagaacgagcaaagtcacaagcaagagaagaacagcaaaccaagcaacaagagcagagcaagcccaacataaggaagaagctaaaagccagagatccacagcccagaagagaagaaaagcagaacagaacgaaaccgaggcagaagaagagaaaagcaaggaagaagagagaagaggacgcacgagaaagcgaggtccagcaggagccagaacataggcaagatggtgaaggcaggatgccaagccgagcagtggcaggggcagggcaagaagcagagcgagccaagaggagaagggaccaagaagcaaagccccaagaaggagcagcaaggtagagcggaagagcagactaaggtccgag

SEQ ID NO: 708740 - DNA, 87 bp, Homo sapiens
gggggggccctggggggggttaaaccgggttcccaaaaaggggaaattgggggggaaaaaccttttgggcccctaagggttccccca

SEQ ID NO: 708741 - DNA, 477 bp, Homo sapiens
ttgctggtattctctgagcttattggatctctggtttagtgaatggaaattctcagtcattattgtttcaaatatttcttctgttcctttctctatttcttctacttctgggattctaattatgtgtatgttataccttttacaattataccacagtaattggatattctattccatgtttttcagtattttttctcttcacttttcagttttggaggtttctattgaaatgccctcaagctcagaaattctttcctcagccatgaccagcctactaatgagccctttaaacgcattcttcatttctgtttcagtgattttgatttctagcattgcttttggttctttcttagaatttccatctctctgcttacaatcccttctgttcttgcattctgtctactttatccattagggcccttatcctattaattgttttaaatcatagtatgataattccaacatccctgccttatc

SEQ ID NO: 708742 - DNA, 1549 bp, Homo sapiens
  misc_feature (1117)..(1117): n is a, c, g, or t
tcgatggtgtattgtgtggggtcgtcttcagctagttgttgtgtctgtggtcgcgctccgcgtctctgctattggtgggatcgacacctacctgtagttctcgctttagccgcggggtttgattatatgatggtcccccgcagcggttatttgtaacagggtggccgctttggcaagatacgggcacgcggctggttaacctcttttgtagggccccctgtggggtgatgaataggttgttcgaccgattttgacggcccctctcgggagttttaatttcgcccctgtgttgtgtctcgctggcaccaaactcgttacgaagtgttttttgtccccctcaggcaaaacgggaaagaatttacagaaaaagggaatttcgggagaagttgttgggtttttttcgggccccgggaagtaccacaacggtgcgcattgtgtgtgccaccacaggcgcgtttgtgttcccccccggggtttaaaaaatgtttggtgggaggccaacgcttggtgaacacgcggtttgcgacggaaatagggccgattgtagccccccccgagagtttttattatgcgccacttggggtgttcctccttcatgaattgtcgaaccgcaacgattaaatataaaggggcctgggggataatacccacggcctcttttggaagaccaccacacggcccacccttcggtgttccaaataacctgggggcccacaaacacgacgcacctttgttggggcttctactaagagaagaacacgcactctggtaaaaaaagatgggcctctcttgtgtgaccacagccctggaagttactcctggttattattaaatagactcacacatgggccccatagagtggcccacaaaagatcttatagcggcttcttatgtaatattgtgccacacatctgtttgtgagaaaaaatatttgggcccacccagcagaatatatgggggagtatgttataatctccgcgagttggtcccgcgctttttcgtcgttgatacgtctaaaatgtgtgtagacaaatatattttatggagtacacctcttcttttgagaaacacacttataccacgctttttcttgtgagagacacacactgagactttntgttaaaggagtctggtgaactatattctatatcacttcctctatatgagacacatggaccacttgtttctgtcacctaaatccctctggagttttggctcgtatattgtcaccctataaattggtaccacggtgagctcgagtgagaaattcttctatagtggattatatcactgataccaccttcttcggtcacacacacggttttcctctcacgcttgtgaagctttttctttataaaaggagaaagagtatcccaaatgcctcgctgctaccacccctctttcacaattgctattcttttgaaaaggcacccacgtaatgtgttttagagttgagttttccccgtttcaggggaatcccggaccgtagtttcagttttgatggtataacgccaaaccaattaaacgtttataaaagttgtattcttga

SEQ ID NO: 708743 - DNA, 509 bp, Homo sapiens
  misc_feature (61)..(61): n is a, c, g, or t
ccctgaagaaacgaaaaagaaaaacaaaaacaacaaaaaacaaaaaaaacaaacaaacctnaaaaacaaaaatagacacaaaataacacaaagaaaaacaacaaaaacatttaacacacaccaaacaaaaaaacaaaaaaaaacacacacaaaaaaaaaaacaaacacaaagacaaaaaaaaacaaaacaaatacaaaacaaactcaaaataaacataactatcaaaaacaaacccaacacacaagcacctaacatactcaactaacactacatcaaacaccacggatccaaacaccataacaaaaccacgaccatcaaaaaactaatcacacaaccaacatagaagcaaacataaaatacaaaaaaccacagagaaaactaacgaatcacaaaaacaacacaaaaacaaaacactaccaaacatcccagaaaaaaacaatcaaaaacaaaaaatctacagccacaatacaactaaatcaaaataacataaaaaacacacaacaccaca

SEQ ID NO: 708744 - DNA, 291 bp, Homo sapiens
gcattcatgaaataaatatatgatgacgggtgtattctcgtgtagaatgagggtaatagtgttgttatagtggtgggtgagtgagccccattgtgtgtaggtacctatgtagagggagtatagggctgtgactaagtatgtaaaatacagtaagtaggagagtgatatttgatcaggagaacgtggttactagcaacagagagttctcccagataggttaatagtaggggggataaggcgaaggttaagcagaggctatgctaagaagtacatccaacacaagctcattag

SEQ ID NO: 708745 - DNA, 777 bp, Homo sapiens
gggaacatgaggcttggtagtgagcccgctgctgggccaggcgctgcggtgctgcttgcattcccgggtcgctgggtgaacaccgcgtgaggccccgggacttgcctgtcgttgcttggtggtgcggcatggtcttctgtctgtcgacgcgaggagccgcgctctgcccgctgcgaggtcgactatggtccacttccaggcctctggaagtccagcgagcgtgctacacaacaagttcgtggtcatcttgggggacttccattcagagggctgtgtacaaggacctggtgctcttgctccagaatagactcacgtttcacagctgcccagctgaaacgccaagggggagctgagctttgaacaggaccagctgttggtctggggaccaactgggtgagctgctacaacgggaacacagtatcggtgaggtccgccagtatctgctcgggctctaggcgcacaccttgtgcgcttctacttcctcacctcgtgtatactccgagtaccttgaggatgttctggaagagctgacatattggacctgccccggaccgtggtgaatcatcaactccatgcctctgggatctttccagatatggtcggctgctcaatggagagctacctgggagcaacctggaagcgggtagtttgtgcgcattggaccacgttatttgccagactcctgcctgttgggtgtggaactattggcgatgccccatcggggaacgtatcactggggattacatactgcaagagctccagcccctggcagggtgc

SEQ ID NO: 708746 - DNA, 805 bp, Homo sapiens
gctgtaccggggactacgcgtctcatccatggcttccgctggactctcgccgggtggcggggtggcggcggtgccggggggcaccttccagccctacctagacaccttgcggcaggacgctgccgcggacggacccaacgctgttgtccgtagtggtggcggttctggcggtgctgctgacgctagtcttctggaagttaatccggagcataaggagcgagtcagagagctggtgcttcattgtgaggcctttgtgattccggggaaaacgttgctctttgtcaggttgttaacaggcctttatcagagacacgtcagacgtccattactgacagctgtgctgtattcgatgagtcaacaataacaggggcaatagtctgaccttgatatgaccttcccggccatgagagttcgaggcttcagattcttagagctggtttaagtcttcatgccagggctatggtgttggtagatggatagtgcagcattccagacgagaggtgaaagcatgtggctgagtttctgtatcaagtcctcattgacagtatgggtctgaagcaatacgaccatcattcttgaatagccgtgcaataagcaagatattgcaatggcaatatcgagccaagttacattcaacagcagctggagaaagaagtcaacgaacttacgagttaccccgttctgctggcccccaggacacctggacagttccagcactgcccctgcgtcagctggggacagaaaggccaagagtggaatttctcacaagttgccctcaatgtggagtcctggagtgcagtgcaag

SEQ ID NO: 708747 - DNA, 1254 bp, Homo sapiens
tataagattattagtttaaaaggggaaataggataggagttagcggtggtaagggcgatgagtgtgtgtggggaggaagtgggggtgggtttggctttgtttcaaacgtgctcattttatattttttacgttgtgttagactactggggagttaggtgtcgattgagggtggaagttagacttctaggcgttcagagttagacaagttcagacaggttaaggagagggttgacagtgggtgcgctatactgaagtggtgtgtgggatatgtatggaggcttatatgtggtttttgtgggtgaaatttcttctcgcattaagtggccccattttgtggccaaaagagcccggttatcagccgggggagcacaggcctctccttaaagggcagaaggacagggttggaagtgggaacatttagagggggtgtttaagctccagtgttctcaggcttttgttatctccaggtgtgtcgaacgaacttagttcagtctgagagggtttccggtggagagtggcccttgcgagagtctttctaacagtctttcgacagcctcagtctcagaggaaaagtgcgccgcgcgtaagacatcagtgttaaaggggacttaccagttcttcacacatgatgtttccacacactcttacaagccacactggggtcacaactgtcttcctaaaggcggggcttgtcgactaacccgacgcgctaatgaaaaacccggtgggccctatagtattatatttatccacgctgcccccatatagtgatctgggggagcattccaactttgtcggcaggcagccaagtagttaattgggcgacaaacaaagcacactatcttcagcgccgtagcttacgacactcgagcgggctcttggcggggtatctatcaacactttcccgaagccatgttcttaaaattattgggaccacctgagtcattaactcggaacatgtcggacatttaacagcaactttcgtctgagcaaaaagactaggtttcgcaacgtgggacagacaaggcggcgcataataacagcggctataactaggctagagaccgcgggacagaaacgacaacttactgctgggcgaaatctactacttgacaccttgtcgacacgaatttggcggcgcaggcaacaaggaactgctaataaaaaaatctggcacagaagtaccgggtgcctcgtctatccagtaaacaggtgtaactacccccatctgaaaggggggtcccccccacaaag

SEQ ID NO: 708748 - DNA, 200 bp, Homo sapiens
  misc_feature (40)..(40): n is a, c, g, or t
  misc_feature (81)..(81): n is a, c, g, or t
  misc_feature (101)..(101): n is a, c, g, or t
  misc_feature (131)..(131): n is a, c, g, or t
  misc_feature (172)..(172): n is a, c, g, or t
  misc_feature (191)..(191): n is a, c, g, or t
gtaaaaaggacatgacttttgggggttcaggagccaaatnctgtggtctgagtgtttgttttcccctaaaattcatatgtngaaacttgatccccaacatngtggggcctttgggaagtgattaggctgtnaggattccactctcaagaatggggttagcgcccttatgaangaggcctgagggacgggtnttgcccctg

SEQ ID NO: 708749 - DNA, 392 bp, Homo sapiens
tggctgtactcggctgagatatcagtggttggtgaacacgctatgcctgaagcatgcgcactaaagtggtttcgggacaacgcagtacctgggtgcccctagttcccagaacccagcaattcctacaccaccaccatcaacccgctccttgaacgaaagggctgagacaccacctctgccgatccctccaaccccaccggatatacaacctctggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaacagccat

SEQ ID NO: 708750 - DNA, 760 bp, Homo sapiens
gagcagacgagactcgagaaacctgctttgatggatgtatgagactcgtgcacatgagcacttttaatgccgaaggtcgagactgcacctgttgcagtcaagggcggtgtgatccagcatgaggcctcttataattgaaacctacgttatatcgaacgtgatgctaatttaccgagcccgggagattatggagacctatcaggattcacgatgacactctctagcacatactttcatacacatatatgtttgacactgatacacagatcgacagctctctatgttgtatatacagagaggtgatcacggactcgttacctgcggggcgcatgttagatgttgtccacactgcaagtcacctactgtggtggacttgagctgagaagagcatgtcgctactcttagactgtctgtgaatacgacgagaagacatattctcgcatgagcctttcctcgtatcacatggaggagcgagagtgctctcactgggagcagactgtgcactggccaccaatggtggcctagtttacccagcattgtgagctatgacaggatgagacattctctgagcctatctacacacgccatagcagcagctttatgcctgcaggttcttgatgaggtgattcgctctgagcacctgatcgtggcgcacaggacactgctgagctgtgggatagccttcacagctgagccgcactcaagacatggtgcggtgtatatgctgatccagattgcgtaggtacaccacagcactggc

SEQ ID NO: 708751 - DNA, 502 bp, Homo sapiens
cttcacgcccagatgcatttgcagctatgcggtcctcccgcctcccgcttcaggcctctcccatctcccctgggtttccacacagtgtcgcagcttcacctcgagagggccacgtgattggcggcactggggatgcctgagcccttgatccctctgctggggtccagggcgtgggtgtgcatccctggagcgtgtgtgctctgggcgtgggtgtgcgtccccggagcgcgtgtgctctgggcgtgggtgtgcatccccggagcgtgtgtgctctaggcgtgggtgtgcgtccccggagcgtgtgtgctctggccttccctgcccagctcctatggctcctcctttccctaggttgggcagaatctcccaggtgtgctgctgatggacaggctgagagcgtggagcccacgagggcgctttggtttagaatcatctcattggtttgcccacgttaagctcctataaaatctaggggaaaaaaaataaacatctttttgggttc

SEQ ID NO: 708752 - DNA, 942 bp, Homo sapiens
gacaggtgggcatgtggacatcccatgcagcacaaccccaatggacccccagcaccttggatgcagcacactcaccaccgatgaaccagggcccccaacctcgcatgggcaccatggcactcctccaatggtaactgggaaggtacagcatgaagaggctcatgggagtcaaatcgccgagcagtcacggaaaaaggtatgactgccgccaccacctagtgggcactgatgcacggcgacagagacgacgccatcccaagatggcgcagccacggaaaaacgcacacagacacgaggagcgacgaggagcagcagagaaacagcagacggagaggcagccggcagaacaacaacgcgcagcaaccgcgcgacgagaaagaagaagcgaaggacgacagggaaagacagagacacgggccacacgcagagcagggcgagagagagcacgaaagagaacacgaaagagcgagacacagaagcaaggggcggacgaagacagcaacagagaaaaaggggagcgagaagaccggacaaccaacagagagcgagacgaagccacgccggacagacagcgagagacgaggaacagacgacagcacgagaggagaaggagagagagaggacagaagcgacagcagaggaggaggagcagagacagagacggagaggagccagcgaagagacgagagcagggacggaacgaaggagaaggaagacgagacggaagaggcggcagagaagaggcacggggaagacgcgccagggcagggcgagcgaggagacagaggggcgacaagaggcggagagcagagcgcaggagcgacgaagagagaaacggagacagcggagcggcgagcagcaggcggcaaagcgcagagcggacagcgaccgagggcacgggggcgaccgagaaggcagaggacggcaacggagaagacgaga

SEQ ID NO: 708753 - DNA, 539 bp, Homo sapiens
  misc_feature (219)..(219): n is a, c, g, or t
aaaaaagcttcatggggtgctggtttagtttacaataatagaaaccttttggaggtgccaaaacttcaactgctgcggtggggcctccacagaaggttttgcgtgggagttggtggatattgtggtaaccagcagagtgcctatgtgaaggtctccagggagcgtgttcctcatgagaggtccaacccatcctttattatacaagtacctgctcatccncggcggctcatgaaggagtactctccaatttggaggttcatgtcaggcggcttcctacctcatgataatagcagttcaatgtgcattttgtgtatcaagtgcttgcatggaaggatccgattgggtacctgtgcaggttgatggtcagttgtcgtcccaactacttggcattctttgtttgaattatggcatgcattccatcgacatcgctttgtgttatatgacctttcccccagtactgtacagcatgtcttgcattaatagccctctgtctcagatctatatgtatgagtgtataaatgatttaataaataagcctt

SEQ ID NO: 708754 - DNA, 404 bp, Homo sapiens
catgagacaacactggggaagaccccgtactctactaaaaatacaaaaatcactagggtagtgatagagagggcaccatagataatccctgatatacaggagagcatgaggcaagaagaactgcttgaacccaggaggcagaggttgcagtgagccgagatcacaccactgcactgcgggcctgggcaaatggagcaagactccatcttaaataaataaataaaattctactgatgataaacatttgagtagatacctgataataactatcatatacttatatgatgtctttaggtggctgtcacacaatacactgctatcagagacaaagtcaggaatgttaatggtgggtcactgagtacacggtacgtatgtttagcttaacagacactgccagaacggtt

SEQ ID NO: 708755 - DNA, 144 bp, Homo sapiens
tactgtgaccttctgaatcctgcagtgtttgagttgcagagcggtgagtctcttgcccgggtggcgagtgaggcacctcttcggtggtgctacaggcctcggcagcattatcgtacatatgagtagcctcgattatgttctttt

SEQ ID NO: 708756 - DNA, 152 bp, Homo sapiens
tcgccggaactcgtacatgtgaaggcatgcccctgcaatgctgaatacacgtcgaccaggctccatccaaacgatctgtggacgtcaacacggtgctcacgtgtcgacggaacttgtcccaggaaggcatgcaccgacagtggtgaatacac

SEQ ID NO: 708757 - DNA, 295 bp, Homo sapiens
  misc_feature (288)..(288): n is a, c, g, or t
atttcgaggagctgtctgtgtgtctgaacaaaaatgggagctgggccaggccggacggtggtctctgggcaggtcccgcggtgctcagatgccctggtcacaggtgccgggaacgggagaagcagcagcattggatgtggtggtggcagtggctctggagaaggacctgggtgggaggtgggggtttgggtggtgacgtggtggtggcagtagctctggagaaggacctgggcgggaggtgggggtttgggtggtgacgtggtggtggcagtggctctgggagaaggncctgggt

SEQ ID NO: 708758 - DNA, 221 bp, Homo sapiens
ggttcaatagcatccacactctgcaactttgggttcaaagtatagattatgtcatcagtatgtggtgcctgtattcttacatattgataatacatatatagacgggcttatcacttaatgttccattggttcatcagcctcttctgcaggttcatcagcaggttgagcaggctgtgcctttctctgtggtctttcttcgagaccttccaggaatggagacg

SEQ ID NO: 708759 - DNA, 271 bp, Homo sapiens
ctacaaataatcattcagctggaacattcattatagacttggcatataatcattccttaagagaggtcggcggtcatgtgcggtacaaatggagactagggaagtagtgtaagtcctgggatggaaaggagtggataagtccctgatagatactcccacccccaccatttcctcataacctccgattactccgattactttctacgtgtgtgtgtgtagtagtgtgtgtgtgtgtgtgtgtgtgtgtgtgtacaacaataagtaactaata

SEQ ID NO: 708760 - DNA, 119 bp, Homo sapiens
tctgaactcctgactgtgatctgccaaagtgctgggatatagacgtgagcaccatgcctggccagtatgaagttaaaacaggatctttacctttgtcagtctagtttgagaaatatcac

SEQ ID NO: 708761 - DNA, 519 bp, Homo sapiens
gttataagggcagatacagtgggagatctgggattcatgttcatctaagtggactccaggaaggacagataaatacctctagttagcaacggttaaaatgggagctaataccaactattaattcccagttgggatcttctctttctctcaggactactttaagtccccaaaattccatgcttccaatttccccttctacaactgaagatcctatgattgaaatcataaaagattagctatattgggacactggccttgtattagtttgacagaaaattctgaaaagatctccccatgccaaaaaggtctttctcagacttggggtggagacctaaaattccaccactagaaattttaatattgagagtaatgctgtgtcccttactgacaaattcaatttcaaaacacagtagaattaaatcgacataaaaataaatgtattagataaatataatttttaagtatttgtgggccaaagatcaggagggaatatagaaatgtcatttgtggcgtgaaggt

SEQ ID NO: 708762 - DNA, 175 bp, Homo sapiens
ggaatctcatgtgtcagccagggagccgtgctggaagtttatccaggatctcgacaactgctcagtgatggccgtggagtgcgagagccggcgctactgcttccagatcaccacgccaatggaaaatcgggaataatcctccaggctgagagcagaaaggaaaatgaagagtgga

SEQ ID NO: 708763 - DNA, 523 bp, Homo sapiens
tcgccaatgatatacatcactgtctctgctgatggacacgagtacgggtcaagagaacaacgattactatcactaatgacaagggtaaggaggcactgtcatctggtcttgactgggataatagtatttcaattgagttactggtgcctaagggcgtctagctaagagaaactagagttacacatacacaggtaatttaaggcttttacttagagttaatttctttcctaggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcaggtatgtgtatatatttttttttatttcctcccccactcaatggaggggaaggggatggt

SEQ ID NO: 708764 - DNA, 141 bp, Homo sapiens
ttttccttgttgggtttccggggccgttccctcccccccccccgggttttaaaccgtgtggttccccttggggcccttttttgggggaccccccctttccctttaaaggttttttggtccctaaaggccgtgggtttccca

SEQ ID NO: 708765 - DNA, 1259 bp, Homo sapiens
  misc_feature (351)..(351): n is a, c, g, or t
  misc_feature (436)..(436): n is a, c, g, or t
ggttcctcctcctccgtccacctccggacattgcggaggtgaatcacttgtcactcgtactcggacgagtcagagatggatgcgcaggcagagtagggtcgcagtctcaatgtaagcttccagacacgttgctatcgtacatgcacgagccaaaggtcgacccatgttgctgtatcgtagagcattgttgctgcagtacgtgctcacattagacctacactggtgcgtacaagtagaacgcttgcatgtagcatagatcaacgcgcataagaggtttcgtttggcaccattgaatccatgtaggtaggcacaacgcaggaggagaacgtgtgtgcgcttaccattgggttngctaagccacgcatttggctacagcatcggtgatcgatcgattgggatcattgacaatgctgtcccgacaggtctcttggtgagnccgactatctagtcgcgcgcatgttgtcactggtaccattcggccgctttgcgatgtcgcacagccatcgaaatagtacgatagtatacagtgagccagatgagcctccgatagtacgtggcacgaggtctatggtgtcgcgagacgatcctcaagaaatgcgagggccatgaattgcattgcctcgcttgccgcggagcacccgtccgatccacccgttgagagggggcctatcatgctaacgcagttgttgagtgcaattgtgtagggcgcgatgagcaacatcggacacgtcctatagagcgtggcgtgcgtcagggtagctaggttcgtcagacgagaacgttgtatccattggttgttgcggaactgttaggacgagcgtagggggtgcagtgcccattgcttgtacactgggggcgcccaggaacgggttgccacctctaggacgacgaatctacaagttgttggacttgggactgcctgatgattgggaagtgccttcaattttgtgtagccttcctggctcgtgaacgagagcgcaggtgcgccattcaatcgtaggccccctgcgaaatgggcacgtgatcgagtaagcttgagacacggcactccgcttccccccacggaagggtgggaaccccagggaccctgttgtcggtgcccgtctggttgcaggatgctccggacgcggggcacgaataccctgtgacccagcgggggctttaccagcgcgggcaattgaagttgaagccggcatgggtgggcggcctgttgggaccacccaaaagcaaccttgggagggaacccccctggtaacccg

SEQ ID NO: 708766 - DNA, 370 bp, Homo sapiens
tggtttactgaacttctcagtttctccatctgtaaaatgagaattctagcaactcgtagggtatttgtgagatgttgcatgcaaagcccccagcaccatgcctgtcctagcttaagcacccaccaggtgtcgataagtaattgttcttccctggactgcctgcacatctagggcaccccaggaagagtcaccgcactctgtttcggggctcggctctctgaggggagggcatcctgtatggggaggagggtctggaccagagctgtccctgatcgctagaatcaacggcagaattcttgttattttaataataattaataatttagtgcttccactaaataaaaatcattggaatggtgaaaaaaaaaaa

SEQ ID NO: 708767 - DNA, 923 bp, Homo sapiens
agctgaaggccaaggagggagaggaggcaggtcctggggaccattactggaagctgttcccaagactgggcgatgagaaggatgtcagtgtgtgacctgcccagactaccgacgcagctgcttccaggcccctatttgccccgttttcagactcacagatagatgccatctcgcccgctcctgacgttcctctacttgcgctgttctggccagcctggggggcccgcccagccctccctggcctctccactgctctccactctccagcgcccattcaacgtctctgcttctgacgtcacgcgggcttccactgccctgcacgacccccccatccagcatcatgcccaaagcccccggcgcagtcccgccgcacacggcaacaaagtcacccaggcccgcctcttacacaggcagctcgggcgaaggcctccaccaaaccaaggccgacacgcgcctctcccgctacaccttggggccccctgtctctccaactcgctaccctcctgcctgctctcgtgtcctccctactccaggccaacccaacccacctgactcctcccacatcacaagaattcaccagacatgctcccaacacaaccccacacacacaccacccaccacaaggaccacccagaaacaaatctaaccacaaaagccacacacaaaccataccaacaaagacaacacaacaggcaaaccgactacaaacacaaaccagagccaagggaagacgaggacagcgcgaagggaggagcgggagaggacacggagcacggaatataacaggcgtacagacgggctgccggcgcccgcgccggaattaacacccagaaagcggaagcggagaagagacggaacaagcgggggcagcgcgccactgggaagccggcaggacagggaacaaggacgggaggagggctgaa

SEQ ID NO: 708768 - DNA, 1247 bp, Homo sapiens
  misc_feature (782)..(782): n is a, c, g, or t
  misc_feature (833)..(833): n is a, c, g, or t
  misc_feature (1112)..(1112): n is a, c, g, or t
agcggggggaatgcgaagtagcgtcaggcgcgaggcggctggtggacccgtcggggcggacgggacgcagaatatgtccgctctgactctggaatgagcagtcatttcgcatcacggtttggatggcctgtccatttgtcacgaatgctggtgtgcagcacggacgtgttggatgataggtgagagatccgtcatgcctgttggtgtgtgtgcactaagttgatgccccagttgtatagacaggttcttccccagtgtgaccacgatcccgaggatgtgtccagaggcgagttcttacaggcgtgacttcagtgattgtgtctctgggattgcgtcgtgtgacgtcttgtttcgcggcaatggatctgcgaagaataggagggtcgcttgggcggtacatcgtatatcacggattatttcctgtgatttccttgtcgcgcattgctggtacacgaatggagatggaaatattaccgtgataataccccattcacatggaattgaattgcaaagaacgtcgataagggtggttatgatcgtacaatgaaccctacgaacgtccattggtgatcgagaagtagggctcgagggattgaaagaaacttttccaatacgtgaatttattaataccgaacattgtgccagtgaatattggcgaaccgactttaaaacaagatttaccgataaattgttaagaggatggggttgtggggttccccgacaaatatatagatatataaaacattgagacacttcactctggaagcgcagacttgtgaggnaatcaccgggtggcttcacacattaggggggtccacgtaggcattccactntttcaagtgagggagggtgcgggccaccccggtgtttggctccgagcgcctttgttctgtaggtttgtccaccctgtttaaagcaatgcggggaggtgtcttctaagggtctcttggggaaagcttgctgttggggaggggaaataaccctttcacaggggggttccatttgagatgcgtaggcatattgtgcgccgtagtgtgcgtgttgtcaccggacctgtggagttttacccccgctgtgtttttcaaaacaacaagtttgcggcagccactatntattgtgcacagagcagacagcaaaagaaaacccggtttgctgagaagagaggtttgtgggagactatttcaacaggagaggcccccaacaagggggggacacaagagttgtgggccattacgcgggtggggaaa

SEQ ID NO: 708769 - DNA, 136 bp, Homo sapiens
ccggtggcttcccggtgccccttacactccatcgagtcccggtcgcggcatgtcccagaaacaagaagaagagaaccctgcggaggagaccggcgaggagaagcaggacacgcaggagaaagaaggtattctgcct

SEQ ID NO: 708770 - DNA, 206 bp, Homo sapiens
ctaatcacattagccttatgcaatgactgggggatgtggagggttgcagtgttcctgcaggtactgctgatcccactaggaagagctccttcaggactggaattttttatgcttttcttcattgctgtatctccgatgactacaaatgtgccagacattagtaggtgctcagttaatatttgctgaatgaatggtattgaatagtc

SEQ ID NO: 708771 - DNA, 511 bp, Homo sapiens
  misc_feature (1)..(1): n is a, c, g, or t
  misc_feature (67)..(67): n is a, c, g, or t
  misc_feature (94)..(94): n is a, c, g, or t
  misc_feature (151)..(151): n is a, c, g, or t
  misc_feature (153)..(153): n is a, c, g, or t
  misc_feature (168)..(168): n is a, c, g, or t
  misc_feature (190)..(190): n is a, c, g, or t
  misc_feature (234)..(234): n is a, c, g, or t
  misc_feature (236)..(236): n is a, c, g, or t
  misc_feature (238)..(238): n is a, c, g, or t
  misc_feature (242)..(242): n is a, c, g, or t
  misc_feature (248)..(248): n is a, c, g, or t
  misc_feature (250)..(250): n is a, c, g, or t
  misc_feature (255)..(255): n is a, c, g, or t
  misc_feature (259)..(259): n is a, c, g, or t
  misc_feature (261)..(261): n is a, c, g, or t
  misc_feature (304)..(304): n is a, c, g, or t
  misc_feature (326)..(326): n is a, c, g, or t
  misc_feature (336)..(336): n is a, c, g, or t
  misc_feature (351)..(351): n is a, c, g, or t
  misc_feature (353)..(353): n is a, c, g, or t
  misc_feature (359)..(359): n is a, c, g, or t
  misc_feature (364)..(364): n is a, c, g, or t
  misc_feature (389)..(389): n is a, c, g, or t
  misc_feature (511)..(511): n is a, c, g, or t
natggctcaagaataggaataagaaaaatgtgcagtagacgctgtttgtccgacgatgatgaaagtntgcacggccggctgtcctccgattgangggccttgtcaaggcctcagaggcagcgaggtcacagcctggtggagggtctgggtntncgctgtgtccatctncacctcacagacaccagttatngggggatgaaaccgggccaagaacacatgtgtgcacaggctgtntntncctncatgtntnggatncgtntnggctgtggcggcgggtggcagatgagggataggacagaaaatngcccatccaaccccacatcctngccgggcgtntccaggtcccttttntnctattnttttncttccccatacgtgacagggacttngctctgagggtcaggacctggctgggaacacaccattgaagagggaacagaaaccaggccctgggacgctagagaccccaagagctacctggctgggtctatggtcagggcctgtagtgggn

SEQ ID NO: 708772 - DNA, 1020 bp, Homo sapiens
tcgtcggtgctttccttgcttcaacagtggcttggacggagacccggctggctcgtgtccccagccccggccggccgcccataggcagccctccgtcagctcttcaccgcgcccttcggactgctccctaagggggccctctcgcactgtcggcttccgagtcggccgtggcagccaaccgccgaccgccgtcgcctctccttagtcgtccgccgatgaacgagccgggtccacctcgcaggtgctccaggaatctaccactcaggtagtcagaggccggcatcaacgcgagcgagcaatcgagaaccctggaggctccttacgggccatccgtaacgttgtaccgtgtacgcagtgctgcttaacctacccttttggaccgcggcgaaatgcactgttgggcgtatgtgcacaccgaaaccttgtgtgccccaaaagtacctgtgtacgttacaaccgaatacgtcactgaaggaacgtaggcggcaacgagtggcgtgtagaagagcttggagtgcacacgtctgctaggacaccaaacggaagggtggtccggagagtcgtatccctatacagggagtagtcagaggaaaacccagacctggtgcactggaactgggtgcagagtcaggaaccttgacactggccacaatgtggaggtgttgtcactttacaactcttgcgcaatacacccatttgttgagacttccaaggtccaccttaccctgggaaaccttggccacaaagaactagtgtccacgttgtaccattaaatagtggacctcgcccattttgttgttggactttcccttcgcaggacacatttagcttgaattggaagcagggttgaaaatgccatccaaagacatttggtgcttggcacctcggttggacccaagtttggtcgccagatgggaaggcgcggaactcgggttggggggaaaatttctttgggacaggcacgctgggagcagcgtgtcatgaagaagggcgggcgcaaacccaacgcggggggcaccg

SEQ ID NO: 708773 - DNA, 233 bp, Homo sapiens
  misc_feature (149)..(149): n is a, c, g, or t
  misc_feature (164)..(164): n is a, c, g, or t
  misc_feature (183)..(183): n is a, c, g, or t
  misc_feature (205)..(205): n is a, c, g, or t
  misc_feature (216)..(216): n is a, c, g, or t
ctagaggatcccatccccggttctgggtacagagccaaggaagcatctcctcctgccaaagatggccacagagcctcacggagcaaggaaaggggtccagaaacccctgggaatcctattccaggctgcctctggatgggggacactanaaaatgtctttcctngtggtttggaagtttctanaaccttaagcagttgtccccangtgtctattanaaaactcgcaagagcta

SEQ ID NO: 708774 - DNA, 238 bp, Homo sapiens
gggacacttgattacctacctcagtgtacactcaactatgggttgtatcagtttgtgtatgtgcaaatgtcaaataatctttggctttaatggctactgtactggcttggaaagattacctactattttatgataaaatgtagttgtctccagtagcttaaatataattggtaaagcactgggtttaaattttctctcatacctataaacagtatagcagttaaggcgtttctagtta

SEQ ID NO: 708775 - DNA, 5541 bp, Homo sapiens
  misc_feature (347)..(347): n is a, c, g, or t
agcgggatcactgaaggagccgagttcgctgctgcggggcctgccctggccggggtgggaggtcgcccggcccttcccccgagagcctagcctcgggctcctcagcggcgttgcctgcgcccgctctgagcgccattacttcatcactttaaagttgatggaagaacttcatttttaatttcatcacggaaactgtggagtaaagacttgtattatccctgttttacaggagaacaaacggagtcttactctctctcccggtctggagtgcagtggcgtgatctcggctcaatgtaacctccactctccgggttcaaggggttctcctgcctcagcctcccaagtanctaggaccatcagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccaggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaagttccctactgaaggaacagatgctaaggaaacaggccgagttagaatcagcacagtgccgactccaactgcaggtcctcactgataagtgcactaggcttcaaaggcgtgttcaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaaacaaaccaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgtaaaaaaaaaaaaaaaaaaaaaaaaaaataaaaaaacaaaaaaaaaaaagaatccttttttcaaaaaaaaaaaaaaaaaaaaaaataaaacccttgtgggccgcttgggccaagtcaattttagactggggaaggtttatccttgcggccgaatttggggctaattggcccatttccccttatggggggcggtttaacatttaattgcccggggtttcaaaacgtggggactggaaaacccttggggtaccaactttattggcttggaaaaaatccccttttggcagggtgggtaaaagaaaaaggcccccaccggtcgcccttcc

SEQ ID NO: 708776 - DNA, 782 bp, Homo sapiens
  misc_feature (62)..(62): n is a, c, g, or t
  misc_feature (104)..(104): n is a, c, g, or t
  misc_feature (107)..(107): n is a, c, g, or t
cattcggggtgggcgctctttctttttctcttagaagagggtttagcacaggttttttcgtnctcacttccacaccacctaccgcctcccaccccccctctccnccnaccccacctatcgtcatgacggcctctccggattacttgagctgcgtgctttttgggatcactgctggggccaccggagtccaacgctaggctcggatgagaaggacttgatcctgctgtactgcacacagtcgcgcctctggccaacaacgacggtgggacagttgcacgaagctgctagttacgaccgcgaatcagtcggaactgatcggagagactgctcaccaaggaaacctaccacatagacgtcgaaatgcctgtcctcggcgtcgcagctggacctaagccctccgacaggtttaaccagtcagtgagcaatgaactgaatcattggactagggacttccttctgtctctgtacctgatgggcagcttcatgtcaggcaagtcctgcatcctgcggcttccaagaacaatgtcctattacctgaactgctctatgccttccgggatcttcgacaaagcaattcacgacactgtcgccctggtgtcaccttgatattgcccaaccttggactgttgccacagggacggaagtatctacacattttgacgcaggagtcgttcgagcctctcagattgggtcgcctctcacgttgaatgattggggcactctcatggttaccagcatgattcagagccctctataatccccggttccagttcatagaacgt

SEQ ID NO: 708777 - DNA, 5491 bp, Homo sapiens
  misc_feature (347)..(347): n is a, c, g, or t
agcgggatcactgaaggagccgagttcgctgctgcggggcctgccctggccggggtgggaggtcgcccggcccttcccccgagagcctagcctcgggctcctcagcggcgttgcctgcgcccgctctgagcgccattacttcatcactttaaagttgatggaagaacttcatttttaatttcatcacggaaactgtggagtaaagacttgtattatccctgttttacaggagaacaaacggagtcttactctctctcccggtctggagtgcagtggcgtgatctcggctcaatgtaacctccactctccgggttcaaggggttctcctgcctcagcctcccaagtanctaggaccatcagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccaggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaagttccctactgaaggaacagatgctaaggaaacaggccgagttagaatcagcacagtgccgactccaactgcaggtcctcactgataagtgcactaggcttcaaaggcgtgttcaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaaacaaaccaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgtaaaaaaaaaaaaaaaaaaaaaaaaaaataaaaaaacaaaaaaaaaaaagaatccttttttcaaaaaaaaaaaaaaaaaaaaaaataaaacccttgtgggccgcttgggccaagtcaattttagactggggaaggtttatccttgcggccgaatttggggctaattggcccatttccccttatggggggcggtttaacatttaattgcccggggtttcaaaacgtggggactggaaaacccttggggtaccaactttattggcttggaaaaaatccccttttggcagggtgggtaaaagaaaaaggcccccaccggtcgcccttcc

SEQ ID NO: 708778 - DNA, 173 bp, Homo sapiens
atccgccttcctcggcctcccaaagtgctaggattacaggcctgggtcaccgtgcctggcctgtttttgtttttgacaggagtgagttcctatctcaaaaagaaaatgataacagtaattttcatattgattacatgttaaaagaataatagttttgacataattgggttaaa

SEQ ID NO: 708779 - DNA, 5211 bp, Homo sapiens
  misc_feature (347)..(347): n is a, c, g, or t
agcgggatcactgaaggagccgagttcgctgctgcggggcctgccctggccggggtgggaggtcgcccggcccttcccccgagagcctagcctcgggctcctcagcggcgttgcctgcgcccgctctgagcgccattacttcatcactttaaagttgatggaagaacttcatttttaatttcatcacggaaactgtggagtaaagacttgtattatccctgttttacaggagaacaaacggagtcttactctctctcccggtctggagtgcagtggcgtgatctcggctcaatgtaacctccactctccgggttcaaggggttctcctgcctcagcctcccaagtanctaggaccatcagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccaggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaagttccctactgaaggaacagatgctaaggaaacaggccgagttagaatcagcacagtgccgactccaactgcaggtcctcactgataagtgcactaggcttcaaaggcgtgttcaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaaacaaaccaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatggacattgctctgcctgtttataatgttttcatggaaaaatctcctacgtggtaacagtacaactacgattccc

SEQ ID NO: 708780 - DNA, 98 bp, Homo sapiens
gcgggagcagctacatgctctgcgtgctgcggtgcaggctctgcaggctctgcaggaacgactccttggccttcacctcctccatggtggacaccccc

SEQ ID NO: 708781 - DNA, 5194 bp, Homo sapiens
  misc_feature (347)..(347): n is a, c, g, or t
agcgggatcactgaaggagccgagttcgctgctgcggggcctgccctggccggggtgggaggtcgcccggcccttcccccgagagcctagcctcgggctcctcagcggcgttgcctgcgcccgctctgagcgccattacttcatcactttaaagttgatggaagaacttcatttttaatttcatcacggaaactgtggagtaaagacttgtattatccctgttttacaggagaacaaacggagtcttactctctctcccggtctggagtgcagtggcgtgatctcggctcaatgtaacctccactctccgggttcaaggggttctcctgcctcagcctcccaagtanctaggaccatcagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccaggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaaacaaaccaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgtaaaaaaaaaaaaaaaaaaaaaaaaaaataaaaaaacaaaaaaaaaaaagaatccttttttcaaaaaaaaaaaaaaaaaaaaaaataaaacccttgtgggccgcttgggccaagtcaattttagactggggaaggtttatccttgcggccgaatttggggctaattggcccatttccccttatggggggcggtttaacatttaattgcccggggtttcaaaacgtggggactggaaaacccttggggtaccaactttattggcttggaaaaaatccccttttggcagggtgggtaaaagaaaaaggcccccaccggtcgcccttcc

SEQ ID NO: 708782 - DNA, 4244 bp, Homo sapiens
  misc_feature (347)..(347): n is a, c, g, or t
agcgggatcactgaaggagccgagttcgctgctgcggggcctgccctggccggggtgggaggtcgcccggcccttcccccgagagcctagcctcgggctcctcagcggcgttgcctgcgcccgctctgagcgccattacttcatcactttaaagttgatggaagaacttcatttttaatttcatcacggaaactgtggagtaaagacttgtattatccctgttttacaggagaacaaacggagtcttactctctctcccggtctggagtgcagtggcgtgatctcggctcaatgtaacctccactctccgggttcaaggggttctcctgcctcagcctcccaagtanctaggaccatcagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccaggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaagttccctactgaaggaacagatgctaaggaaacaggccgagttagaatcagcacagtgccgactccaactgcaggtcctcactgataagtgcactaggcttcaaaggcgtgttcaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggctcctgctcaagcatctccaccagctctaagtgcaatataggctgccactgaccgtc

SEQ ID NO: 708783 - DNA, 3904 bp, Homo sapiens
tttcccctcagaatcccaaagtgctgggattacaggcatgagccaccatgtccagcctttttaatttattattttatttccttagaactcaagaggaaaacctgtggcccccaaaacaaatgttatggaatttaaaggagttacctgggcagattctagaaaaaatagggaatccagatagtttgggtgtatgagtgtgttctcagtaaggattaatgatcatttaaatgataatctttacatctttgtcatgtatttgattttcttaatgcagttgtaaaagtcttttgtaactccacagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaaacaaaccaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgtaaaaaaaaaaaaaaaaaaaaaaaaaaataaaaaaacaaaaaaaaaaaagaatccttttttcaaaaaaaaaaaaaaaaaaaaaaataaaacccttgtgggccgcttgggccaagtcaattttagactggggaaggtttatccttgcggccgaatttggggctaattggcccatttccccttatggggggcggtttaacatttaattgcccggggtttcaaaacgtggggactggaaaacccttggggtaccaactttattggcttggaaaaaatccccttttggcagggtgggtaaaagaaaaaggcccccaccggtcgcccttcc

SEQ ID NO: 708784 - DNA, 3748 bp, Homo sapiens
  misc_feature (347)..(347): n is a, c, g, or t
agcgggatcactgaaggagccgagttcgctgctgcggggcctgccctggccggggtgggaggtcgcccggcccttcccccgagagcctagcctcgggctcctcagcggcgttgcctgcgcccgctctgagcgccattacttcatcactttaaagttgatggaagaacttcatttttaatttcatcacggaaactgtggagtaaagacttgtattatccctgttttacaggagaacaaacggagtcttactctctctcccggtctggagtgcagtggcgtgatctcggctcaatgtaacctccactctccgggttcaaggggttctcctgcctcagcctcccaagtanctaggaccatcagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccaggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaagttccctactgaaggaacagatgctaaggaaacaggccgagttagaatcagcacagtgccgactccaactgcaggtcctcactgataagtgcactaggcttcaaaggcgtgttcaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaaacaaaccaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgtaaaaaaaaaaaaaaaaaaaaaaaaaaataaaaaaacaaaaaaaaaaaagaatccttttttcaaaaaaaaaaaaaaaaaaaaaaataaaacccttgtgggccgcttgggccaagtcaattttagactggggaaggtttatccttgcggccgaatttggggctaattggcccatttccccttatggggggcggtttaacatttaattgcccggggtttcaaaacgtggggactggaaaacccttggggtaccaactttattggcttggaaaaaatccccttttggcagggtgggtaaaagaaaaaggcccccaccggtcgcccttcc

SEQ ID NO: 708785 - DNA, 780 bp, Homo sapiens
gtacacctggctaatttttgtgttttttgtagagacagggtttcaccatgttgcccatgctggtctctaactcctgagctcaaggaatccacccacctcggcctcccaaagtgctgggattacaggcatgagccaccacactggactgctgtgtcaaagttttgcatctttttttttttttttcccaaaaggagttttcactttgtgtcacccaggctgtggagttgcaggggagtgtgactcatgtggctctcactgtgaaaccttccgccctcccaggtttcaaggattttcttccgtgccttcagccttccttgagttagcttgctttacagggcacctgtgccaccacgcctttgcaaatttttggtatttttaaggggaaaagggggtttggccattgttgggccaggctgggctctcaaacctcctgtgacctcagggtgactccgcccgccttcagccttcccaaggggcggggatttaacgggcgtgagccatgtgtgccgggccccaagtttggctctctttaaaggccctcgttgaacaattacttagagaaacttctcagaacatttaaacccgtgcagagcaaccaggtgtcccccatgtctaaggttcacaagttggcctctaaatttctaattccatattttcctactcctcaagataatcatgtggtgggtactcttcctaaagagtcaaagacgacttttaagtggctacaattttttggtccgtgcttaaaccaaaaacttcattttccctttactcaatttg

SEQ ID NO: 708786 - DNA, 642 bp, Homo sapiens
gcaatctgttctttgggggcccccggctcccttcgcgcctcttgatgcccctgtgccaccgggacggacgcgatagatcttgtgcgccgcttggtgagtgagtcgcccccgcccctgtttttcctcctccaccacgtagcaacgagccctcttgtgtggggtgaagaacagagggagtggtggggtgcctctcccttcggtgctgttatttgtcgtctttttgttctttgttgctttggttgtataaattccacttctgggagttccactcagaaggcgcgctggggctttcttgggccaactggttgccccctgttggcgcctccccgacctcattcccttggtgttggtggccctcgttgcctagtagccccttggccctggcgcaaccacccccgccacacgatgctggggagccacgccccccttgtcgcttgcctagctgtttcttcgcccgccaacccccttatgagttgggaggggaaagaacgaaggaagaaggggagaggggatcctgcccccctccccccggcatttgtggggggcccctccccccacggggttttccccttcctcggggtttttcccccaaaccattttttaaatccaacccggattaatacccaattttaaatggcaaca

SEQ ID NO: 708787 - DNA, 1349 bp, Homo sapiens
ctcttccagaaccagcttgcctagcggctgacgctctaagtgccgactctacgcgtagcgcctggttccggccgctatcagcctacgtcgtccgtggcccctacgtcctcagacccgtggaaacacaggctctttcggtcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaaacaaaccaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgtaaaaaaaaaaaaaaaaaaaaaaaaaaataaaaaaacaaaaaaaaaaaagaatccttttttcaaaaaaaaaaaaaaaaaaaaaaataaaacccttgtgggccgcttgggccaagtcaattttagactggggaaggtttatccttgcggccgaatttggggctaattggcccatttccccttatggggggcggtttaacatttaattgcccggggtttcaaaacgtggggactggaaaacccttggggtaccaactttattggcttggaaaaaatccccttttggcagggtgggtaaaagaaaaaggcccccaccggtcgcccttcc

SEQ ID NO: 708788 - DNA, 298 bp, Homo sapiens
  misc_feature (18)..(18): n is a, c, g, or t
  misc_feature (22)..(22): n is a, c, g, or t
  misc_feature (25)..(25): n is a, c, g, or t
  misc_feature (28)..(28): n is a, c, g, or t
  misc_feature (33)..(33): n is a, c, g, or t
  misc_feature (52)..(52): n is a, c, g, or t
  misc_feature (56)..(56): n is a, c, g, or t
  misc_feature (71)..(71): n is a, c, g, or t
  misc_feature (76)..(76): n is a, c, g, or t
  misc_feature (78)..(78): n is a, c, g, or t
  misc_feature (88)..(88): n is a, c, g, or t
  misc_feature (95)..(96): n is a, c, g, or t
  misc_feature (177)..(177): n is a, c, g, or t
  misc_feature (192)..(193): n is a, c, g, or t
  misc_feature (196)..(196): n is a, c, g, or t
  misc_feature (205)..(205): n is a, c, g, or t
  misc_feature (235)..(235): n is a, c, g, or t
  misc_feature (260)..(260): n is a, c, g, or t
  misc_feature (266)..(266): n is a, c, g, or t
  misc_feature (281)..(281): n is a, c, g, or t
  misc_feature (288)..(288): n is a, c, g, or t
  misc_feature (292)..(292): n is a, c, g, or t
tcgccctattcttcatancggnatncgngaacnttattataataaacacccncacngctacaatcttcctnggaangnaatatgacgnactctcnnatgaactctacacaacatattttgtcaccaagaccctacttctaacctccctgttcttatgaattcgaacagcataccccngattccgctacgacnnacncatacaccncctatgaaaaaacttcctacggctcacccnagcattacttatatgatatgtctcnataccnattacaatctcaagnattcccngggnaacggg

SEQ ID NO: 708789 - DNA, 101 bp, Homo sapiens
tggaaaaaaagcccccccttgggcccccggggggggggggggggggggaattggggccccgggacccccccttcccccggggtcaaggaatttcccccccc

SEQ ID NO: 708790 - DNA, 1114 bp, Homo sapiens
  misc_feature (34)..(35): n is a, c, g, or t
  misc_feature (265)..(265): n is a, c, g, or t
  misc_feature (270)..(270): n is a, c, g, or t
  misc_feature (403)..(403): n is a, c, g, or t
  misc_feature (466)..(466): n is a, c, g, or t
  misc_feature (473)..(473): n is a, c, g, or t
  misc_feature (594)..(594): n is a, c, g, or t
  misc_feature (668)..(668): n is a, c, g, or t
  misc_feature (702)..(702): n is a, c, g, or t
  misc_feature (713)..(713): n is a, c, g, or t
  misc_feature (898)..(898): n is a, c, g, or t
  misc_feature (949)..(949): n is a, c, g, or t
gcagtgtgcagtttctatcgtgtctcagcattannggcacagggcaggtgtcatcccaggcacgcacgtcgaaggttttcccagtatcttcaatgcgcaaatgcagagtcaggctttccttcttccaagcaggcacatcctcgcgccagcataaacttggcactggtccctctcaccagcacagtgcagtgcacaacacaaggggcaccatgtcgcgcacagcacaattccacacacagcaacacagcaaaccctggctcgcagnccagntccacacaatatctcaggcagtgggcctcgtattacttgagattgcacatccttcctctggcgctggaatccatcaaagtgggccgccacacgcacgggcaacattccaaggcaaagagcccttgctacaggnttatctagcaacaagtggcgttcacaagcggaagcaaaacacaaggcgttatatctaggaggngcatggncgttcaaagtggcaaaggccaaataaaacaggtggcctcaaaggccaaaggaccattcttcattgcgacaaagtgcgaggccaacgctcacaggcgcacacatgcattggtggcaagggcnttgtggcacaaggtcttcacgactaccccccgaaagatatgtgattggcaacaaactgccttagacacgtggtngcagcaatttacgcagtatttctcaacactacanatggagtttgngcagttcatacagcgaatcagacacaaagaagacaacacgacacatcaaacgacacaaacacattggtacgggccggcccttcgagcaccaaggtcagaactcatagaagctcgacggcgagcttatatgcattgcgggccgccaaattcgaagcctcacatgtgcgcactatcgcccctatagnagaagtcgcaattacacctaccaggggcggtgtattacaacagttcggaantgtggaaactcagtgggtaaccacagtaatatgcatgtagcaattcccatttgcagcggtggtatagcaaaggcgccacgtatgtcatctcagatgtgccctcatgtgtgtgaatatgcgtatgtgtacacaggcaatggtagccactttaccaagagacgtaat

SEQ ID NO: 708791 - DNA, 587 bp, Homo sapiens
attatcactacgatatatgcgctcatatcggtggggtcagccatatgtttaaatgactctcgcgatgcatacaaatcagtcctccgtgaagacaggatcttctgtcacttacggttctgacatttactcgtggtgtgaccctgtacacttaatcttctgcaaaggagaaaaaaaaaccattgtaaaaaaagcaaaaatgacaacagaaaaacaatcttattccgagcattccagtaactgttgtggggtgtatgtacttagctgtactataagtagttggtttgtatgagatggttaggaaaggccaaagataaaagaggtttctttttttttccttttttgtcgtatgaagttgctgtttattatatatattgtggcctgtgtgatgtatgtgtgaaacaggtgttgtccaacaattaaacaggaatgtttattattggcttgagttagttctatcaggggaaaaaaaagagacagaagaaacaaaaaaaaaatctttgtggggggcatgtgggccctggaaaagggttttttaagaacaaaattggttggtgggggcacggggggccaagaagaggaaaagtgga

SEQ ID NO: 708792 - DNA, 107 bp, Homo sapiens
acccctattagaggaaggattgagagactagcaatgtgaagtaacaaagatcaggcagctgcaggtgactcctgaatcttgagtccagtgctttcgccactccaata

SEQ ID NO: 708793 - DNA, 95 bp, Homo sapiens
  misc_feature (8)..(8): n is a, c, g, or t
  misc_feature (13)..(13): n is a, c, g, or t
cactgtanctatnattatcccacccccaggggtgaccttgtgagccacacacacaggtacacacatgcacgatatgtacacactgcacgatatgt

SEQ ID NO: 708794 - DNA, 1197 bp, Homo sapiens
caggcgccttggggtcggggacgacgctgtgggccctcaacgcggcctggggccaggcggtccggtgtggatcacggagacgcgctacccgccacctgcgttcccgagactttcttggcaccgcaccgcgcgctgcaggcgcgcttcgatgacggccaggttcctggagcatttgctccatgccctcgcctgccatgcgagggccccggtgtggccccggtgctgctgctgcgcgctagacccccgcgggtctgtctctccaacttgcagcggtccgccgtcttcgagcgcgtcctcagcgccgtggccgcctatgccatgcccggccttcgcctgcctcgctgggccaggcgccgtcttactacactgccctagaacttgcggcaggttcccccttgcggcaactccgggttgagccaagcctgcgatacggtgctcgtggccgatcaccttggcggcgagccctttgggcggctcacggggggtggtgcggtgacgcctaggttgccacgcttgtgccgggaatccgcacgattgctagacctttaccctgcaggcaaactgcgggggtggaccttggcccccggtggccttcgggagaagcgaggttccttcccaaaacccgtagagggacgccaacggcctctttggaaagaacttataaccccttctagcataattgaccggcggaggagacccacttgtccccctgggcaatccgtagggccagaacttggtgttcttggaaagagagcctggtgtgggaacacagaccaggggcccggcacaggcttggctaatgaccccccaaagctttggacccaaatcttgtctgggtggacctgagggagtcctcccctcttctggtggccgggctttgacgccttcgccaagcaatgcgcttcatactggcgctttttgcgccccgcgtatgttcacgagggccaccccccaggggccacttgggtcattggtcggcccctctagggaaataccgctgtagtttacacagcgggctcgggcttgtccccttggattgggtcacactttgttgggctccaggccttggtgatacggtacggcgtctttccactaggcaaacgcaggaacgaggttgtgggcacccactgtcaatttcgtggccggcaacatgtttggggttggacaacggaggcctcccacttcacagtcgacgcg

SEQ ID NO: 708795 - DNA, 150 bp, Homo sapiens
acgaagacaaccgatgatacagctacagcatctcccgtccaaaggcgccaattttggcaggcatgtagagcatcaaaggcactacaggagagtcttcatttccatagatgatgaagcacatctctttcaggcgtctcctgcaatacctgg

SEQ ID NO: 708796 - DNA, 422 bp, Homo sapiens
aatagctcggtaccgacgctctctctgttggggatggcctctagttttgccagtcggctaataagggactacattgagtccacgttttgctagcgtcgaagcgagtacggctgttcccaatttccatcgcctgctccaatgatcactgcccactgtcccattgatcgcaagatagactttggcaaaactattccagtagttcagtaaaacacatctggagaatctcacctgcacttcgccaggcaggccaggtcacaccatcaggcctgtgaggatgaacaactgttccaggacgtgccccatgggtgcactgcaacagactgtttcaggccctggctcgtggctctctgatgtatgcctcctgggaccacgctgctctggagacctccagatgccccacagagagagcgtcggggatcctc

SEQ ID NO: 708797 - DNA, 166 bp, Homo sapiens
  misc_feature (23)..(23): n is a, c, g, or t
  misc_feature (110)..(110): n is a, c, g, or t
  misc_feature (137)..(137): n is a, c, g, or t
ttaaaattaattctgaaaccatngcgccaataagtggggagtgggatcttggacaacaatattttattgtttaaattaaatactgtgtaccccccccactcatgaatgcnggttcactaatgtgaacagtttgcttnaagtatgcatgttttacatactccagatg

SEQ ID NO: 708798 - DNA, 110 bp, Homo sapiens
acctggtcagcccaccacgatgacacggtgctcgggggcagaagtgcttgattcctgggtccacactgtcttgacctggtggacgcggaattgcggggacaacgcgattg

SEQ ID NO: 708799 - DNA, 136 bp, Homo sapiens
  misc_feature (12)..(12): n is a, c, g, or t
  misc_feature (18)..(18): n is a, c, g, or t
  misc_feature (74)..(74): n is a, c, g, or t
  misc_feature (110)..(110): n is a, c, g, or t
  misc_feature (112)..(112): n is a, c, g, or t
aatacccttggnaagagngacgaacacctctgggttttttcaataccaaattaacatggaaccttttctgtaantgggtacaatgaagaagtttcttaaaaacacacacnangcacattgggccaactatttagta

SEQ ID NO: 708800 - DNA, 875 bp, Homo sapiens
  misc_feature (152)..(152): n is a, c, g, or t
  misc_feature (468)..(468): n is a, c, g, or t
tgtatgtgtgtgtgtgtgtctcccattctctcttctctctctgtctctcagtctctgtgtgtttctttcccactctctgtgggtttgtaccagccgaagttgcgtcagggctaccaggtcggtggaggattgggggtgttgcgaaattggcngaaacctctttgctcctctggtaggcatttgaaaacgtggcttgggtcaggcacaggaggcccccctaccccacggttcccaggtgttgtttgtttttccttggcgttgacggaaatgtcacccgtttcccccttccaccggcatatccctggaccccacccttcatttcgccgtcgccccgtatgcctccggtgacacacattaacaccaactgctgtgggattggccagtgccacgcgtggtcacatggtctccccctggatttcgcctctgttcctctttgcagttgtcctgtaaagcacggtcggctttccngaacccctgggcttttacaagcggggcaggccactgctctttcaaaggaggagggaggcagagggctgatggatgaatgagtttgctctgacactaggccttgagaactatggggtcattgtgtgctgcagcgaggccctgccggcctgaccacatgtggtgagcccatcctatgtcactcggagggggccagaatgggatctcaacgggagtccagagaacacagcaggcgtcctgaagctccccctcccttggtggaagtcggctcaagcaggtcctgaggacaggagccctgggggtttgggcctgggacaggaccagacacccgtcgccccctctcccacgccgcctgaaacaggacccaggacacaggcgctgccggggcggcagcaggagcatcgcggccg

SEQ ID NO: 708801 - DNA, 308 bp, Homo sapiens
cgtcgacactctaaccactaggctacctgctggcccctccactctaaccactaggctacctgccgcccctccactctaaccacttggctacctgctggcccctccactctaaccactaggctacctgccgcccctccactctaaccactaggctacctgctggcccctccactctaaccactaggctacctgctggcccctccactctaaccactaggctacctgccgcccctccactctaaccaataggctacctgccgcccctccactctaaccactaggctacctgctggcccctccacgtcgac

SEQ ID NO: 708802 - DNA, 360 bp, Homo sapiens
cctttgagatcagagcatctggtcccgcctgcaggagacgggcctccgtggctaatgcggagtgcatctgcgaacgcgaaggccaccctgcaggagctacagacggtgcactcggaagtccacaccctcctgtatggcacgaaccccctcaaccggtcataaactggacagtaagataccttctaggtatttcaggaccttcctttcctcccatatcgggtttgaagtcccctgaggttgtgtttccagctctcaagcccttgtgtctggggcacctgtgcgtgttgcctgccacggttatcaggtaaagggcctgaaagggaacctttcaccctctgttcataagccacggtcgaccca

SEQ ID NO: 708803 - DNA, 837 bp, Homo sapiens
gcagggcgtgctggttgtccggcccaaaccttcacgtgttccaatgggaagtgcctctcgcacaaagaccagcagttgcaagtggcgaaggactactgtgagagaggggtcctatgaggcctcctgccccattgtgaatgtcaatcatcttgtaccagaaacgaccacgcttaccggcgtgccctcaaggtggggcatcatgtcttgtgagtccaaaggtggcatacctcacatggaagtggtggactgtgaaagagagtgatctgtaggcgtacgtgcgtcagaatgtggataggacttgcgatctggtgggctgcgaggtcatgttccatcgatgaacaggtctcgcatggttgatatggggggcacgtgaacttcaggattgaagggccgatgtgagctccttggccgggtgtaacagaccatgtgattgtctctcatgtggctcaaagaggaccatcgagtctagcagagtgacttcgcactcatctagtgctccacatagctctgagcatgtatcctcatgtgcgtaacatctgtgcttacatctctgattcatcatgatggagttctagagtacatcaaagaacgccccaaaaagctcaagtggtgaccggcacatgtaccttcgtgtggcatttgcgtcacaggaacacacagaaaggacgaagtcccgcgacggcagcactccccttgggggagggtaaagcgatggggatgcgggcaagatgccttctaggaagcccgccgatgcaatgctttccacgaccccaccatttgcatttcagattgggcttttgcagggctttctggaccttattgactttccaggagctg

SEQ ID NO: 708804 - DNA, 797 bp, Homo sapiens
  misc_feature (170)..(170): n is a, c, g, or t
  misc_feature (235)..(235): n is a, c, g, or t
  misc_feature (280)..(280): n is a, c, g, or t
  misc_feature (286)..(286): n is a, c, g, or t
  misc_feature (288)..(288): n is a, c, g, or t
  misc_feature (293)..(293): n is a, c, g, or t
  misc_feature (349)..(349): n is a, c, g, or t
  misc_feature (432)..(432): n is a, c, g, or t
  misc_feature (439)..(439): n is a, c, g, or t
  misc_feature (765)..(765): n is a, c, g, or t
gagtgagaggaccgcgcgagagtcacgccgcaagtcggcaaccgggcaggagtggggaatccgcggcggcctttgttcccccaagagacccagaatcctggcagccgggttcaaagcggtggtgagtgtctgacaagcagaggcatgagcgggggccaggccaccctacnggcccgaggccgcgggagggccgggggaggcaccggcggggccgccctcacaggaacctccatcnctcagggcccccgccggcgccctcggggcctccacggcagcgcancgctcnantagcnctgaacagtcccggggtcccagcccaccggaaccccggcagaggcccaccaaggcnctggggccctttgaggaccgggtggggcaggcgccggggggggaacgggacaaggcgagcggccggcagacggggcagaaatnggcgganacagcgtgcggaagcggggccacagggacggcagcgaccgggcccggcgcaagaggcgggagtatggtgtcgagcgggaccgggcgggggacaaccagcggctcaacatcttccccaaggagggcttccggcctcgcaacaacatccagcgcatcggcggccacgaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattnatgaacgtcaaccccttcccagtgccccggga

SEQ ID NO: 708805 - DNA, 253 bp, Homo sapiens
tccatccatgcccgcgtttgtggcgggtagagtcagtgacaggaaggcaggcctcctttggtagtatatagagtgagctagatttgggctcaggaaaacctaagctcgcttgattagctctcgtctgtgatatttctcgtacactggttctgctacgtcatggcaaagaaacagtacaaagccccactgagaatagataaaagcaagagacaacaagctcatctcaacacaagaaaaagtaaaccaaagaggc

SEQ ID NO: 708806 - DNA, 230 bp, Homo sapiens
gaccccgagcaggctacctgacaagatcactgctgacactatggagcactggatggaacctgtcaaagaccagagcattgagagcactgaccgacgtatttggctccctgtccccgtatttgacctctgcttcctgacttgtgtgcccttccttgctgttggaagtagagtctctttcttctaccgtaccttctgcctctttgtcggaggtatctgctgctcttcctctc

SEQ ID NO: 708807 - DNA, 138 bp, Homo sapiens
aacaaagtggagcgggactggaacccaattgccgaggatagatacatatcgctcggcaatggtcccagctgccctcacgttagttcccggcgacgaccaccccacgtagactactcacaccgagccgccgtggtgcct

SEQ ID NO: 708808 - DNA, 158 bp, Homo sapiens
  misc_feature (130)..(130): n is a, c, g, or t
  misc_feature (141)..(141): n is a, c, g, or t
aatgtaggatgggtcaagaaaacgataataccgtactactcataagcagcctctcagaagctgttagtgatgttgcaactcataggcaaagatagttaccctcctttcaaagcctaaatttaatgcttcnaacttctaccnaactctttaggtacagt

SEQ ID NO: 708809 - DNA, 132 bp, Homo sapiens
cggcacgagggctcccacaatctttaaacacacagccattggaaggacgatcttgagcaggaagggtttttaaagattgtgggagcttcgttgaacgttaatgtgtagtaaatgcacctccttgtattccca

SEQ ID NO: 708810 - DNA, 270 bp, Homo sapiens
atctatactaatccagctcgtagagctcctgggcaatggcaggcgatctgcaccacgcgagtcctggatgcgcagccaggtcgcactcgaaggcctcgagacatgcgaatgagggctatatgatgtccgatagtgtggacgtctacgtagtcccggtgcttcagcatggacttccttcccgtcagtacaggacctcgataggatggaggcctcctgccggaacttctctgccaggtggtcgagccgctccagcctgcggatctcattcag

SEQ ID NO: 708811 - DNA, 222 bp, Homo sapiens
aggagaatattcaggtctattgtgatttcgagatgcattagccgcacttagagttaaggatcaactttggcttctgtggaagctgctgagatttaaagggtaagagcttcatcccatttagaacatggtgtattctttccctccttgctcatatcatttatgaaaggataaaagactggagaaagtgtcagagtagattctggaggtacttatattgctagg

SEQ ID NO: 708812 - DNA, 674 bp, Homo sapiens
gtctcaagccctcccgtttccacgcacgccgtcgatcggccgttggacgccaccggcgacatggatcccctccgcctactcctcccccgcgcccaggcccagccattgcttccgctccccgccggcgtcccagcgccgagcgtcaggccccgcctcgtcccgcggcgacgggcgcgccgccaccgcaacggggccgcgcggatgcttccagcctcggccgtggcgtccgagtcgccgtggacggagcaggatccgccgtctggggagaaggaggagcggttcgactggctggaccagtggtaccccttcgcccccgtggaggacctcgaccccggcgcgccgcacggcaagatggtgctggggatccgcgtggtggcctggtacgaccgcggcgccggcgagtggcgcgtgttcgaggacgcgtgcccgcaccgcctggcgccgctctcggagggccgcatcgacgacaagggccggctgcagtgcgtgtaccacggctggtgcttcgacggccgtggcgcctgcaagttcatcccccaggcccccgccctcggccccccggtgcacaccaacagcaaggcgtgcgtggcgtcgtacccgtgcgtggtgcagaacaagctcctgtggttctacccgcgcgccgggccggagcacagggacgtgctgcagcggaa

SEQ ID NO: 708813 - DNA, 590 bp, Homo sapiens
  misc_feature (583)..(583): n is a, c, g, or t
  misc_feature (585)..(585): n is a, c, g, or t
atgatttctaagtttcagcaatcagtcatagcaaccctttaactattatatactcaatacagagctaggtattctgtggaaagtatagttgaagaaatgacaacagtcctcaggtgcttgactgacttatgtgaaagtataaaagtattctttgtaattccagtaagcagaaatagctttgtttagggggttgggagggactaaatttacaaagaggcagaatctcagtctaagggagagcttttggaaaaaaaaatagattattgaaaaaattggatttcccctcactggctcttttctgatgtgttgcttctcacttagcaacagctatagtttcctgagctctctccttgattcttcaaggcaacaagacttcgggttttctattaaggtttagtcctgcatggcactgactggttttgccctcagaataaaagctgtcaaaatgggaaactcggtaccatttcttccaattatcacatcccctccagtatcttcctgcttttggttgctctccagtattttcagatagctgttttctatattgtccacagttttgggttcacatgcttggtgtgagggnanaaaaa

SEQ ID NO: 708814 - DNA, 273 bp, Homo sapiens
  misc_feature (5)..(5): n is a, c, g, or t
  misc_feature (21)..(21): n is a, c, g, or t
  misc_feature (37)..(37): n is a, c, g, or t
  misc_feature (176)..(176): n is a, c, g, or t
  misc_feature (208)..(208): n is a, c, g, or t
gtaanatccccgagaaaatcncggggatattatgacnctgtaattgggggcatataaacctaactaaaacaacttttttattttattttatttttatttatgtatttatttatttatttcaagactcagtctcaagaaaaaaaaaaaaaagaatatacaccagcctgggcgtgggngcacgcctgtaatctcagcacttttgggatgncgaaggcaggtggatccacctgaggtcagaattttgagaccagcctgaccagcgtggtgaaaccc

SEQ ID NO: 708815 - DNA, 926 bp, Homo sapiens
gcccctcatgtacatgaatattatactagcatttaccatctcacttctaggaatactagttatatcgctcacacctcatatcctccctactatgcctagaaggaataactactatcgctgttcatatatagctactcgtcataaccctcaacacccactccctcttagccaatatggtgccgtattgccatacatagtctttgccgcctgcgaagcaggagggggcctagccctactagtctcgaatctccaaacacatatggcctagactacgtagatgacctaatagctagctccaattgctaaaacataatcgtccaaacaagttatattactaccatctgagatgactttccaataaaagctgataattggaatcaacaagagaccacccacagcctaattattaggcatcagtccctctactattgttctaaccaaagttcagaacaaactatttagttgtgcccccaagcttttcttccgaccccctagaaagcccgcctactaatactaggtacctgactcttacccctcaacagatcgtggtaagccaacagcccaatttatccagtgaaccattatctgcgagaaaaaaattctacctcctatatataatctcccctaagaattctccttacgtgtatacaatttcacagacacacaggaaagtaatcaataattgtatatttacgttcgaagcccaaaattattcgcagtgtgttatcacacccgagagggaacaggcagaagctggtagaaggcatatgttcgtatttaaccctagtaggccctccctagcatggaaattaacacacccgggctgaaatttatattactccgtcaaaataactgcaaattgatagagcacagatataaaacacgggcatacccaaggccccgataggagcaaagggatcacaacg

SEQ ID NO: 708816 - DNA, 253 bp, Homo sapiens
agctaccttcaatcacatccctacaatagtatttattgagcactgaccgcgtgcataaagactgttacatggtgtcagcggaaacacgctgtcttacagcgttagggtagaaggacgggcaagcaaacgaaacaagggctcccgcccttcaacatgagtataagtaatgatgcactttcactccagggacggacaaatgagggcaaaccttcatcatccatgagcagcgatttcgccaacgcaacaattgtca

SEQ ID NO: 708817 - DNA, 202 bp, Homo sapiens
acgaactaggccgtagccgcacgcggtaacagccgagcaccgcgcggtatgctgtgtctgatcacacgatcactcgacaataccaccaggctacttggaagttgtatgagcattacacttaagagaacagagcttctgccaatgtcagcttgacaattgtggactcctgtcagtgaccgacacgggtgatgctggtaaaaca

SEQ ID NO: 708818 - DNA, 151 bp, Homo sapiens
  misc_feature (7)..(7): n is a, c, g, or t
  misc_feature (47)..(47): n is a, c, g, or t
  misc_feature (73)..(73): n is a, c, g, or t
  misc_feature (81)..(81): n is a, c, g, or t
  misc_feature (115)..(115): n is a, c, g, or t
ggatttngcgagactgcgtacatcacggtatttattggatgtggaancctaaaataggaggggcgtggtaaancctcagancagaagtactgacaaagagtttccccaagcaatngaaccgccatagcccgcacacattcccaggacacat

SEQ ID NO: 708819 - DNA, 1121 bp, Homo sapiens
gagcgccttacgaaaggcggcaaaaagggagccaagaagaaacgtggtctggatccattttctaagaaagattggtatgatgtgaaagacacctgcatatgttcaatataacgaacactattgggccaagacgctcgctcaccaggacccaaggaagccaaaacttgcatctgatggtctcaaggtgtcgtgtgttgtgaacgtgagtctctgctgattatgcagaactgactgaagttgcatttagaaacctctcaagcctgagtaactgaaagaatgttcacgggataaaagactgccatgacgtaacttccatgagcatggatcttacccgtgacaacaacatgtgttccatggtcaaacaaatggccagacaaatgattgacagctcacgttgatgtcgaagactaccgatggtataaacttggcttccagactggtactgatgttatggcgatctatagctaaacaatagagcaaggaaacatcgagagatacgggaacgacccatctttactgctcaagaaccacaaacaaggctcactgacaacactacccggacagacacgaatgactggaaaattccatgacccccgagagggattgcacagggacccaaactggcaacgtagcaacgagaaaagtcggggatccacataaagaatttgcaagttgccaggtaccaggccatcttggccaaacacagaccgactcggcacaccaagcggccttggccctcaatcgattataatacataccttcatcccacgtgcatcggtcgtgaccgagtacaggaacaaaagtaaacaacatgcatcggacgagaaagcacccaacggatttaggacacgttggtgcgcaaaaggctcgccacatggaaccagaccaaccaacgggcgaggcaaggggacacggccacgaggcccatcacgaaaacaaggaccacaagggagaaccagatgaccagaggtgcctcaaagaggagaaaacacgacacccgacatgcgcaatagtgacccccaggcagagtacaccagaaaaacgaggccaaaagaggcccagacacgtacagaacagagtgcccacgacagaacaactgccgaacaggacaacaccaccaa

SEQ ID NO: 708820 - DNA, 251 bp, Homo sapiens
catgctggcatacattcatatgcggactgcaaccataggatatactggcaatttgttgtgcatttcataccactggccccactgcgcataaggttggggatatcaatttgattctgctgtagcgcgggattcatcatatcaagagtttctttgccccaatagcatatcacaagatgaccttcaatggtagtaccattagcagaaacaattgcatgtgctgcactatcatgggagttgcaccggatagcttg

SEQ ID NO: 708821 - DNA, 288 bp, Homo sapiens
  misc_feature (114)..(114): n is a, c, g, or t
cctggtgtgggacgtgacttcttctgtcttaggacattcaggattcttcgtcccaaattccatcccactaaaaatgtgctcttggtggaggtgggcaccttaattgtactcccnctgcctatagatagtgtggggaaatgatggtgaaagacgtggcaggaaactagaaaaatttttgaaaaatgaagcatgagtggagatccaataatgcatgacgtgcagagatgtagcttgagaagatttacatgagacaggtgaattaatgccgagaatgtagcagggggaaga

SEQ ID NO: 708822 - DNA, 561 bp, Homo sapiens
ccatcgccacatgccgtccggctcgatcgacctcagtcacggcagccaccttacagatcagtcctccaatctactcaggggggtcggggtcttccactcgctactctctcacagagctcaatatgggcaggtggcaataaatggacagaccagacccggatctacctagggggcatggccaatgtcaccttgatcgaccttcgaggatgcaagcagatcactcgaaaagcctgcgagcacttcatctcagacttgtccatcaacagcctctatggccggtctgacgagaagctgatacagaagatcagttaagacacacccagcccagattcaacaggaaaccgatcttcccttgattccccacggaggagagcctctcctcgacccggcaggggctcggaggccagcgtcacactccctctcggctctccggtcccttgagcccttcctctacggggggggcagagagggtggtggacaccaggctaatctggctgctcctctccctcctaaggaaacgggagtagccgattgatctgaggggacagccaggctgtggtg

SEQ ID NO: 708823 - DNA, 366 bp, Homo sapiens
tggccaggtctctacctaaaactgaacctcggatcctatctggatggtctctttgaagcctccaagtgcacacaggggggcaagggccgggcgtgcaattctctgaagttgggcaagtttccggccacggctgctgccattttccagaaggctttcggcgtatttccccaatgggggaaggtacatcagggctctagacagaaccttctcggcggtgggggtccatattggagcagcattggattcaggtgccatgagcaagctatgtagcaaggcgatcacttctgcagccatgcggtttggcacatgcccacggatgaagggacgcacaggatcagtcctggcaagcggggtacggagctcgaa

SEQ ID NO: 708824 - DNA, 643 bp, Homo sapiens
tctccctctccccacggtcctccgctctccctgtccctctgggatcatcgctataaacgatgaaggtctctttacggtagactctcatatgcaaagtcagtttgcccagatcatgacgtgtgagacaggcagaggaagtgcactagctgagtacatcacgacagacataatagcgtaccgacattgtgatacagggaaacgcgtgcggagccgcctggtaagcctatgggccccacatcaaggcgcatactcgtaagatgcggaccgcacactataagttatgcccgacacaggaaactgccttaatggaataagcacgcgacacggcaaaaaccgaacgtcccaacaaaaacgagaccaaagacaaatcacgaaaacaagaaagaatgcaagaacaaagaggaagcataacaaacaaatgagcaacaacgaaacgcacaacagaaaagaggcagtcacaccaaacgaacattcccaaacaagacacgcaaacaaggactgacaccacaccacgacgagcgactacacagaacccaacaggcgaacgaaacaaacataagccacgcaccgaacaaagcacagaaagaaacaaacaaaacgaacaacacaagaccaccaaaacaacaagaacacaacaaagaac

SEQ ID NO: 708825 - DNA, 487 bp, Homo sapiens
acaggaacagctataacatgttgaatgtgagaaactaatcgaggtactctaccgtataagcgctatcacatttagcctgcgaccctcagctagttatcggtgtcagtgaacgtgtctctaaactagctctagtgagatgtactgattttctctatttgcatataaacgttgacagttatttatagaatgcagcctatttgtagcaaatagtaatacgacaataagtagtcaaaatccgagtaagtccaacatggtacctcaggtaaagttacaggtagtacaaaatctgagacagacagggataggggtagtacgctagtctaagatagacatatgacagaagggacatttgtaatgcataatatatcaggaagattactcaagcagagctaaacactagaaacaatcttaatggtaatagatagaaacaccgggagaagatagagaataactatagaaacaatatatatttcaaacaaacagagga

SEQ ID NO: 708826 - DNA, 137 bp, Homo sapiens
cggctgcggcaggagtgccataccacggagaagcgcctgtcagcctggccaggcccagggcagcgtcgcctttgattaccgaaagcgcaacattcttcaagctgggcttacaggatgtgaaaagaatatttattcca

SEQ ID NO: 708827 - DNA, 209 bp, Homo sapiens
ttaattttttcccttgtttttaaggcaaaaccctttgttcaggggtttatttgctgcccttttcccccctatttttttatgaccctgccccccccccctttccgaaaaacccctaaaaatgatcaataaatattaagggaattaaaaggccggggggatcccccgtattttgaaccccggtccccggggccccctttttttttttttta

SEQ ID NO: 708828 - DNA, 2605 bp, Homo sapiens
gctcacttttctaatttacaggctggcagcagactgagagccctccttgctagggacagcagaattgcggcttctagctgcgcactctgttgctacaccttaacaccttgtgagacaatcccgcccatatatttctattactttaacttactgcaaactgccctagccttccctaacactaggacttgcgcagcgccaacactctaccccgttacacaccttctctcgacacacctaagctccctttacattacgtagctttctatggcaacatcacctgccacttactaccttgctatctgtcgccaaactaccgttacacaacgtgcgtctattatccctggcttcactcctcgctcctctaacgccatctgtcctcactccacgcgcgccgccacagacgtatatagcgggcttaccgccgcaatacatcatctaccttcggccgccctcacaacccgaatcgctctcctcttatcccccgtcgtcgcctcaacctatccgccaccacctcgccctgccttacctttcccccatcgccctccctctcccttctcctactgctcatcctcggccccctatctcactctccagcctaccctcactctcggtcgctatactcatccatatcgatcagtccccacctacaccgctatccaaacgacaggcaccatacacacgattacactcaaactccatctacaatcaccacttcgcaatctctccacctcccacctctacctcgcctatcacctatccatcaatcaatcacccaccgcccaccctacccccacttccgtgtcagctctcttctgtactgcgtcaacgtcgcttcaatgttcggcagttatgtcgcagctcctaccctcggcgcaccgcggccccccacaccttatgccttcttccggtccccgccctatgtctcatatcgctcctcgatctccctttggcgcctcccccttctccatcccgtcgccctctcctgccaacagccagtatcttcccgtctaccccgttgtcacccacagcgcgtgccaactccttccccccctcctctacgttagagaacacatgctaccaccataatccacatacgcacctccaatcactcacctatctcctaccgatattctacatctcacccataccactactaatcacaacatgcttcaacacctctactccctcactagattcgcttaccctccgcatctactcatactatatacatatccactcaacactcctccctcacccacccactcacatcacttctgcgctctcaatcttccccctcttatccccccaacatccacacacctccacacacctactaccccacctctacatccgacccatcctctcatcattactccgtcacgccttctccctgcatcaatcactcacatactatccacaatcactaccatcaccacacctccccacctacatcaacaacacccctactaccaccctcacaaacctacactccacacactacacccacccaccccactcgcatcttccactccatcatcacctcccccacaccccatcatcctacccccacccccatactcatccccccacacccaatcacctcactcctcacaacccctcaccactctacgtcccatctgcacccacacctatcgacatcatcatatacccccccgctcccattacaccccactacctcctcacctcctaccactactaccatcacacattcatactttagtccaccctctctacacgcctccacgctcctctctccctaccttcacatcacccatcccccactcccttccaccatccaactaactacttcactactcatctataactcatcacctcaccgtctacatcatcctaaacatcgcccttgactcaacctcctccctttacctaccactatcacctcatactcctttgttagtacctactacgtcatctgctgtctacagttgcattctgtcacctatgcgcgtctcctttcctcgatccgccgtgtgtcgtcacaatgcttactgactccgctagactatacgctaccgataccactctccctgcctctactctatgactactctcttctcactgctgtacgctcctcacttcttcaatctctacgctcttgtctctcttcgttccgcctctgccgctagcctctctgctgtgcctctacctcatcgtcgtctatcatctcctcctctccttgcgctcgtctacttttcccactcctctctactcgtcgtcagcccgccgtctatacaaccaaccatacgctacgctctcactatctcctcatcctcatcaccaccgtcctcctcaaccctcaccacttccaccacgcttacccacttccatcacacataccactcatatccacccacactatctcctatctaacatatcttaactacacctcaatactcacttccaccccagcatctcatgacccctccaacccatcccacaacacactccatactaagtcccaataaactcacctaactaaccactattagcaccactcatcacacctagattgacgcactcctcacacaccctatacactcacctagatctacccttcacccct

SEQ ID NO: 708829 - DNA, 184 bp, Homo sapiens
  misc_feature (154)..(154): n is a, c, g, or t
atggaacctcagttgcagcaccatgtgggcttcaaaagaagattccttatgtgggatacctaaggacagttaattaagccagacaaacccaatgggattaaagatgggaaatttgtcttttgacatcttccagttttgcaaaggagtttttggnatatggagtatttccgaggagatgagtttt

SEQ ID NO: 708830 - DNA, 217 bp, Homo sapiens
cctagccgcctgggaggagcgcctggactcgcgggccgcggcgagcgcctttacaatggccctgaccctgttttgatacagatgaatatagacctccttgtttggagatcttacttatatcagctacaacaggaaggccctcatcctcggagaattacctgtacttgcgaggtggaaaacagaccaaagtattatggagagagtttcatggcatgat

SEQ ID NO: 708831 - DNA, 178 bp, Homo sapiens
gcaactcacaatctttttagtttgcgtctttttatcatttcaatccaaagcgcatgtcattttggtaagtgcctgcattgtagttttcatggcaaaataattctatcccacgtattcaattactcatacgtttaaggtctcgggtgtatcccagtctcactactgttgtccatcattt

SEQ ID NO: 708832 - DNA, 575 bp, Homo sapiens
  misc_feature (1)..(2): n is a, c, g, or t
nntcgctttctccgcggtcttccgagcggtcgcgtgaacgttcctgcaggctggcatggcgcttccaacgtctcccccacaggctccgggcttgcccagatgctcaaggagggagcgaaacacttttcaggatctagacaagacggctgtgtatagaaacatacaagcttgcaaggagcttgcccaaaccactcgtacaggccatactggggaccaaatggaatgaacaaatggttatcaacacttgggagaacgttgttttgtgacaaacgatgcagcaactattttaagagaactagacagtacagcatcctgctgcaaaaatgattgtaatggctttctttcattaatgggcaagagcaagaagttggagatggcagcaaaacctttttgattctggtatttgctggagctctcctggaacatttaagcgtgggacagaacttctgaggactggctgtcagtttcagaggtcataggaaaggggttatgaaatagcctgcagaaaagctcatgagattctttcctaaaatttggtatgttgttctgaaaaaacttcgagaatatttgatgaa

SEQ ID NO: 708833 - DNA, 920 bp, Homo sapiens
gtcgggcggtctttgtgtgcggagtgtgtggtggccgggggtgcttggggcctggttgcgggcgcgtttgcgggacggagtggtggcacgagcggggggttctcgccgcgcgggggccctggcccttgggggccgggcgatgtgggcgtgggcctgggcttattgccccccctgtggggcgttttgtgtttttgggacctccgctgtgggtggtgtgtggagcaacccttgccatggtgcctggggagggggcacgggaccctcactggggtggggcccggaagctggcccctgtccctgtttacgttttcccctgcgtgtggaggccccacgagaaaggcgttgcaggcccttttatgtgggtgggggccagaaggcgaagagcgcctttggttccccaggggggacacccaccgccggaagttctcccccggccgtccataggtccgcacggggggcgcagcgcccgattgtacgtgagaattgtgagggaggtaccacgtgcttgcgtctcccacggctccccagcgagggcccccggagctctggggggtgttcttggtgtgttgggggaacggccgagagccccggttccggagttgaggagagtcttgccaccctggccgcttcctcgtagctgaggcctgcatcctcatgctgggcctcccctcccctcccccctctggtgcatggggtttgctgccctctcttttgcccccgcaggtggaagagacttattagggcacctggtggtggatggcccccgcggaggtgctggagctaggtttcccggggggcctggtttcccggcaacaggtgggaacctgggcctggaattgaggggcggtcaggaaggggtacaagtgggttcccttatttggagttcccccctccattaaacaaggtttggaccccccaca

SEQ ID NO: 708834 - DNA, 306 bp, Homo sapiens
gcgtcatcagtagatactcctttcatggaatctacctggttatgcagccacagctgacgcacagagcaactggaactaggtaagacattggtattgttgatactactcttcaacaaacaagtctattgtgtttgaagggactgtttctattgattaaataactcttatttccttggagcttattattgattgacagtttgtcctcggtttcaataaatttcatttgaattacctattatactgccactcagagttcctacattcgccagaattggcattcagttcattggttcatttcactttaac

SEQ ID NO: 708835 - DNA, 782 bp, Homo sapiens
gaaataatgctagcgatggaggtgttgccgaaataaatgtatagcatagccggcgtaaggcggcaacgagtgtgtcgctagagcgacatgatgctacaagcagaatagtctagctataaagacagcaagcagtaacacactcgcgacaggctattacaagcagagtaaagcgctaaacactacgccaactatgactatagacacagcaacataggtagactactatacatcggcgacccaggttatcaaaccattggccaataacaagacatgacaataccaatgaacataaggcaagcagcgcacatgctatgaaacgagtgaacgcacaatgccaccagaagtaggtggaacaccccaaaaaaaacgacttagtaaattgtccaggtgccacaccttcaatttccgtttgccaaaaggtagcgctcgcgcaatctggcaacaaaatactgggcgcgcaaaaggggtaaagccatctacaaaagatacacaaagagccttgcacgcggacacacggagcacgttaggaataaaaaaagcgctctaaaatctgggtacccagcaaggcaccaggcaaaaattttacaaaggttaattgcttcgcgggatagggtatacagaaacacccgtgtacatatcacacacgccgttatagtgaccacagaacgacaaacagggaaaacacaattatgcttgcaaagcaaatgctggagcgcaatttccctccacaaattggacgaataccaggaacacgtgggataaaacagacaatacactggagt

SEQ ID NO: 708836 - DNA, 376 bp, Homo sapiens
  misc_feature (6)..(6): n is a, c, g, or t
  misc_feature (11)..(11): n is a, c, g, or t
  misc_feature (46)..(46): n is a, c, g, or t
  misc_feature (370)..(370): n is a, c, g, or t
gatgcnggtanggaacctggggataagatgtatttaagggtccccngaaggttaccgaataggggccatgctgagctggggaagtcccagcctctgcccctgggcttccttcaccctgatgcagttatttcttgttaaagattcactgtaaaatgccaaataaacttaataactaactaataaccatctttgtcagttgaggacacttacattttatgaattttggggaaaatataggaagatacctgaggaaatagaattttcaatatcataggtctagcttttgatattacagaatttttgtgcacatgtggcaatgtgcttgctttggctttctaaaaagaattcaggtagcggtagacatcttgcnaccagt

SEQ ID NO: 708837 - DNA, 318 bp, Homo sapiens
aagctttttttttttggttatgtcctttctggttttggcattagggtgattctggctctatggaatgaattagggagggttccttctttctctatcttgtggaatagtgtcaaaagaattggtaccaattcttctttgaacatctggtagaatactgctgtgaatccatagaggagtggtgagaatgggcatccttgtcttgttccagttctcagggggaatgctttcaacttttccccattcagtattatgttggcagtgggtttattatagatgggttttattactttaaggtatgtcccttgtatgccgaagctt

SEQ ID NO: 708838 - DNA, 326 bp, Homo sapiens
  misc_feature (53)..(53): n is a, c, g, or t
aaaacgcaaaaggactttaattaaagtttactgcacagtttaataatccggtntggaatcgcctataacagggattgtcaatacaacctaatggttcctgaaaaaaaattctaccacacagaacaacattgggaattacatagtgctcgggactaaaaaataaatacatttacttttgggaaggtcatttcagaactgggttgtgaggtggttccaataagtcagttgggaaactaatatctgacaagaacggttcagcctcatgaataattactataagactatactattaaagaggtgtattgccgaaagcatctctgggtctg

SEQ ID NO: 708839 - DNA, 493 bp, Homo sapiens
ggatatgacttagtatcttcacaatgaacatctattacaggtgcaaaggggacacccgaatcctcaccgaggtaatatagattatcaccagtcagtaatggggaccaatacaacggcaagagcctcctgatatatacgcagtaagaaaaatatgacatcgcttctacggtgttcttgctaaaattgcttaaactgaatccaatcatgaggaaacctgacaaaccaaaatagaggaacattctacaacataactgaccagaactcttgaaaaccatgaagagactaagcaagacagaggatctgtcatggattagaggatactaagatgacagctcatctcgacttcatgtgtgatccttaaactagaaccctgaaccagaaatttgaattggacattagcaaggcaacaagtgaaatttcagtaagattgagagattatagtattacctctgtgttaatttcctgatttccaccttgccagggtaccgagctc

SEQ ID NO: 708840 - DNA, 533 bp, Homo sapiens
  misc_feature (425)..(425): n is a, c, g, or t
  misc_feature (458)..(458): n is a, c, g, or t
  misc_feature (480)..(480): n is a, c, g, or t
  misc_feature (497)..(497): n is a, c, g, or t
  misc_feature (519)..(519): n is a, c, g, or t
ttttgttgaagaacattatcccagaagagaacttgtaccaatgtaaagatggatattttggggatatggaagcctgagactaagttgaattcaaaatatcatggatctggctgggtgcggtggttcacacgtgcaatcccagcactttgggaggctgaggcgggtggatcgcttgaggcccggagttggagtccagcctggccaacatggtgaaaccctgtctctactaaaaataccaaagattacctgggtgtggtggtatgcacctgtagtcccaggaactcaggaggctgaggcatgagaattgcttgaaccctgggaagtggaggttgcagtgagcactgaggttgcagtgagcactgggcaacacagccagactctgtcttcaaaaccaaaccaaaaaatcatggttcttagcaaatttnatggtgagttaaagttatatgttagttacattntttcttaggcacccaaatcttnatttacgtacagcttgnaaattagacttaagcttacttnagggtccaaaatta

SEQ ID NO: 708841 - DNA, 894 bp, Homo sapiens
  misc_feature (61)..(61): n is a, c, g, or t
  misc_feature (117)..(117): n is a, c, g, or t
  misc_feature (125)..(125): n is a, c, g, or t
  misc_feature (260)..(260): n is a, c, g, or t
  misc_feature (313)..(313): n is a, c, g, or t
  misc_feature (316)..(316): n is a, c, g, or t
  misc_feature (323)..(323): n is a, c, g, or t
  misc_feature (330)..(330): n is a, c, g, or t
  misc_feature (348)..(348): n is a, c, g, or t
  misc_feature (465)..(465): n is a, c, g, or t
  misc_feature (806)..(806): n is a, c, g, or t
ctgatcggaacgaggcgactccgtcgctctcaattcgtcacaggaggaagacggagctggntgcccagcccaaaggcccatgaggggatgcagttatgggctctgtcgccgtggatngttatttngtgtcagtaagtaatccataaagtgccaacatgggaaagaaacggacaaagggaaaaactgttccaatcgatgattcctctgaaactttagaacctgtgtgcagacactttagaaaaggattggaacaaggtaantttgaaaaaggctttagtgaatgtggaatggaatatctgccaagactgtaagnaantgacaantaaagtngaaacgataaagctgaangaagaaacagaagaaaagccttcagtttgggctgtgtcttaaatgtggccatcagggctgtggcagaaattctcaggagcagcatgccttgaagcactatctgagcgccaagatctngaactcactgtctggttcttagttgtggacaactggagtgtatggtgtcacgtatgtgataatgaggtccagtattggtagttcaaaccagttgggtcaagtggttgattatgtcagaaaacaaggcagcattacaaattccaaagccagagaaagatatggaatattgacttgacataacaatttggacccacacaacaaaaaaaaaaaaaattgtgggggcgcggcgcccggaaaagtttttaaacatcggggggcgggggcccagaggtaatggacacggccaaaggggcaagaaccgggccgagaaggtggttccccaaaaaagccggcggcggtcngaaacccagggtccggtccgtcacgccgtcatcccccccgtgcgggggtccacccgcagcaagagcacctacgcggaatcgacggctg

SEQ ID NO: 708842 - DNA, 621 bp, Homo sapiens
  misc_feature (1)..(1): n is a, c, g, or t
nggaacacctttcttaaaaagggggcgcaatagcctttaaaaaaagaacctttgcccaagggaggccaatagaaaggaaatcttgcttaaaacccggcctccgggggtagggggcacttccaaaatagggttcttaaccccggaggggcccagcattccaaagattgggccaaactggaggccaaagtttgtggccgcaaaaaaagcttacagaaggaaggagttttttgggacaaaaacatttgttttaaagttgcaaaagagccgtataaacgcccactttatggccaggggtggtgggtcaagcccgtaatcccaccccttcagaagggcaagggggggcgatcccaaggtcaaaagatcctgaccctcctgacccacaaggtgaaaccccctctttactaaaaaaacaaaaattaggtggggcgggggactttccccgggaagcctaaaaacctgggaggctcaggcaggggaatcccctgaacccaaaaggtggaggtttcagttaactgatttggcacccctgcactcccccctggtggcaaagcaaggctccctccgaaaggaaaaaaaaggaaggaaaaaggaaaacaaaaaataaacccaccccggggtata

SEQ ID NO: 708843 - DNA, 184 bp, Homo sapiens
tggggggtttttttgggggtttttttaacccccttttttggggggggccggttccccccccccttttgggggggttcaaaaaaagggggttttttttccccccccccccctaaccccggggggggaaaatttttgggggcccccggggggggggggttttaaattaaattttttgggtttttta

SEQ ID NO: 708844 - DNA, 321 bp, Homo sapiens
tcctggaagctcatctagtcttatgaactggtaatagaccacgcttttctttattcttctgggccacttctattagcctcatattctggtgagagagttgaaagtgctgagctaagtcagggaaggttagagcaggccggttactggtaagacacttctgttctaccttttctgacaccttatattctggcaggacgaaaggccctatttattgattgtgaacgccgtggaaaccttctttctggggattccttcttgagtccacctggcagggcttccagctttggacttgcccttcgttttaccacgttcctgacttgg

SEQ ID NO: 708845 - DNA, 769 bp, Homo sapiens
  misc_feature (230)..(230): n is a, c, g, or t
  misc_feature (254)..(254): n is a, c, g, or t
  misc_feature (303)..(303): n is a, c, g, or t
gtcgacgtgggctcagagcagacactgggcttcggatcctggacaaagtctcccaagttgagggtatcgaggacgcctagatctctctcccagggccatggcgaacccgaagctgctgggaccggagctaagcgaggcggagagcgatcgagtactgattcggctcgatttgaggagctactgctgcaggcctcgaaggagctccagcaagcccagacaaccagaccagnatcgacacaaatccagcctcagcntggtttctgcataaagaccaactcctcggaagggaaggttttcatcaanatctgccactcccccatctatccctcgctccacgccgacgtgaccgaggcaggagctgcttcagatgctacgaggaggacccaacgctgggttcgcatccccatgagatctgggagcagcctcatgcagaaatggatgccaacggccaggactgctccgcctacgacgtaaactgcaaacaggcgaccttcctaccgggagggatgccagaaaaccacgccgactatccttagcccggggagccacggtggatctcaccaattacggcggggtaagggccagtcaggcgcaaacatcacaaccctggcacctgaattctgcacactgcgtgcatgtcatgaaagaaaccgggcaaacaacaggagctcccatcgcagacgctacacatccgcccccacccaggctctcccacaaggaactggaggcctgaacagcacgccccgagaaacagacaaggccgacacac

SEQ ID NO: 708846 - DNA, 919 bp, Homo sapiens
  misc_feature (175)..(175): n is a, c, g, or t
  misc_feature (180)..(180): n is a, c, g, or t
tattctatttactctcaattccttctatataataataccaccttccatcccaccaagtccccgtcaaaattgataccagtggatactccaaagtgcctaagtgggtatcaaggcagaggcagagacaacgaacaaaatactctcgttgggtcgcgcgtaggatccgaaatcgatntatcnttgcatgctagtttatcccgtactcatagcttcacgtctccagatttcttttccatgcagttcatctggtgaatgcagagtatctcgagtcactatgtgtgagatcttggctggttagcttgtcacatgtctaaggcaggtatacgtgattgcacaaacgaagagttttgcattagtcatttgacgctgcaactggagcagtattgactactttaggtgtgttacataattgtccatttgaactggacttaagttgcttgacaaaagtttcacacagttctgattcatactcttgggagggactcacatgattaggttccatgaactcttaagtcctaccaatcgtatttccgaactttcagctatgaggatcgatatatgcgttcagtggtaacatgagtttattaagagctgtctagagtcactatatggttttatctaaatgaattgcttgcttaggcttacttgctttttaggttacctgttgcactagattgaggcaaataaaaatatactaaagtgaaaacatggattatagttgatataactttggagattggggtaaataagtggttaacaaaggttgcaataccaaattgctggcttcaaaaacgtttcggttatggccaggcaccggtgggctccaatgcctgtaaatccccaggcacttttggggaaggcccgaggccagtgggatcaagaaggtcacgccagttccaacaccaggcctgaccaactg

SEQ ID NO: 708847 - DNA, 540 bp, Homo sapiens
tatacgaagtcgagctcgtaccggcatgtgctgtaagccagtcggttggccgacgacgatgcccgatgcgcgaacgcctgcggcaactgtacgcggcgcactggcgggcgcagtctcgaacagattgcccaggacctgagggactacgtgccgggctagaaggcgtacttccgactggcgcagacccccaaggtcatgcgcgaactggacgagtggctgcgtcaccggctacgtgccgtgcagttgaagcagtggcgccgggggggcaacggtcttccgggaactgtgccggttgggcgcgagcgcggacctggcagcgctggcctacagcacatgccggcatgtgctgtaggccagcgccgccccgtcgtcgtctgccttcgcttcacggcgccgagccgcggtccgaagtcttgctgtgtcgcccaggctgccaggctggagtggagtggcatgatctcggctgacggcaacctctgcctcccaggttcaagcaattgccctgcctcagcctcccgaatcgctggcctacagcacatg

SEQ ID NO: 708848 - DNA, 352 bp, Homo sapiens
accaaaaagataataaaggaatactactaacaactctacacacataaatttgacaactaagatgaaatggaccaattcttcaagaagcacaaactactataatccactcaacgttaaaacaataatttgaatagccctgtagctactaagtaaactgaatgtgtaatttttaaattcccctgaaagacctcttcaggcttaaatggtctcattggagaattctaccaaatgtttaaagaagaattaacattaattttatacaatctcttccagaaaatagaagaaaaacagatgcttctcaattcatgtcggatccctacgtaactttgataccaaaagagacagacagttt

SEQ ID NO: 708849 - DNA, 1307 bp, Homo sapiens
taagggtaaataccctctttagctgagtccaaaacttgggatatattaaattactggtccctaaaaagagtaaaatgtgggtggccagggggtgtggcttcacgcctgtgcaactcccagcactttggggaggccaaggaggggtggattcatcgtgaggtctcaggagtttcgaaaccagccgtggccaacggtggttgaaaccccatctctactaaaaatacaaaaattagccgggcgtgtgggtgggtgcacgctgtgtgtggctcccagcttactctcagagaggcttgaggcaggaaaactcgctttaaacctaggaggtgtggaggattgaaggtgagcgccacaagagtggcgccccacaacatgtggacaattatcacgtggcactgtggggacaaacacacagagacacaaagaagttcaacaggtgggaacaccatatgtgcacacaaagggatatggggagaaaggggtgcgccctcaacagagaggcgcttataagactttcacagagaggacaagtggaagagagagacagaggaaacagagtgagaggggaacatatactctgtggaagaggtataaggataacgtgggaatgtggagaaacaccaaaaaaaaagagactgtgtgtagatattataaaagacgagaatttagaggaaggttccatgtatatagaacacaggtgtgtgttctcaagagttacagagagatatacaaaaacgagggctgtgtgagaaaaagaactctgagggggggtaaatattgtgagggagttaaacccatgagattcctaaggaggatctgaggagagaaaatcaccatattccaaggtataagtggggagaaaatctcagaaagggtataaaagacattatgtatagagtccgagaggaggaacaaatttgagggaaaatgtagaggtggcctattgaaaaagaaagttgtacattagcaaaaaaaaagagtccgttaaggtgtgaaacacacaaggagattacagtgtggggcaaaatattatcagccatttgtaagatagaaaaaggagtaattatggccgcaagacgacgaaagaaaaaacaactaatgaggtaatggattacgaggtgaataaaaaaagagatttaaccgcccattgaatatagaagacgcccaaacaagtagtggtgtgctagacaaggggaagaaaagagagaggtcatgatactttttaagacaatgtagttgcgaacaaatatgtgtgagaccaacctgattaagcaatataccgagagaagcaaatatgacacaccaagaat

SEQ ID NO: 708850 - DNA, 776 bp, Homo sapiens
tgtgggcccatacgtggatatggggaccctcacaggtttcctacaggaccagaacaccggaggtttttcagataacaactgggcgccgatgaccataaagcttggcccgggttgaaccgcggtggtaacgcagcacgccgtttcgcacgcctgctgccccgcgccttcttgggtgttaggacaccgcagcgcctggccggtgtgctttcaaagatactcgccccgggtgaaccccccgtcataacactcgtgaaaggatgatgctccccgaggagtcacattccccccgttgcagggcttggttcccaattggtaaggttcccccaagctttttacagagggcacgcgctcctgactagggtcataacagcatacaagtggcgcaccgaaaaaggggggaggaaaactcggcgttcgcgaccccctctggtggtggtcaccgcccttcttggcaatggcccttgcaccccctatggcgagagtccgccctctattcgaccacttgtgtggtaccccctcccgggtggcacgaggtcactcgtgcgaggcgccccccacgggcatggcacacctcctccggcccagcgggctttcttccacgatttaccaagaccggctcaaaaaactcttgttcagccaccacccaccgacgggactcaaaccccgggggaagatgtgggacgttgtgcgacaaggatggcggggccagaagggggcccccgcggggccggggacccccgcccccacggaaaaaaccccccggggcccaaaaaaaa

SEQ ID NO: 708851 - DNA, 333 bp, Homo sapiens
ccgaggccggactcttggggtgaggacaactgggagggcgtcgagactggacagtcgacaggtcagaggctgaggtggcgcggaggaagcgcgagaggcggcggcgggagatggaggccaaacgcgcggagatggaaggtgccaagggcgcgaggaagctgggaggccggagggtggagtgaacggtggcggtggcccgtgccggctgcggaggagcgcgccccacaggggtatttgttgtacagaccatgtgggggccggccgggcagcgaggccatctcacgtgtacagtaatgagaggcgcacaataaattctaggtcacaaaaaaaaaa

SEQ ID NO: 708852 - DNA, 119 bp, Homo sapiens
  misc_feature (4)..(5): n is a, c, g, or t
ttanncagataagctgtctgacccaggagaacaggaactatacagcatagtggagttttgtgtactaaaacttgctatctactggtcctttggaagttgaagtagtagaaacctaaagg

SEQ ID NO: 708853 - DNA, 484 bp, Homo sapiens
ctctctagaggttccatgatgcatccatattcagcgtttcccgagttaagcccacccatgcaggtctgcagttttactcaacaggttttgcctcagtggctctccctgtggttcatctaaattctctcatttttttttaataactgctttattgagatataattcacatgccacacaattcacctatacagtatacaattcagtagtgtttactatattcagagttgtgcgactatcatttttctcacccccaaaagaaaccctatgcccgttagtattcactctgttttctcacaactctaggtaaccactaatctactctccatctctatagatttgcccatgctagacatttcatataaatggaatcatacatgtggtctttttcactgagtatattttcaaggtgcatcccagctgtggcatgaatcagcatctcattcctttttattgcccaataatattctatcatatggatatgtcg

SEQ ID NO: 708854 - DNA, 535 bp, Homo sapiens
ggtcggtaccgtgatggaactcactagctccagtctgtgcgggtgcagctaggaggtagtaggttttctgattgttctgacagatttgcctcccactctgcttgtgtgatgagatgatccccaagaatttaccctgtagcctcaatggcccatctgtgaaagacatgatcgtatggatagtctgtcaaattgattgcggccagtgcaaaacttttcctgataaaaacagctagccggaattgagcactagctctgggtcatgagctgactcaaatacttcctccctcacttctcccattctacgagtggcagagaagacctgggccatattagcaagggctgagatcaggactcacactcaggccagctgcctatgccccaggctggtgatgtctgggagctcagggtcaacgagaggggagtgcggattcttgaacgacaccaagagggagccattcgagcagctcccatcttccttcagagttctgctgagatttctcccctctaggctggcggtatcctgccacatggctgt

SEQ ID NO: 708855 - DNA, 253 bp, Homo sapiens
cagcgttgactggtgttttgttcggggtcccccaaaaggcaaaaggagaggtggccgaaaacccagcaaaagtccagaccggagacgtcgctgacaggtcctttgttgtccaggggttctcttcaagattccctttgcccatgcacccttggccaaataggactggggtggaccttgctgtgtttatatttaatctcttcccgtatatgggtagtttttgagttgggaataaatgttccctttttgtttttta

SEQ ID NO: 708856 - DNA, 269 bp, Homo sapiens
ggtccacggaaacctctgcctcccaggtcccagtattcggaaataatagtgagctatgataatgcctctgtaaccggcccaggcaacagaaacaagaccgaccctgtctctaaaaataacaaaaatacttaattgagcaattccaaaatctaaaattgttaagcagtttacggcaaattagttaatatcatattttatacatatggttacttcattatggctatctaaaatttccatggcttttaaccatatggttccacttggccact

SEQ ID NO: 708857 - DNA, 232 bp, Homo sapiens
cgacccacgcgtccggttttatttaacaggtataggttcaatactacaaggggaaaagagctatagaaatggaaggtggggaagggcacacaacattataaatggagtaatgccactgaaccgtacacattaaaaaataggtaagatgggaaaatattataggtgatcatataggggcgccaaaaaacgaacaaacaaacacacaaaaaaacacacgggccatgcctgggga

SEQ ID NO: 708858 - DNA, 647 bp, Homo sapiens
catcgcgctcggatcagtcatcatccattcattgacttactcgtcagtcaatgatctaatgctatagaccatacttggtgcagatgccatgggcgttttccgggcgtgacgcccgacatcgaggatgattcatgaacattcgcttccgcatcaatttccttcactgcaatcgcaggctttgccctgctgctatccgccaacgcttcggcccaatgggctggaaggggccgcatagttcagcaaaattcttctggagggattactactcatgcggcccaggccggggctggatacaaccgaggctacgaccggcgccatgagaccatcaccgatggaacgggcaatgccaccagaaatggcagttcctatgcaggcaacgcattcggtggctatagccagagctcgggcagcagctatatcaatggcaatgacgcgggctactcacgccagcgaaatgggcaaactgcacagggcgggacattcaatggaaacagcacctggccagaacggacagggcttcacgcatccaggaaccgcgaccgccgccgacggacagacgtatagcggacagacatctattacgaaagatggtgtcactcgcagtgggacttgtacgacgctagcggatcgtggtgtcttgctaactc

SEQ ID NO: 708859 - DNA, 153 bp, Homo sapiens
tacaaactatatgtatacacgtataaattaaataaagatgttgagttggtctgcactttcctacaaaaatacagcttaacttttttggtcttcctataacctgcaccttggttgcatgtgggaaatgcttttcccatgtagcacaatggtgga

SEQ ID NO: 708860 - DNA, 211 bp, Homo sapiens
tccctgtcgccgcgaggggcggggcaggacgcgcaatccggccgagctgtccggggtcgtgagccggcccgctttggtggggcgcccctcggttccagaggccagacgcatcgggtggctcgggtctccagccccggccgggaggaaggggacccgcgtctgcggagcgggggacacctcgggggcctcgggcggggccggcgacacacgc

SEQ ID NO: 708861 - DNA, 330 bp, Homo sapiens
aaaaaataaaaaaggaattaaattaattaatacagcgtttattatgtttaaactcttaggattcaaatgagatggatctaatggatatttctgatttgggtctttaaaacccttaatctcttttaagcattttaggcctgcattcagaaagaaatctgtcttctaaaagaccttttcctagcctttccctgcggagaactggcaatcaaaatcccctccaaagggaactaaagattaatatacccctttttttagtccttaatatggttctgtttttaatacagttccactcctgttgcaatgttgaatttaatgtttttttttaaatga

SEQ ID NO: 708862 - DNA, 338 bp, Homo sapiens
gtatccactttggaggctgaggcagacggatatctgagcagagtcagacagacggacatatgtgaacttgttcttaaatataaaagtaggcggcgcgtgctcacgctgtatccggcacttgaaggccagggagtgatcacaaggtcaggagatcagacacctggctaacacggtgaaatcccatctctgtaaattactaaaattagcaggtgtggtggtgggcgcctgtactcccagctacgtgggagactgaggcaggagaatggcatgaaccaggaggtgagcttgcagtagccgagatcagccattgcacgggtccgagctcaatcgtaacatgg

SEQ ID NO: 708863 - DNA, 755 bp, Homo sapiens
gattggtgccccggggcgcgggaaataagtgtatacttgtcacggggcaagggggggtttttctttaagccaaagccagggcgcctggggtaagccaaatcgccaataatgtgccctccattaaggcccaagcagttccttgaaggtctagaggggagggggaaaagacgcctgtagaaataataaagccccccaggattcccttccccaatggagtccaaaaggtcgtagttttaaaggaaaaggaaagggtaataagctgcccagcctgggtttggtaaaggaaaagtcccgtttcagggcaagaaaacgaaatttgctagtgatgatgcacctgatgaacctgatgaaaatggggcccctggcccttgtaaaagagcaaaagaagaacccgccaaagaagcccctgcctcccacccacagaaaaccgaaaatgggggtggggccccgtagtttagtaaacccattttttattccttttaaaaagggtttaaacgacttttgtttgcggggcttttaaaaggaaacccgaattaggtccccttcaatgtccccccgggagaaaggaaaaatttttttgttgtttaacttgtctttttgttaagccaaagagatttctttgaagggattgttctgtttgggttttttccgatgattccaaaatccaaagggagatttttcccttaaattgcctttgtaatatgggaaggttttgggcccacctaccttattaaatttttcctttttggaaagga

SEQ ID NO: 708864 - DNA, 145 bp, Homo sapiens
acagtggaaataaccgcactctcgtctacagaatgaatacgcgcgatagtacacattcaagaattcaggacggtccgatagcgggataccatcgataatgggcataatcgacaggtgaatgtccgcctccccggcctgcgaggtt

SEQ ID NO: 708865 - DNA, 330 bp, Homo sapiens
ggctatagcggtctcttcctagacaggtacctatcacgatactattcatattcagtatcacacaaaccaatggataggtttgaacactatttaatccccatatcattcacccggaaacttgcttcatgaatataagaaatattggccaaagtcatgcactactgagtggcaaagtagggaacagaaaccaagttttagggctcaaagccacactcatgaccactgaccccaactatatctctgcctcccctgctaatacctacccaaaacctgcctgatagatgcccttaagtccaagcagaagaagtactaactacattcctttacttc

SEQ ID NO: 708866 - DNA, 212 bp, Homo sapiens
tggtgcttgaggatccgccacggtagatttatacaacgaaatattatacaaaaataaaaagaaggccgggcgcagtggctcacacctgtaatcccagcacatgaggcaagtggatcacctgaggtcaggaattcgagaccagcctagccaacatggagaaaccctgtcactactgagaaaaaaaaagaaaaatcacctgggcaaatctaccg

SEQ ID NO: 708867 - DNA, 669 bp, Homo sapiens
ggtcttataaggaaaaatttgttaaggcctctacagaaaccacgtctggtgcctatggatggactgttgtttttagtcctttggaggaacaaagtttcctagtgtttaatatctattattattattttaaaagtaattttaaaaatcctcggggaatggctatgaaaaagataagaagaaagtagtgatttttaaattttcattctattccctgacttttggctgtataaattttggtagcagtcttgtggcctagaccttatttatcaagccatagtctatttgaatagtaaacccccaaaaatctggttttatggctgacagatctttaataaaaatgaatccctctgcccctttctcattaaacatttgctggggactttttatgtactggctatttgtacttggatgtaggatgtacatgtgagatacagctatgcccttgctagtgagtttatattctcgtgtaagagctcagtaagtaagctagtcatcacaatgaaatgggataagtactgtgccggtgagtagggtgctgtgaaagcatacccctgtcttgtgaagagagaggggcaggaagtcttcatggaagacagaatgtctgaatgatcagatcatttcacagatagattgagaggtaggaacaggtaatttagttgaagagaataa

SEQ ID NO: 708868 - DNA, 424 bp, Homo sapiens
tcttcctgatcagggaagaaggcccgggacctttttcgtcgtcgctcaaagagcctccacaatctcaggacgacggttcagcatcctctgtctgtgctgcgtgtacattccaccaaccaaaatagcagttttaattcctgtaaacctggccacagcatcattgtgctgtttgacctgtacggtcagctctcgagtgggagtcagaaccagtccaagctgaggacgctttggatatgccttacaggtgctgcttttgtcatccaactcttgttccagatttccagtctgttctttatcaagatttgcctcctccaagtaacaccgaagcaccacctggagagaccagaactgaggcccggagctgagactagatcaccaggcaaggcttgatgctggagtctgatgcattgcctgacgatacttg

SEQ ID NO: 708869 - DNA, 592 bp, Homo sapiens
tacattttcggacctctcaagttcatacataaaattccaactaaaagagtttcatatccataattcatttttagaaaaacaaaatcttttcctttaagagatggggtatcattctgttgcccagactggagtacagtagcatgaccatagttcactgcaacctcaaactcctgggctcaagcgatcctcccacctcagcctcccaagtagctgggactacaggcgcccaccaccatgcccagctagggtgttgggtctcactggatttcaatattacatcttttattttttaagttttaaatgttaattataacacaaatacagaaaaccacagcagttgacattctattctgttaccaagagtcttcccttattctaagttaatggtcaccattgacccatgaattttaatttttctcaagggttatcatcctttactgtccttaattatttaggtgtctaaatggtctcagattgggccagtaggaaccccctcaagatggatcctgtgtgtgatatgaccccatcttttttttggtcttattatttaagacttcattactttctgatgtaccaagctgttctgcatcat

SEQ ID NO: 708870 - DNA, 155 bp, Homo sapiens
gacggcgcctcctcctatcagcagcatagccgactccaccatgtccctcaaaatacgtaactgtcacgctcaacatggaaagacatcacttaactgggcatcagcatcgtggggcagagcaacgaccgtggagacgagcggcatctagattggct

SEQ ID NO: 708871 - DNA, 142 bp, Homo sapiens
tgcttaccaagctgggccgcgacgacgtgctgctggagctgggacccagcattgaggaggattgccaaaagtatatcttgaagcagcagcaggaggaggctgagaagtctttacaggtggccgctgtagacagcagtgtccc

SEQ ID NO: 708872 - DNA, 223 bp, Homo sapiens
cgctggccccgagttaggtccagtaacaatacaagcatacaaatttcacatcttcagcacaattaattagacacagactacagactcaatacacctgtaagtaaaaataataaacagcaaattccaagcacagctatctcctgaggtcccactgcaaatctttgtggaaagtgaggagaatgaggaaatatggtatggatgagagatgagcagtccaaagggt

SEQ ID NO: 708873 - DNA, 110 bp, Homo sapiens
catttgtctagtacattccagtttacaaagtgcctgatatacatgatctcctcttattcttgcacccattcctgttaaggtaggcgttggcatcccccatttgccagtga

SEQ ID NO: 708874 - DNA, 861 bp, Homo sapiens
ggtctgcggttaatcgcaccagacgcgcagcaaccgttgcgggtatatgattttgtgtgcgatcgcggcgagtcgaaattcatccagatttattcccgcgtggtcgtagcgcctggcatgagtgaaacaacatgcgccgcgatgtgacttaaatgtgtacatggcgtgcctaggtgtattattcgacgatggtagaagcttagacagtggaataggtctggtgcagctcccaggaggaacgttcggagtcgagtttactagggtggcgatattcggaccactggatccaacacgcagtacgtcgtgcgaaggattctctccgctagagtgaactatcgagaatgcggcgttctgccaagttctgtcggtgcggccggtgtgcgggtttgccatctatcagacaacctgtgggcgctcggtgattcgttgagcacaagcggctagcgtttacgcctgtgatcactatgtttatccggcacatatcggctgtgcggaatatgcaccagcaaacaattgcatgaaatgatcgattccccgcaacagcatggcgctgaggtgacgataaattcaaggcagtataccggacggcagatgtctgacagcttgtaacgtgttacaacgcgtgctgggggatggctgcccgagaataccgtcttcatagctcgattgcccatgcgggcaaagcgggacctgaagttatcttcgtgatgccgggtatcagcggtattctccgccatctagccgccatatcttcaaagacaagtggccgtgataatgctggcgcacggtcggcccgggaacagccgacattcattgcatgcgccagttgtgcatggtgggtggagtaagctaggaaacatc

SEQ ID NO: 708875 - DNA, 164 bp, Homo sapiens
gcacttttattttagattcagagggtgtatgtgcaggtttgttacctgggtatattgcatgatgctgagctttggggtacaaatgatcttgtcacccaggtactaagtatagtacccaacagtcggattttcaaccactgcccacccccttctgtcgtcttctc

SEQ ID NO: 708876 - DNA, 673 bp, Homo sapiens
  misc_feature (611)..(611): n is a, c, g, or t
ggaattcggcacgagggctatcatttctttgtcttaggaatgtcaccaaatacaaaatgctcaactttcaggtaaccataggtagggtgagaaaaagctgtgatactattggcctcaggataaattattagaattaaatatatagaccataatagacctaagaatataaaagaattgggtatattataaacatgacatttcagatctattagaaaaggtgggattattaaattatattgggatagctcggtagctatatcttgagagaaagaatagacctatacctcataacctgtatcagcacaaaatgcagatgaaataaagatttacatattcaagcacataaagtaacatacaacaggactagcaggcacagagaatggagatttatataaatttagtgtgacagaagcctttctttgagtgacaccaaagtgaactaacagcttggaaggatgggtggcatttgagtgcataaaaatgctatactcctatatagtgaaagcaaaccaaattgtgagaacaatatatgctacagaaagttagatctcaagacatacttagagcgtaaacaccacaactttggggacattagcatgatctacaatacncctctcaaacaagagtttccatctaatcttttcttaatgaacggtttcatttggtagttgcc

SEQ ID NO: 708877 - DNA, 187 bp, Homo sapiens
tatgctacacatgttaaaagatctacactcctctgccatgtgtatttgatgtcatgtgtcatgtattatatcttcacgtctatcctttgtatattgtagttatggttgattttgcaatttattgtcttctagggtttttcctttcctataaattcttacttcttgtgtagccttttctttttccact

SEQ ID NO: 708878 - DNA, 745 bp, Homo sapiens
gcaccgctgatctgaactgctgatgcgccaaagtctctaaggacagaggctgcccattacagtacataacgctcgaggtaccatgtccttggcctgatgatagcgaagaatcatcgcaactcctactttctagacacatcacgatagaggtgcattcacagctcgatcgcgctcgcgctagctgctcgcacctgagtatctccacatttccccacctttttgtgaattgcaatatacgaggttcgaggcacgcaatcataattcaatctcaatagagtaagagctagtagtgctcaggcagtctgtagcggtatgacgttcttcgcatgtgcagctaccaaggtactcgcgagtagactacgtatgtgaggaatcatcccgcatctcatatttacaccatgagaccatatactcattcaatcttgcttgaacatgcgcggatacaacagataccttgatacgccttgtacacaattgattacccagtgctcgtcacaggcttatgtcgacaatatttgacgttcaccaagagagtctctgtgcaacctaccagcgaccaaaaccggctactctcggagccagacgtccacaatttccacaattgctagccaacatacacctatgaccaacaactcgtcgttgcaacgtagcgacggatctattctcattgtaaccttactagccaaatccttttgtaacaacagaattgttcagcgcgggaccaaggttattgtcataccccgaa

SEQ ID NO: 708879 - DNA, 167 bp, Homo sapiens
gaagccagggcaggtaggagcgccctgttcgcgggcactgagtggcggcgacccatcataccagtatgtcgagtccgggaacgacaagaactccaactacttcagcatggactctatggaaggcaagaggtcgccgaaagcaggggtcaccagcatgagggcatgcc

SEQ ID NO: 708880 - DNA, 296 bp, Homo sapiens
ggctatcatattatatcacattatcctttttttttctccacaactttcacagataattcttagacatgcctcaactttctgacttgccgcaaacacctttttttttttgtgaaatggagtctccttctgtcgcccaggttgaagtgcggtggtgccttctgggctcgttgcaattctgcctccggggttcaggccatttctccttcctcagcctccgtgagttaggtggggcaacaggcacccgccaccctttttttttctccacaagtttcacagataatgtgatagggtcccga

SEQ ID NO: 708881 - DNA, 463 bp, Homo sapiens
  misc_feature (6)..(6): n is a, c, g, or t
  misc_feature (78)..(78): n is a, c, g, or t
  misc_feature (85)..(85): n is a, c, g, or t
  misc_feature (105)..(105): n is a, c, g, or t
  misc_feature (150)..(150): n is a, c, g, or t
  misc_feature (199)..(199): n is a, c, g, or t
  misc_feature (209)..(209): n is a, c, g, or t
  misc_feature (215)..(215): n is a, c, g, or t
  misc_feature (227)..(227): n is a, c, g, or t
  misc_feature (424)..(424): n is a, c, g, or t
tttttncatttttctggaaagatgttccaagcaaatggacctaagaaacaagctggggtatccattttaatatctganaaatttnatttcaaactaaaactaatnatatgggataggggaggacactacatgctcgtcaaaggaaaattnaccaagaggacattttaattctgaacatctaggcaccaaacacaagggnagccaatttntaaaanaaatattactanaggttaaatcatacactgagcctcacacactgatagtgggaaacttcagtacccgccactcaccaagaaataaagccaaccagccatgtgagatttcaggtaagtggccactggtcacttccccgtttgggcccagggtagcaggcagacgattagacgtgcccagccattgagctaaacagtacattaaaaataancttctctctgtgtgtgtgtgtgtgtgtgtgtctgtgtgt

SEQ ID NO: 708882 - DNA, 247 bp, Homo sapiens
acataaagatctttgaacatcacctacgagattattatgaaccagtagtgtaaattgaagtgattgaaatcatgactagaccgaggaagtggcaagaaaaggggctaagccatattgtaacctattgacgaccatagactaccgtgaatacgattagtcattcagaaaataccatactagtggataggccacaacatgtaaagattagacaaggccctgtacaaagacaagagataggctaagtagc

SEQ ID NO: 708883 - DNA, 396 bp, Homo sapiens
agccggcccggctgagcagctggagctgcccccttggagatacatgcacaagcgactccccaagccagctcccaccactttctggtacaagttggctctaatgttgagcagaatattgggagacactattttaggtatttatataccatatagcaacgatattttaacagattctccagcaaattttctagagtccagactattttctcatagccaaatttcacaatgactggctctgaatgacttattttttaatatatatcctattttttatgtagtggtcatgcgtagcctctatctcgaatttttttctatttctcctccccacaccatcaatgggactattctggtttggcggtattcactagttcttaacattggtacaaagtttgtaca

SEQ ID NO: 708884 - DNA, 1403 bp, Homo sapiens
ggtggtgctagttttctctaagccatccagtgccatcctcgttgctgcagcgacgacacgtctcttgctgtccgacatgactgatcagatgacccttcgatggcgacccgtcgaagggccagaacggctgggtaacccaggatcgatacgtaccccgtagtgtcccggacagtgatccgtcgtcgcgcgctcttcgagcataagaccatcatcatgtggaaactgaccagggatgagagcaactatggaattccacagacgtactctgcggggtcactcccacttatgtcatgtgatgtggttatcatcgctcagatgtgacagtatagacgctctcaggcatccatgggatgtgactcctgacgtcctctgggatctcacaaaggggcaggcagcacgaggagatcaagtgtggccataccaaggatgtgctgagtgtggcttcttccttcttgacaaggcgagaagaattgtctctgggatctcggagataagaaacatcaaaggctatggaataccctgggtgtagtgccaacttacactgtccatgggatgatcagccacatcagaatggagtgtcttagtagtccgattctctgcccaaaaaagcaaagaaccccttattcattcggtctcctagtgggcatgtgcgacaagcttggtcagacacagtactcggagaggccttgtggctaagcatgccaaggctcgaaacaaacgaccacagcattggggccacacacagggctattttttgaacaccgggtgcactgtcttctacccagatgggaatccccgtcatttgctttctggagccacacgcattgtccacaccgaccattgcttatttatagacttcttccaacacgaaaaggtgaacaccacccgtattaggagcggcttagaatgtgcgtttggggacacttccactcaaggccccctgatgatagcagcctctttatccgaatacatggttagatgttgcctgccatagggccctcaagactcatgaaatctgcgaactccaggagcggaaaggacatcattgtacgactagacctgtaaccgcagcgaaagctattacgtgaagccaacgctacactgggtgcagtaaacccatccacccaggtgaacacctctcccgttgggcctgttatttgacgaacgtcgcacagaaccatggtgttagtcaggagcaccacagaggaaaaacccctgctcacatatgttgtgtaacgctgtcccaattgtgcacaaagcgtaacaagcttcagttgcataacatataccacattcaaaacaaagtgtgacaacaccacaaaacacatgcaggaatatattgtggtgtggaagacaagcgtagatatgggcatggcactaataggtcgaccacaatttagtcc

SEQ ID NO: 708885 - DNA, 738 bp, Homo sapiens
gagcacgccccgcctcgccccggcggcagagaggagactatggaacgtcaggtgctgctgagcgagcccgaggaggcggcggctctgtatcggggccttagccgccagcccgcgctgagcgccgcctgcctgggccctggaggtcaccactgcagtactggctggccacatacctggacggtgcacacgtgagtggacccatgagggaccatggaacgcatggcagaacattcagatatctgccgccaataaccgtggtgttccatagacgtgggactcacgtggtgtttagcaggacctgcagtgcaacaagtgtggagacccagggggagaactcgctgacgcagacgcgtctccattcaggacaccactgaaagctgtgcttgcgcaaggcctgcatgtgcactgaggccctggcggaacgacgaacgcagttcctcggaggtcatgggagcaagaaccaggaagctcaacgagcttcaacctgtcagcgctggagacaacatgggcctgatcatgaggatgactgcttaggctgcctgtcctggtcgcacatcggagacacactatgtagtatgtggcagagaagaagcgccccaaggcacgagtcacatactgaacagacaaaagcctaggacacgtcaagagccagcgacgatgagatagccaggctgaagaagccagacacaagccatcaaggagggatcagcaaagagcaaacgaagacgggggagcaca

SEQ ID NO: 708886 - DNA, 178 bp, Homo sapiens
ccccattcattcagaagaaacaagaagaaaagttattttcttttaacacaaaacaggaattcactattgttcccaaaaaaaaaagcacccaaaagaaaacaaaaaccaaacccctattgctgacactgatgttcagtcccctgaaccagtgccccaaaggccattgttcaaaattaaa

SEQ ID NO: 708887 - DNA, 343 bp, Homo sapiens
  misc_feature (70)..(70): n is a, c, g, or t
gatacccggatgtcgcggataggtaagtttgataagggagtacatgaagactgatcactatagggcatanagaacagtgctacttactagctgggtagactgggagaggtggtagtaactaagttcttgatgatcccacttcctgtttccctctgctatgggatataccagagtttaccacaagtgttctgacgatatactcctgagctttcactctgctgcttctcccaggcctcttctactatcgtcatggagatgtggtgtgctgttgcaaagtattcacgtcatcgtttcctggcttgttcatttcattaagtggctacatcttaacatatgcatttgg

SEQ ID NO: 708888 - DNA, 194 bp, Homo sapiens
gcacgcatttcattcatccatccagtggctggcacggtgcagggtgtgcaccgccctgccggcgccccagtccctcggcaggccggcgcgtggtcagtcccggctcatgtcctcctcttcgtccttcttgtccttcgtgtcgccctctttctgctcgggcttggccttgccatcatgcacgggtcaccgcagct

SEQ ID NO: 708889 - DNA, 773 bp, Homo sapiens
gtccattcacagaatggacaaaaacagtgtttccaaactactgaatgaaaagaaacgtttaactctgtgagatgaaactacacatcacaaagcagtttctcagaaagcttctttctagcttttatctcaagatattttctatttcaccataggcctcaatgcactcccaaatattcctttgcagaatggacaaaaacagtgtttcaaaactgttgaatcaaaagaaagtgttaactctgtgagataaatgtacacatcacaaagcagtttctcagaaagcttctttctagttttatatgaaaatatgtactttttcatcatagatctcaatgcagtcccaaatattccctcacacgatggacaaaagcagtgtttccaaactattgaatgaaaagaaagtttcaacactgtgagatgaatggacacatcacaaagcagtttctcacatagcttccttgaagtttttatcccaagatattcactttgtgctccatgtggcctcaatgatcaccaaaatagccatgtggcagaatggacaaggacagtgtttacaaacattttgaaataacagaaggttttaacactgtgagatgaaagaaccatatcaaaaagcagtttctcagaaagcttctgtctagttattatggaagatatttcctttttcaacatagaacctcaattgtttccgaaatctcctttgcagattctacaaaaacagttttccaaactgttgaatgacaataaaggttaactctgtgagatgaatgccaatg

SEQ ID NO: 708890 - DNA, 120 bp, Homo sapiens
ctgtagtcttagcctctaagcataactatcttccacgttatcacaaggttcaactgccccacatactatatagaagatgtggggcagttgaaccttgtgataacgtggaagatagttatg

SEQ ID NO: 708891 - DNA, 589 bp, Homo sapiens
gccaagtaccttcctgtgtcgtgtgccctccattactgtgcatgattccgtccaggtgtgtaatggtgacaatgcagctgatcggaaagtctcttgtctggggcaaatagaaggggttccggtagtgcgtgctcgtggtcacgttcggtcatccatccgctcgttttccctgcctaggagctcaaccacgcttcatttggtaaatgttgcttgggagcattgtacaatgggtggggcagtgagctacagaacaggatatggctgagagatggtcgatggaaggagaaagagctcattgccgtggtatccgttggcgaagaaggcatgtctactaaggaggttaggtgacgtctcagtaatacttactaaaatttctcacgtgagagtgccttctactcgttactaccacactctggcgatagagtacagggctgtgctggtccccgtctcaattaccataggatttatctttggcccacacaattgtgatccatgttaatgccgagctctcccctgtttcttttccagaaacaaattttgaacacactctgattgctgagggggacaacaaggtgtgtccgtctcctgg

SEQ ID NO: 708892 - DNA, 310 bp, Homo sapiens
gtggagtctcctgagaacattctaggcgtccctgggcgaacacgtgctggtcttgtgtgctgcgccatccacactttggcacaagaattcaccccacccagtgcaggctgcctatcagaaagatggtggctggtgtggctaatagcctggccccacaagtatcactaaggactcgcttttttgctgtgcccaatattttattaaaggtgtcctttgttccctaagatcccaactactaaactgggggatattattaagggccttgagcatttggattttgcctaattaaaaacatttattttccttgcca

SEQ ID NO: 708893 - DNA, 257 bp, Homo sapiens
caaatcagaattgtagccagtttctttggccagaaggataatacttggatattactgaaaggaggggtggagatgggtgtggcagtgtctggtgtgtgatttttattttcttctttggtcatgggggcaaggagaaaagcatgaatcttccctgtcagctcttacagccacagcattgtgtctactgtctggaagacatgtccccgtgactgtggggccgctgctcctgtttaaataaaagtcggctgtggttaaga

SEQ ID NO: 708894 - DNA, 345 bp, Homo sapiens
  misc_feature (10)..(10): n is a, c, g, or t
cccgtattancggatataatggtgttgatagattaaataacttaaaacaggtcatcttaaagcttacaaatatactcaagaatatttaaaaaacagaaaaacaaaaaacaccaccaccaaaatcataggttgcgcacggtggctcaggcctgtaatcccaatactttgggaggacaaggtgggattataggcgtgagccatcacatccggcctctactgtttttctattctctgttttatttatttctcttctaataattatttcctttataatgctaactctaggtttggttcattctttttctaattcctacatttgtaaacttagcttgttgatttaagatc

SEQ ID NO: 708895 - DNA, 1092 bp, Homo sapiens
ggcacatgtaaaagtgatgatttggaaaagcttcgacctatgtgcacacccacgaaacccttcccatggtccacggtgaacctcgtcacccacagcatgtcctcctgcctgtgtcctcccagccccttgcaccctcattgctgttcagattaaagcctctgttttgcacctgtcaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaccaaacaaacagaaaaacaccagacgaaaggaacaaaacacacccaacaatcaaaccagagcgccggggcggccgccgtcaccccaatcacccgggccgggcaccccacaccgccaccccgctcctatagttgccgagcgacgcacaactgctgcaggaccaaacataccaccccaccaccgcacgccccccccactacagcgtacgactcaggaccacaaaaattaccatcaaataattccaatctacaccacacaacaacacctccctcctgcggacacactaaaaatgaacacaacaacacccactccatcacaaattcaacctacctaccagacactcacatactcctcctctctcttctctttccactagaactcacgccaccaatctgctgcttctcccgcatcaacaccacacaaccccgctctacaacaaccatacaaaaccatcatctgcgcttcctattcatcatactctccccaccccatcaccttaacgacaattcatccacgtacagcgattacacacagacaactactccctagcctcccccacaccaataatacataccctacctaacatagcaccacaacctaacagccatcacacaccaccatacccaacactaactactccctaacacaacacaccaacccccaacaaccaccacccacacaacaccacaaaaacaacacacactgacaaatacacaactatcacatcacccaaaccatcacccccaaactcactctaccgtccacactcacacaaactcaacacctcccacaccccatctccaccctcctctcccacccaag

SEQ ID NO: 708896 - DNA, 280 bp, Homo sapiens
ctcatcttcattttcttcttcctcctcctcctcctcatcttctggttcgttcttcttcttttgagcctcgttggcggccagggcccttctttctgttcatttggccttggacgatatgcagaatatccttttcatattctccttagcttagtgcttctgtcatatggcgttatctttggctgatgctcagacacatttacccaatttctttgcagtatccccaatggataggccagggtgtgcactttttgatctcttgggcgatgttcaagagcaaaaa

SEQ ID NO: 708897 - DNA, 977 bp, Homo sapiens
gagctagtctgcggacgctgtataccctccgccatttcccggtggatccaataaaggccgattacataccagtagtcatgtgtgttcgcgtacatttgttccgggactgcagagcttcggggagagctgatagcagccgcctgttcggatacgcaggaaatttgcaagagtcgttctcgccgtggatcctcagggccgtcttctcggcttgtgatgtaggaggtggagcggctatcacaataacgcttcgtctggcgtctgaagcctatacgcgccgataatctccgaggagttggctcagcagcttagaaggtcgtgaaatggcatcacagcgatatgcacgaccgacctgagtgcaatgggaaggacagatgacacggcccccgttttgccagggtcatcagcttggtcgtgaataggtgtgccatggccagggtaacacggatggtcgtcatgggaaatcgagtcatgacaattaggcaccgaagtcgcattcgataatttgtgggccaactttgtttccgcgcaattccttgttctggaacttggagatgtaagttgtataggcggattcacccggaacccggaagaggttcccaatggggtggacattcccgttaaccatggcccgaattataggcgttggccaaacgtggaacggggacacaccaagtgtggccttagagcccgaaggtaccgcattcatttgaccagaaaggattcgcgcttcggcggcaatgcggttagggggcgcctgtggttcgacgaggcaaccgttatccgccaatggaccaccttaaattggattaacaccaaatggcgaccccagtccaataaaaagaaacccgagaagaatatttctgtacgccaaagctaagagccccaaagcgtttgggggaaagttgggttggccatttgggaaagaagcagcatagggggaaaccggatagtcataatccgattcacccgatagggtg

SEQ ID NO: 708898 - DNA, 450 bp, Homo sapiens
accactgctcgaaagtgctgcagcacttgtaagatggtggacatcaggaagttgagcaacgcccagagctcgggaaggttgttctgcagcggtgtacccgtcagcaacaggcggcgggttgccacatagtacgtgttgagcccctgcgtcagattgcagtggtgattcttgattcggtgaacttcgtccacaatcatataactaccaaccggatcttggcgatgatgtgcttgtctctgatgatatacacgaacgtcgacagcaatacgttgaacttcccactccggagctgagggaacaaaggcccgacatagcagctggggatcccttgtaagaacaccttcagcaaggaaggggcccacttgtcaaactcgtacgcccagttggacaacgatgacataggcacgatgatgacgaaggggccatttatgcgtttgtggtccatgaggt

SEQ ID NO: 708899 - DNA, 639 bp, Homo sapiens
  misc_feature (91)..(91): n is a, c, g, or t
  misc_feature (139)..(139): n is a, c, g, or t
  misc_feature (150)..(150): n is a, c, g, or t
  misc_feature (163)..(164): n is a, c, g, or t
  misc_feature (183)..(183): n is a, c, g, or t
  misc_feature (187)..(189): n is a, c, g, or t
  misc_feature (201)..(203): n is a, c, g, or t
  misc_feature (207)..(208): n is a, c, g, or t
  misc_feature (212)..(213): n is a, c, g, or t
  misc_feature (225)..(225): n is a, c, g, or t
  misc_feature (233)..(233): n is a, c, g, or t
  misc_feature (235)..(235): n is a, c, g, or t
  misc_feature (253)..(253): n is a, c, g, or t
  misc_feature (272)..(272): n is a, c, g, or t
  misc_feature (298)..(299): n is a, c, g, or t
  misc_feature (362)..(363): n is a, c, g, or t
  misc_feature (389)..(389): n is a, c, g, or t
  misc_feature (391)..(391): n is a, c, g, or t
  misc_feature (399)..(400): n is a, c, g, or t
caggtgagccgaggagcggagacacggacccagcagggtcacgcgggatggagactcgggacacccactcgctggctgccaccgggagcanaggggggctcgtgcctgccccctcccacatcagtctccagacccttgngtgcttcaganggccgctcctagnnctcctcggagtgaggcgcnggtnnntcttcttttccnnnaganncaannctttcctcggangatgcctngncatggatgatgccgcggnccccggagaggacgggacngcctctgatcgccgcctgcgtgcccnngccactgcccatggccatggaggccccagggaacggacatgcccgacctcttaggcgcctggnnccctcaggctcagatcagtggccgangnccccaganntttgcagaactcagctctggagttcacgcaagcagacatgcaagcaagggaaaaaaagccctgcgccccttggctcgcggggctggcacgctgagggagcagccagaaacgcagagaacgcaaagcaaccgaagcaaggacggggaagcacacacgagaggacccggcgcacggggcaccgcgggcccacaacccgccgacggcaggcaccacacgcgcgaacacgaacaaccacgccc

SEQ ID NO: 708900 - DNA, 430 bp, Homo sapiens
agcatccgtaccggacatgtgctgtaagccagcggttaggcttggctctgcgttgctgatcttggtcgattggttcaaactgtttttgaactgttttcccttaaagagaacataaagcttttcaaggttttggtatgagaattattatttttttagtttctgtgcctaggtatagagggagtactgttttctaagaaaccgttcttggaagcaatgtttctgcgtatcttagagctctggctggtttacagtgcatataagttggggcagccccagcccccagtgaggcccctgtagcagaggtagagaccgctggcagatgctgttttacacacgccaatgaaaatctttaagctgtcaaacccagagctcctcaaactggctctgaaattatgagattagcatttactacgctggcctacagcacatg

SEQ ID NO: 708901 - DNA, 895 bp, Homo sapiens
ttcggggccttgcctgtgggaaaaacctgctgctcctgagcccagagtacaggaagttcaagagccgtttagccacgaagtcctattaatttaacatccctccgttaactgaagggccaggaccttgctgtgaacgtcctcctagggcgtggctgtcgacagtgagggacagaactgctagatgagcagctaggtgggaggctgcggggcactggcgagatgcctacttttttttttgagacagagtctcgctctgtcgcccaggctggagtgcagtggcgtgatctcggctcactgcaacctccacctcctgggttcaaaggattctcctgcctcagcctcttgagtagctgggactacagatgcgtgccaccatgcccggctgcttattaggtatttttaacagagacgggatttcaccgtgttagccaggctggtctcaatctcctgacctcgtgatccgcccgcctcgacctcccaaagtgctggagattacgggcctgagccacatgtgcctggccccactgctggtttttgatagaatcaagttgctaaaggagacctgagcctggctagccgaaggcatgggccccaggactgaaccagcaggaagagactgtgggacaagccagcccaggagggcggaaaccctaacgcttatccgaaggagagggaccgcaggcccatccgggaagtaaagcagaacctgggccccgtggacgaaggggtctatacctaaagcccaacgcgtgtatggcaaggtactcactcgaagaacgcaccactggtgcctactagggaaggcgacatcatttgagagacctcaggcgattatcactagtaccgaggacaaagagagcaggcgactatgagcgcctacatagaaacaagagct

SEQ ID NO: 708902 - DNA, 413 bp, Homo sapiens
taaaggatcccccgccgctaccgacgcaaacatgcacatcattataagcaccctgacttgataaaccataacccttgaggtcgagcccagtgacaccattgagaatgtcaaagccatgattgaacacagggatggcttcccacctgaccagattaccatgatatttgccggcaaacagctggaggatggccgcactctctcagactacaacatccagaaagagcccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtccggcgtccgtaacgg

SEQ ID NO: 708903 - DNA, 412 bp, Homo sapiens
agagatcccggtgtttccttagacttgctcctctcttgatacaccctacgcttattaataggttcgcttcatatcatcgtctccatcttctataattttctttataacattcatcaatccctcactaagatctagtttcagattcatatgagtgcttcctttaaaaagaaaacatatacgacaatagggaaactaaagcaccgtaagatactatcattcaggttgttaacactggccggcagttaaaagatgagaaggaagtacagagtacccaaagattattaacggatcaaaacggtacgcacaaattcatcttaatgaaaacaacacacacgtatcaggcatgcacacacttggtgcacgaaagaggtcatcaaaatagttaggggctatttatagacaaagggaaaca

SEQ ID NO: 708904 - DNA, 695 bp, Homo sapiens
tcaagatcctgaagcatttcttgaaaaaattaaaacagatgaaacatgtctttaccaatatatcctgaagacagggcataattaaagcaatggctaccaagaggtggaagtggtccagtcaaagcaaaatggactggtcatggcaacagttttttgggatgctcaaggtattttgcttgttggttttctggagggccaaagaatgataacatctgcttattatgagaatgttttgataaaaccaaagctttagcagaaaaacactagggagaaatttgttaaagagtccttctccaccatgacaatgctcctgctcattcctgtcatcaaacaagggcaatttttaaagagtttcaatggaaaatcaatatagtcctgatttggctccttctgacttctttttgtttcctaatcttatattatgaatgtaaaaaattatttgtttgtttgtttttgagatagtgtcttgctctgtcacacaggctggagtgcagtggctggcacaatcttggctcactgcaaccttgacctctgggctcaagcgagcatcctacctcagcctcccaagtagctaggactacaagtgtgccaccatgcctggctaattttgtttattttttgtagagatgagatctcagtatgttcgccagtctgggctcaaactcatgcctggtgacacagtgagactctgtctc

SEQ ID NO: 708905 - DNA, 687 bp, Homo sapiens
cggacgctacgaaacttgggggagtgcacagaagaacttcgtggagcgcacgcgggacctaggaccaggctgagactcggggcgccagtccgtgcaggggcagcgggagccggccggagatgccctgtatccaatgcccaatatgggacaccatgcacctgagtccgtggaccccgttgaccacctggcagagctgacccctcgtgtaccccctgatgttcatcaagcccaccatggacctcgccagccccgaggcagccctcgctgccccctactgccctgtccagcttcagctccttcttggacgggctacacaggagacgtctgagcaccttcctctaccagtctgccaggaacagtccagccatgctcctcagcctcctcctcggcctcctccgcatcctcgtcctcaggcacctcccctgcctctggctccttcaagttcgaggacttccaggtgtacggctgctaccccgggcccctgagcggcccagtggcatgaggccctgtcctcctagtggctctgacgtactatggcaagcccctgctcggcgcccgtcgccctccacgccgcagcttcgcagcgcggcccgatctctctccctgggctggctccttcggccacttctcgcccagccagacttacgaaggcctgcgggcttggacagagcatctgcccaaagcctc

SEQ ID NO: 708906 - DNA, 1243 bp, Homo sapiens
tccgatcgcttgagaccaggaagtcaaggctgtactgagccttgactgggccactgcactccagcctgggtgacagaatgagaccctgtctcaaaaaaaaaaaaaaaagggaaaatttatttaaggattaaagatgggcatttaaattaattgagaaaggggcaatttattccaaaaaaccattaattaattctcttataagtttattgcagggttaacaccagcattcttaaattacattgagaacaaaaattttattaaaaccttgcaagaaagaaattaatctcaaattttaattatttatttctaatctacattatttttcgggagagatctcttcaacattcccttattatttaattaaccaggctataatttctcaaccaaggcaggaaatctcagggacaaattgttctcaacctgtgaattagccacttaaccaattgtaaaccaggggactctataactgtgttctcagagttagcagccgagaaaattacatttaatctccaagttaacgagccagaaattacattattttccttcttcaaagtttctatttattgggaacttttattgccacaaattagaaccaacatttccgtggggcgcttgacaaagagaattgtcccttcaacaaatctttacaagagcaatttagaaagggttttataccgggcatgtggtgtcttccttagcacctattacgtgcaacatttttaaccttgggaaaactcgaggtgcccagaaagaaagaaactcccagaaaaggtttcccgcgaaaattagtttgctggagtacttaagtttaacctattaacttctttattttctaaacccacgtatttagcgtctccaacaacgcaaaaggaaagttccttcacagcgggcacaacctctctaccacagacttatctttccgaaaactttaaaacccaaaaacttgtcaaacagtggctgttcctttccaccaacttttatcgggcggaaagtggcctccagcggaaaaaaaaaactagctatgggggaacatgccctgtagggttcaaatacccctcggggtgtaccagcggcttcgacactggggtgccgggaagaaagtcccccattgtgtacccggttttaccttgtttttaaaaaaagcgtcacatcctgcgcattttcccgtggaaacggcaacacacgcgcgtttcacaagaagcgacaagagaaaatcctttttcccgcaacaaaaaaaatcatc

SEQ ID NO: 708907 - DNA, 99 bp, Homo sapiens
gaactgcagaatgtgttacagaaagagtctacaattggcatcccaacggagcagttggcgtgggaagctctaaagtctgtatgagactagcactactat

SEQ ID NO: 708908 - DNA, 390 bp, Homo sapiens
  misc_feature (332)..(332): n is a, c, g, or t
  misc_feature (375)..(375): n is a, c, g, or t
atatattgtatatattagattaaatataatgtattattcaaattaatttcttttgtttctttttactttttaaattttactctttagaaaatttaaagttatatgtagctcacattttgtttctgttggacaacactggcctacagaaatgagatgcttgtttcctctagttgctaagactctatcttgtttttcttgctctctttacaaactcaagttcctttaaagattcttcacgttgatataaggagcctgcttcctcattgccatttgggtgcagagttcttcctgtcagcccactcatcatgctcatcataccttggctgccgggnctctctatggctggatggactcgagggaaaacacggctcctcnggggttggcaaggag

SEQ ID NO: 708909 - DNA, 469 bp, Homo sapiens
  misc_feature (19)..(19): n is a, c, g, or t
  misc_feature (272)..(272): n is a, c, g, or t
  misc_feature (453)..(453): n is a, c, g, or t
atgccaataacctccaggntattgtgttcaaggaaggccacagcgtgatgctggtattcgccgcccatgagcaattgcaggaagggttgaccaagaccctgaaggccgtgactggcaaagccgccaaatggcgcaagggtgaactggtgaccttcaaggctagcgagtaggcgataaatacgctgtgcatctttgtcttttggaacctctactacagttgagttgacttaactattcagaggcttcgcgcattcgcagcaaagccgttcgcnatgactgcgaaaacgcgaggtgcacaggcatgaaaggattgaagtcactgctggcggcgggcctgacgaccctgagtctgtcattgccggtatcggctgcccaggcaccggtgcattttgccgacctgaactgggaaagcggcagcctgatcactgaagtactgcgttttatcgtcgagangggaggttattggcat

SEQ ID NO: 708910 - DNA, 345 bp, Homo sapiens
  misc_feature (19)..(19): n is a, c, g, or t
  misc_feature (27)..(27): n is a, c, g, or t
ccccctttttccttcccantgcccctncaaaaatttttcaaaaggccccctgccccctttttaacagggggaggggggtggttttaagcccccgggttcccccttcccctttttgggaaaggcccaacttttgggggggggcacaaacctccggggaaagggaaacccccggggtgtttacattttccggccccctttggggtgggggaacaacccttccccatgtgttccctctttccgccctgttttttgggcagcggggggggttggggatggggggcccccccccttgttggggcagggttggggggccccggggccccgttaagggcctttttcctttta

SEQ ID NO: 708911 - DNA, 121 bp, Homo sapiens
  misc_feature (11)..(11): n is a, c, g, or t
  misc_feature (28)..(28): n is a, c, g, or t
  misc_feature (32)..(32): n is a, c, g, or t
  misc_feature (75)..(76): n is a, c, g, or t
  misc_feature (111)..(111): n is a, c, g, or t
tactgtagcangctcccagaggcttggnggcngcagagacatggcatccagcttcatctcaaatcctttcccctnngtcttctcccagccttctttatacttaacctcacngaagagttgg

SEQ ID NO: 708912 - DNA, 305 bp, Homo sapiens
ttttttgggggccccttttttttttttggggcggggggtttaaaaaaaaaaaccagcggggggtttttgggggggggttttttcaaattccccggggtttcccctttttggtttttaactttccgcggggggcctttttccccttttagggggggggaggggggggtttttcccccgttttttagttttcctttttggggggccggggggcttttttcgggggggggggggttttggtttttttgaagggggtttttgtttttccccccccccttcctttttcggggtttcccccccccccctta

SEQ ID NO: 708913 - DNA, 611 bp, Homo sapiens
  misc_feature (552)..(552): n is a, c, g, or t
  misc_feature (583)..(583): n is a, c, g, or t
gggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaggctggtcttgaactcctcacctcaggtgatccacccatctcagcctcccaaagtgctgagattacaggcgtgagccaccacgcccggccagagatccacatctatatttataacacatttatggatgaaaattaaacaggtgtccgggtgcggttgctcatgcctgtaatccgagcacttgtggaggccgaggcaggcggattacttgaggtcaggacttcgaaaccagcctggccaacatggtgaaatcccatctctactaaaaatacaaaattagccaggtgtggtgtcacgcacctgtagtcccagttacttgaacctgggaggcggaggttgcagtgagccgagattgcaacactgccactccagcctgggtgacagagcaagagaccctgtctcaaaaaaaaanaaaaaaaaaaaacctcgagggggggcccggnacccaaattcggcctatagtgaggggat

SEQ ID NO: 708914 - DNA, 247 bp, Homo sapiens
tgtattcgtagatcggcaggtcatggtcaccactgacacgtgtgatgtggggacacggaagggcatgcagtgagcttcccgttcagctcagggatgaccttgccacagtcttggagcgctgtagaggcaggggatgatgttctggagagccccggggccatcacgcgacagtttccgggagtgtccatcgcacggtcttcatgggtggcagtaatggcatgcaactgtggtcatgagtccttccacg

SEQ ID NO: 708915 - DNA, 1692 bp, Homo sapiens
  misc_feature (1633)..(1633): n is a, c, g, or t
  misc_feature (1664)..(1664): n is a, c, g, or t
gggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtgatccacccatctcagcctcccaaagtgctgagattacaggcgtgagccaccacgcccggccagagatccacatctatatttataacacatttatggatgaaaattaaacaggtgtccgggtgcggttgctcatgcctgtaatccgagcacttgtggaggccgaggcaggcggattacttgaggtcaggacttcgaaaccagcctggccaacatggtgaaatcccatctctactaaaaatacaaaattagccaggtgtggtgtcacgcacctgtagtcccagttacttgaacctgggaggcggaggttgcagtgagccgagattgcaacactgccactccagcctgggtgacagagcaagagaccctgtctcaaaaaaaaanaaaaaaaaaaaacctcgagggggggcccggnacccaaattcggcctatagtgaggggat

SEQ ID NO: 708916 - DNA, 269 bp, Homo sapiens
agctcgactccctgatcgctgcctgctgagatcgcgccattacacaccagcctgggcaacaaggcatgactctgtctcaaaaaaaaaaaaaaaaggggggaaaaaagggggtttgcaacctcattttgccccggattgtctttcaaggcgggtgctttttttgtctgcaagaaaaacattcaagggggcgggggttgccccacttttccggggggatgcagttccttggggacacaggtgtttctgggggggccctgaccatttctcgg

SEQ ID NO: 708917 - DNA, 1663 bp, Homo sapiens
  misc_feature (1151)..(1151): n is a, c, g, or t
  misc_feature (1165)..(1165): n is a, c, g, or t
  misc_feature (1170)..(1170): n is a, c, g, or t
  misc_feature (1182)..(1182): n is a, c, g, or t
  misc_feature (1604)..(1604): n is a, c, g, or t
  misc_feature (1635)..(1635): n is a, c, g, or t
gggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaattctcctgcctcagcctcctgagtagctgggattacaggtgcgcactgccacgcctgactnattttgtatttctngtggngatggggtttcnctatgttggccaggctggtcttgaactcctcacctcaggtgatccacccatctcagcctcccaaagtgctgagattacaggcgtgagccaccacgcccggccagagatccacatctatatttataacacatttatggatgaaaattaaacaggtgtccgggtgcggttgctcatgcctgtaatccgagcacttgtggaggccgaggcaggcggattacttgaggtcaggacttcgaaaccagcctggccaacatggtgaaatcccatctctactaaaaatacaaaattagccaggtgtggtgtcacgcacctgtagtcccagttacttgaacctgggaggcggaggttgcagtgagccgagattgcaacactgccactccagcctgggtgacagagcaagagaccctgtctcaaaaaaaaanaaaaaaaaaaaacctcgagggggggcccggnacccaaattcggcctatagtgaggggat

SEQ ID NO: 708918 - DNA, 134 bp, Homo sapiens
acagaaactagaaaggggcaggagggcgagcattaccaaagaaataatataacagaatttcccggaggtaaaggacatagagtcttagacatttacaacggtctacaaagatacttcagcacaacaggcactgg

SEQ ID NO: 708919 - DNA, 637 bp, Homo sapiens
  misc_feature (125)..(125): n is a, c, g, or t
  misc_feature (139)..(139): n is a, c, g, or t
  misc_feature (144)..(144): n is a, c, g, or t
  misc_feature (156)..(156): n is a, c, g, or t
  misc_feature (578)..(578): n is a, c, g, or t
  misc_feature (609)..(609): n is a, c, g, or t
ccaggctggagtgcagtggcgcaatcttggctcactgcaacctccacctcccaggttcaagcaattctcctgcctcagcctcctgagtagctgggattacaggtgcgcactgccacgcctgactnattttgtatttctngtggngatggggtttcnctatgttggccaggctggtcttgaactcctcacctcaggtgatccacccatctcagcctcccaaagtgctgagattacaggcgtgagccaccacgcccggccagagatccacatctatatttataacacatttatggatgaaaattaaacaggtgtccgggtgcggttgctcatgcctgtaatccgagcacttgtggaggccgaggcaggcggattacttgaggtcaggacttcgaaaccagcctggccaacatggtgaaatcccatctctactaaaaatacaaaattagccaggtgtggtgtcacgcacctgtagtcccagttacttgaacctgggaggcggaggttgcagtgagccgagattgcaacactgccactccagcctgggtgacagagcaagagaccctgtctcaaaaaaaaanaaaaaaaaaaaacctcgagggggggcccggnacccaaattcggcctatagtgaggggat

SEQ ID NO: 708920 - DNA, 657 bp, Homo sapiens
  misc_feature (598)..(598): n is a, c, g, or t
  misc_feature (629)..(629): n is a, c, g, or t
cacgagggctatgttgcccaggctggagtagagtggctattcacaggcataattatagtgcactacagcctcaagtgatcctcccttctcagcttcctaagtagctgggactataggcatgtgtcaccacagctggctgatttttgtatttttaatagaaacggggtctccctgtattatgttgcccaggctggtcttgaactcctcacctcaggtgatccacccatctcagcctcccaaagtgctgagattacaggcgtgagccaccacgcccggccagagatccacatctatatttataacacatttatggatgaaaattaaacaggtgtccgggtgcggttgctcatgcctgtaatccgagcacttgtggaggccgaggcaggcggattacttgaggtcaggacttcgaaaccagcctggccaacatggtgaaatcccatctctactaaaaatacaaaattagccaggtgtggtgtcacgcacctgtagtcccagttacttgaacctgggaggcggaggttgcagtgagccgagattgcaacactgccactccagcctgggtgacagagcaagagaccctgtctcaaaaaaaaanaaaaaaaaaaaacctcgagggggggcccggnacccaaattcggcctatagtgaggggat

SEQ ID NO: 708921 - DNA, 410 bp, Homo sapiens
gtcgaccccttcctggtggcgagggacatgtgaagtcggaactgttcactttggggcagcctgtaaagagaataatatgaatccagctcacgttaaagtctcaaaagtcacatgcactctgatcagcttcatccaactagaatattactcctaaatgtccacagagctattattggtggatttaaccccataggaagaacatcaatatcaaacaaccagacccaccaagcttccagtgtctaaaccaccaaccaagaagtatacatggagggacctgtggctctagctgtatatgtagcagaggatggcctgatcagacatcagtgaggggagaggcccttggtcctctgaaggcttgatgcccgagtgtaggggaatgccaggacagggaagcagaattgtcgacgcgg

SEQ ID NO: 708922 - DNA, 241 bp, Homo sapiens
ctttttattgaaagtcactaatacatcctgtgaaagcgaagtaagtatcaggaccccaaaaccactaagccaaggaaaagtcaagctgggaactatgtcagacaaacctgtctcctggttttttcctaaataagatagctacaaggataaaaagctacatacctccctcaccatttgcccacaaggaaattccttgtggataaaggacggacagaactcagtcacccctctgaggttcacc

SEQ ID NO: 708923 - DNA, 1132 bp, Homo sapiens
ggacgctgctgctgtccaagtaccgactggggagtagctgtcacacatgctgtccgtgtcgcgttgcgtgcggccgtggtccgcgcccttcctcggcggaccggagtggtctccaggaaatgctattgggcttcactctttgcattgcatgcagaggaacttccatgccctctaagcacgtcatcctactaaaaaggacctgggacgtgcttgaggattgtcctcttagttctgtgaaggatgcgtattctttggagctgatatcctctgttgattcttgaagaaactgggcgtgtcttaagtagttgggtcgatggtattgcaccggcagtaccagttggtgcatgacggaactgttcattgctatgaagacaatgagtagagtatgtcattcagcgctttcaagggatatgtcccttgaatttggaagctgatgatgtaggggttggtccgcgttccgtggaaattgcatagagactaaatcttaagccaatggcatatgatagatcgaacgaatgcgatcagggtaggcaccttggaatggacgcaacggaaatggggtgcatggtagtcacgaggcgttgtgcatcgctaaagtaggattgctctcatccgaggaagatgaactctctgtcctgggggaactggggaagtcggcatccatgtgggaatgtctgacaacagagcgctgactaggggccgcatgtcgtgggactgaacacaaggcgctcgcgggttattaaaattaacaccatcggcacagtaaactgagtgggacacgcgataggatccccaggtggtgaatcaccttggggcaactatggaacgggggcattggtgcgggagctttatggggttgggaagatgacttcgatccttggcagatacatgtcatcggaccgcagggcttggagcacacgcaccgaattttctaggtcacgggctgaaagcggcggacccaggcacctttggccggagaaatacgtgctcacaatacgtgtgggacttcatatagagacagaggagactttccatttgaggaaacgcggaaaaaaccaggttcttcccatcttaaatgggacatgcatcgtgagagcacatgggtggatggcatcgtctaattacactcgat

SEQ ID NO: 708924 - DNA, 1475 bp, Homo sapiens
gttgggttattttgtggcttccttcgtgattggagccaggcctacacgccagacaaacatgtccaagggacctgcagttggtattgatcttggcaacacctactcttgtgtgggtgtttccagcacggaaaagtcgacagatcattgccacatgatcagggaaaccgacaccagtccaagctatgtcgccatttacggacactgaacggttgatcggtgatgccgcaacaggaatcaaggttgcaagtgaaccccagcaacacacagtttatgatgccaacaagtctgattggacgccagcatttagatgcatgcatgaagtccagatctgcatatgcaacaacattggccctgtcatggtggtgcacatgcatggctggccaggcaccgacggtccccaagtagcaataccacaggggaggaggacccaaagagcgttcatcatccaagaaggcaggatgtcattgccgtacatggggtgaccgtggacacacacagaactgacaggggacaaactacgcacagagaggaccctaacacattggggaacagaacctggtgtaacccaagtgcctagtgggtaccccaagaggggccagcggtgaaccatgaaagatgcaactcttcaagcaggtccggggacataacccaaagcagaatgcctgggaacacggtaatacagcacagggggaactcacaaaggggatacacgatacaaggaacaatataagccgaagacaggaaagagcacaaaaccaggcgctggcagatgcccataaagggcaataaacgacaggcgataaaggacagacgaaaacaacggaggataaggggaagagccaagaaaccaaggcaaacacccgagtggacgaccacaatcaactaaggacacccctagcacaacgacgaggggaccaacacacagacgagacaatggaacgagcaccacacaaacaccgtccaccaacgtaaagaaagacgcagccacggggaaaacgaacccaataaggaacgagggcatccaagagctactcaccaaggacaggggaacgagacgaacaacaccacaccactggggacgacgaaacagacacgcagcaatacctagggacacacacaagaccgcgaagaaggagagtaccaaaaaccacagataataaagcgaggcacggacgagtagaaagagggaacaaagaccaataagaaaggggaacaaatcacagagtggaaaaaaacacaagcaagcaggagggagcaagacacagaccacagaccgagacaacaggagaaagaaagaaaacagagaaagaacaaaagcggacacacacgtgagagtgatatcaccggacgcaccacgcggacacacgaaatagagagcaacgacgaaacagacgacacaacaaaagcaagaaaacgcggaaaatcaagagacaacacaaaagcgcggtgaccagacaagagagaacaaagcaagg

SEQ ID NO: 708925 - DNA, 191 bp, Homo sapiens
agacttagaggatccctggacagcgctatagcgccgccaccttcttgccgtgccactcctccgggatcaccgggaggggcggcgccgtggtcaggttcatcagcgcggtgacctcgtccggcgcgtcgggggcccagtcgcggaaggcccgcaggagctcgcccgccgcgtcggccgggtagaacacgggg

SEQ ID NO: 708926 - DNA, 113 bp, Homo sapiens
tcgaggatcccctgatgtttgctggcctatgctgtatattttgcaattctctttactagagtaaaaagaatatcttaatagaagagagctggattcggccaggcaaacatcaa

SEQ ID NO: 708927 - DNA, 927 bp, Homo sapiens
ggaggaagtgacgacaggcgtgcccttgacaggcaggagggctaggctgtgcatccctccgctcgcatgcagggagatggctcagcgacttcttctgaggaggttcctggcctctgtcatctccaggaagccctctcagggtcaaggtggccacccctcatttccagagccctgaagaccccaaacaattgcagtcctgggtggcccttgattgtaaaaacccaagcccaggtctcggacaaataattccaccacgagggatctccttgacaacctttaatatccagggatggacctgacttttacaaggacctggagtggtcccaacagttggacgacccccacgtgtgttgtggcattcccaacgcacaggggggtgtgggacccctgcaaggaatcctggggaccgcgggttacgagaaagatgggtggccaagacaggcactgggacaggtggttgatgggccacaggggtggcttatggatgacacacaagacttcgcattgagtatggagggtgtcagtggtgccactgtgcttggccatgacgaatggcgacgtggtggacaaagttcgtggcgcatcaagaatgaggtaagttggaggcctttcttggaagaagcggattggtgacaagcagggatgagtcctgttcatttcccggtggacccaatagaactcaagccttccatgcagccctcctgctgctcctgccggttggtcctggggccatgctagagccaggcccagctcgagtgtcgacgcggactgccaggcacgaggcgagggcgcgcagaccggacgtgttcttacaagctgacaccccttaggctggagtcccggtggggcgggaccccggcaagggcgacatggccccgcccaagacggggcggcatcagggaaacaagaaaaacgggacgcgagcag

SEQ ID NO: 708928 - DNA, 240 bp, Homo sapiens
cctgctcgctgtcctgtataccttgatcccagacgctgccgcgctctgtgtgagtggctgcgcgcgctgatgctggcgtctctgggtgctggcggccctcgttttctcagaggagactggcggagagatagcctggatccatgtgtccatttcctcatcgtctttggcttggaagaggtcctcattgccatcattgagtcttagcttgcatatgtgtcccttctcttctgtaatcaaggg

SEQ ID NO: 708929 - DNA, 136 bp, Homo sapiens
  misc_feature (120)..(120): n is a, c, g, or t
ggattcagaagaaaagaaaaggaagagaggagttgattataatgccgagatcccattttgagaaagaggcctgcccttgggtttggatgatacttctgaggaaaactaccaagctgtttnacgcagatattcagag

SEQ ID NO: 708930 - DNA, 448 bp, Homo sapiens
gactagcagtggtggtggtagtgacggcagacactctgatatacccaatgcgacgtctctgaaaacattcaggccccctaccggggagggctttcgagcttggaggacgtggattggaacagcgttgcccgccggtctcccaatctcttcaccaacatgcagcccacttcatagcataagcagccccggccctggccatcagccttggacacagggagcccatagtcctctggaaagcattccgagcggcatcacaagaccgtgtagtgtggctccctgccctgtctgaactcctgcagctcagggggcgctgactccgactccagcagctgccggccgggcctgccttccttcgtgcaggtaatcgggcacccgccccgggaccaccgcgcttcctccgagcaagcgctggtgcaggccgggagctacagcagggactcagaaggca

SEQ ID NO: 708931 - DNA, 197 bp, Homo sapiens
ttaaaataactttttagcccccgtcttcctattttgagtttgggtcagatcttaagcagctccatgcaactggatttatttttgatgacaagactcccatttaaagtttttttcctgcctgatcatttcattggggggtgaaggattttaaagaaccttttgtttttgcaaggaaaacaagaatcccaaaccagtga

SEQ ID NO: 708932 - DNA, 517 bp, Homo sapiens
gtgtgtgctcatctcaacgcctcgtgcgaggcgtttaggcagccagcgcaggggcttcgtgctgagggggcaggcggagcttgaggaaaccgcagatcagtttatttctcttagaaagatagagatcaatacaactacttaaaaaatactacgtcaataggttacctaacgactactggcttacgcgttccgttttacacgtacattttacatacgcttaccgactttaccgacgaccactactgacacgaccttacgaacgacgtacccatgaggacacggacaacagactcaaacggtctctacaaaccatgacggacggttgacgactgaccgcttcttcctggagtccacactgtctttaaacagaccactcgacgacgaacaggacctaccagcgccccgaatacataccacatacgacagggcactgcttttacgacttaaaatgaacggtgaacttaaccagcttaaagtttagtttaaacgtggtaggtgattaaaataattagaaggc

SEQ ID NO: 708933 - DNA, 146 bp, Homo sapiens
tttcagctctgcaaggtgaacggagcgcgcagcccgcgacaccgtcattgaaaaattggggttgttttaagggggctactcgggctttaaatgggaatgcaagggaggagaccgccattattattattattacctctattaaaagg

SEQ ID NO: 708934 - DNA, 232 bp, Homo sapiens
  misc_feature (83)..(84): n is a, c, g, or t
ctgtgacgttctgcaggagtggggggaggtggtggggggggagagggggaaggctaggggtggtgggggtaccatacatccannagttcatcaaaacaactaagccaagacatgctaataaattttcaacactaggggggcgggggggaagaggatgaaattgtacgaagtaaaaagtttctgcttcaaagttccccttcttgttaaagaataaatcataagtcttagaaat

SEQ ID NO: 708935 - DNA, 126 bp, Homo sapiens
tccgggagagcggacgctcttcctctcctcttcctcttgctgtctgcgcacttccagtaagtccaatgtagtccgcctttccagggcagagaaactccccaccagcgtcgtcaccatgatgcagct

SEQ ID NO: 708936 - DNA, 762 bp, Homo sapiens
  misc_feature (45)..(45): n is a, c, g, or t
  misc_feature (82)..(82): n is a, c, g, or t
  misc_feature (89)..(90): n is a, c, g, or t
  misc_feature (185)..(185): n is a, c, g, or t
  misc_feature (221)..(221): n is a, c, g, or t
  misc_feature (237)..(237): n is a, c, g, or t
  misc_feature (240)..(241): n is a, c, g, or t
  misc_feature (248)..(248): n is a, c, g, or t
  misc_feature (256)..(256): n is a, c, g, or t
  misc_feature (262)..(262): n is a, c, g, or t
  misc_feature (267)..(267): n is a, c, g, or t
  misc_feature (282)..(282): n is a, c, g, or t
  misc_feature (286)..(286): n is a, c, g, or t
  misc_feature (302)..(302): n is a, c, g, or t
  misc_feature (314)..(314): n is a, c, g, or t
  misc_feature (316)..(316): n is a, c, g, or t
  misc_feature (337)..(337): n is a, c, g, or t
  misc_feature (379)..(379): n is a, c, g, or t
  misc_feature (392)..(393): n is a, c, g, or t
  misc_feature (406)..(406): n is a, c, g, or t
  misc_feature (420)..(420): n is a, c, g, or t
  misc_feature (460)..(460): n is a, c, g, or t
  misc_feature (475)..(475): n is a, c, g, or t
  misc_feature (486)..(486): n is a, c, g, or t
  misc_feature (549)..(549): n is a, c, g, or t
  misc_feature (564)..(564): n is a, c, g, or t
  misc_feature (654)..(654): n is a, c, g, or t
  misc_feature (680)..(680): n is a, c, g, or t
  misc_feature (717)..(717): n is a, c, g, or t
ttggagctgaaaaaggaagcaatgtggagaatcctatggtaaaanaacgggactgacaattgataaaatagtctctgtgtcncaagaannggccgtatttacagggttaaaaatattcacagctcagagtacagggaggccaaaggggagtgggaatgtttctccaggtgaaaaggccccggacncccctgccggggtaaaagggggagtgggggcgcggncggcccgctgccgggngtnnggggccnggaaagcncgccgngagcngggctcagacgtccnctcnctcctgggcttctgtngggaggtgggtncngctgggccctgcccgtgcccncggtgtgctggggtccctctctggctgggccgggccgtgggnctgggttggctgnngtgcctgctggtncctgtgtgcccggntgctgtgtgcggtgctgtgggctggtgccctccctcggcnggcctggtgcccgcntgctccctgtngtggcttcgttcctggcgggctctcctggttttgcgttgtgtcgctggggggctggtcttggncgccttcttctgtgnccggcgccgccccgggtctcgccgctccacaccagggctccagggaccccgcctgccctgtgggggacagggacccgggctctggggganacctgcccttatgccccgtgagggtnggtccctgatccccccccagggtcttggcctctgccncccagatttggttttgcggacagagctcctggctgcctagcccgc

SEQ ID NO: 708937 - DNA, 352 bp, Homo sapiens
ttacactggagcagatcattctctctcctgccgcctgtgaagaggtgcttctgtcatgattgtaagtttcctgaagcctccccagccatgtgaaactgtgagtcaatgaaaccttttttctttataaatcgcccagtctcgggtacttctccatagcagcgtgagaacaaactaatacagatggctactatcaaaaagacagaaaataagttttgaggatgtggcaaaattggaacccttgtgcactgctggtgggaatgtgaagtggtgccgcagctatggaaaacagcatgatggttcctcgaaaacttaaaaatagaattactcttcttctccaagacaaaatctcaaa

SEQ ID NO: 708938 - DNA, 509 bp, Homo sapiens
tgtcgatgatactgcagtcgagaactgccgacagctggttttaaaagaatgaaatgttctgttgatcacatttttcaccagcattttttgttttttttctttagatggagtcttgctctgtcatccaggctacaatgtagtggcacagtcagctcactgcagcctccaactcctgggctcagcaatcctccagcctcagcctcccaagtagctgggactataggcatgtgacatcacacgctggctttttttttttttttttttttttttataaaaacggggctcccacttttttccccaggcgggtcttgaacccctttgcttcaaattgtcctcctacctcggacccccaaagtgctgagattacgggtgtgacgcatggtgcccagccttttcccagcattttttttaaggacaaacgtgattatttttgctcatgattagaatttggagcagtatggaaagatggaaagcacaagggaaaaacccccagtccatccctctttcta

SEQ ID NO: 708939 - DNA, 164 bp, Homo sapiens
aagtccagatcacatacaagtatgatctccaaagaatctgtaaggtcacagtcagcagcttttcaggactgtaggatatttgcgttaaatgctgcatgtgacacaaagttctgtaaacctttcagtgacaccctagtggtctacttttggaagtggaaacattc

SEQ ID NO: 708940 - DNA, 122 bp, Homo sapiens
tattgaatctactcatacttcctccccaagagaagaggtgaaaagaaattaagagggatgtctttttgagacggagtcttgctcttgtcgccaggactggagtgcagtggcgcgatctgggg

SEQ ID NO: 708941 - DNA, 1710 bp, Homo sapiens
aagcttgcggccgcttgtgacctaaccgcagcgcctgtgtgcaacgtggtggggctcccggcagggctcggctctgcccaagaggcccgccctggggctgcgcgagccgctttgccaaggggtttccttctcactcagacgcatgatggccccaggtgtggccgcgggaccgagggatggacgggctggacctggctcgccgtaggagacgccccccacccctgggctggagtccagccaggccgctgatcctgcatccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaacta

SEQ ID NO: 708942 - DNA, 2743 bp, Homo sapiens
  misc_feature (30)..(30): n is a, c, g, or t
  misc_feature (2743)..(2743): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccactgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcgcggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacatggggatttctgtgtctgcttggcgacctccctgcgtgcacggcctaggaggtgcacgggccaccatagtcacactggcactgtcagggtgcgtttgggtgggtgccgtcgn

SEQ ID NO: 708943 - DNA, 2421 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtgggacacggataaagctggaaaccatcattctcagcaaactatcgcaaggacagaaaaccaaacaccgcgtgttctcactcataggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctctcctagc

SEQ ID NO: 708944 - DNA, 151 bp, Homo sapiens
  misc_feature (89)..(90): n is a, c, g, or t
gcgtggaagtgacatcgtctttgaaccctgacgtggcaatcccatgacgcaccgcgcgtgatgccgcagtgcaagcacagtgactgacnnctggattgtcctctgtttctctttcctctctgttgtcctcctttctgttcttcccgctggc

SEQ ID NO: 708945 - DNA, 396 bp, Homo sapiens
ccggtccaggcttgacgcagccagcgcagggcttctgctgcggtgggctggcggagcttgagtgaatccgctagattagtttttttctctttgcaaagatagagattattacaactacttaaaaaatatagtcaataggttactaatatcttgctttcagcgttcacacgtttttaactgttaattttaatcagcttaagattttaagcagaaaatatgaagcacttagaagcagtagcatgaggaaggaaaagattaaaggtttctaaaacatgacggaggttgagatgaagcttcttcatggagtaaaaaatgtatttaaatagaaaattgagagaaaggactacagagccccgaattaataccaatagaagggcaatgcttttagattaaaat

SEQ ID NO: 708946 - DNA, 2387 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaagagcaggctctgtgctccttgaagcaagcgctccagaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtgggacacggataaagctggaaaccatcattctcagcaaactatcgcaaggacagaaaaccaaacaccgcgtgttctcactcataggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctctcctagc

SEQ ID NO: 708947 - DNA, 1176 bp, Homo sapiens
catagtggcacatgcctgtaaccccagctactcaggagctgaggcaggagaattgcttgaacccaggaggtggaggttgtggtgagcagaggttgcaccattgcactccagcctgggcaacaagagtgaaactccatctcaaaaaaaaaaaaaaaaggttttttaaaacaaccccagggggttgggtgcgggggttcacactctgtattccccagcatcttcggggaggccaaggacaggcggatcatgaggtccgggactaattgagccacatcctgggccaaaacccaatctcctactaaacaatacaaaaatttacgttgggattgcggtggttgccgcaccttgggaattccccaagcatattcggggaaaacttggaggcgcaacggagcacttggcgttcgagacaccttgggagcataaccaggtggcgcattcctaaagacaccgcctggagccataaataccggagattcccactggaagcaacgatagattgttaccaacacaatgtgttcgcccaacggccgggtatctccgaagaaacatctccatgggcccatcacaagatgtagactcccaaccgcaagccgcttagaagggccttcttacaaaaaaggttgcaggggaaagctctatcacaccgggcggccatattagcgcccaccaccggagtcgccttggcgccaataataacagtaaagtagctacccgagtgggtagtatttccaatagaaaacctaattccttcgttacgaggaggtaaagactacttgttcgacggacgcgttaccaaaccactctgtccacagcgttggcaggaacaaatctgtccaatctgtcgggcgagagaaacgatctagacacaggccacacacagaggggggggttacacccccagctacacccagacgtcaccgaaaagagttagtaccgccacaaagaagctgtctgctaaagcagcacggggggtcaagggatccccaagaaaaagcacacacagaacgacaagcctggggaaccacccaagaaaaagtcaaccagcgtgaaacccccccaagaaggctgggcggcgggggacaacccccgcgcgctcagcaaaaacaccagagggcagcaccaataacaaggagtgcacaacggggcgcgacaggggagcccccacaggacaaa

SEQ ID NO: 708948 - DNA, 361 bp, Homo sapiens
ccccccaggaaaaaaaaaaaatttctgtttaaaaaagcaatctgtttcttggccctggaaactttcgctacttaaattcccaaaaaaaaaaaatttaaattttttaaatgggactcccccatccccctccagggggggggggttttttaaaaaatccttttggtcaccccccccagacattagccccacatttaaacttttttcttaaaaacggggttgggggggttaacttcacccccgttcggggtacttttaatctcgggaaagtttcttgggattgcgggggaaacccaacccgtctaaattaacaggaaatccttcttttggggggagaaaaaaaaatcggtttttttcaaagcca

SEQ ID NO: 708949 - DNA, 2270 bp, Homo sapiens
  misc_feature (30)..(30): n is a, c, g, or t
  misc_feature (1400)..(1400): n is a, c, g, or t
  misc_feature (2258)..(2258): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccaaggtacccgggggctccctctgcagccgccagccgcncccgggctgccctcagtgccctcccctgaaatgcgggcggcgtcacggccgtttccccgccggctgcagctgtagctacgaaaccagctttaatgccgaggatgacggctccttcccgggagggtgtagcgctcgtctgtcgttcccgatgatttcagagctgtgacggtttccttttgcaaagctggtgcattcaggttccccgagcaggctggcagcctcccgggggccagggcagaggctctctgtttcctttgggtcggggcagtggcagagagtgcaggaggccgctccctctggcccgcgcctctgtgtgtggtcagctggcctggctgtgacctcaccagtggcccagagcagaggggcaaggtgggctggggggagggctgagcgcacagagggggcctgccgtgggcccgggtccctcctccgcagcgtgaacctgacaggtctcaccagcgccggtactgacgaccccctcagcaccaagagcctccctgctcctcctgcaggcgcgactggtaactcccatgagcccggggccagggcccacagacagacagacctccccaggacagacgtccccggcacgctccttgtcctcaggagggctgcgtccccctggagtccaacgcggggcgaccccataacctgttgtctgattacagttgtgataagtccccgggaaggagcatgacaagaggctgagacatgtggcagcccagtccttacctcatggtgaatattgaagacactaacccaggctaggccaggctcgccccgcagctacggcggtggcatgcgtctgcggcgtcatctcagctccctgttgctggcggccgcaaagcttaattcccntttaagttgagg

SEQ ID NO: 708950 - DNA, 2196 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctctcctagc

SEQ ID NO: 708951 - DNA, 1393 bp, Homo sapiens
cacacgctttgtgatcccctaatacggttaatgcaaatttctagagtgatccgtctttgtttgagtactgggcaggcagcagggagagtcaggcagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtgggacacggataaagctggaaaccatcattctcagcaaactatcgcaaggacagaaaaccaaacaccgcgtgttctcactcataggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctctcctagc

SEQ ID NO: 708952 - DNA, 2335 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggttggggctggagctctggctaaggaatgcatgtctctgtaccctggatgtaagatcaccgtttttgacatcccagaagtggtgtggacggcaaagcagcacttctcattccaggaggaagaacagattgacttccaggaaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctctcctagc

SEQ ID NO: 708953 - DNA, 485 bp, Homo sapiens
  misc_feature (452)..(452): n is a, c, g, or t
agggttgggttagtggtaacgataatataatcagaaaagctcagccgggcgcagtggctcacacctgtgatcccagcactttgggaggctgaggcaggcagatcacgaggtcaggagatcaagagcagcctggctaacatggtgaaatcccatctctactaaaaatacaaaaaaattagccgggcatggtggcatgagcctgtagtcccagctactcgggaggctgaggcaggagaatcacttgagctcaggagtttgagaccagcttggcggacatggtgaaacactgtctctactaaaaatacaaaaattagccgggcgtggtggcacgtgtatgtcattccagttaggaggttgaggcacgagaatcatttgaacccgggaggtggaggttgcagtgagccgagattgtgccactgcactccaacatgggtgacagagagagatactgnctttaaaaaaaaatggatcaaaaaaaaactcaa

SEQ ID NO: 708954 - DNA, 2089 bp, Homo sapiens
  misc_feature (30)..(30): n is a, c, g, or t
  misc_feature (1964)..(1964): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtgggacacggataaagctggaaaccatcattctcagcaaactatcgcaaggacagaaaaccaaacaccgcgtgttctcactcataggtggtaactgaacaatgagaccacatggacacagggaggggaacgttacacactgtggcctgtcagggcctggggggctggtaggctgatngaggtatagcactttgccaaatccttattgtaaatgactaatttatgggttcaggaaactaccatggcacatggatccttatgtaatcccgtatgttttggacattgtccctatattttggtttt

SEQ ID NO: 708955 - DNA, 1217 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaacaaaacacagtcgtacagctcaaaaactcattacaaatctttccaactcaaa

SEQ ID NO: 708956 - DNA, 224 bp, Homo sapiens
tcgagctcggcaccccagcgcaactagccatttagaatgtttttacattggctgggcgcagtggctcacgcctgtaatcccagcattttgggaggccaaggctggaggatcatttgaggtcaggagttcgagaccagcctggccaatgtggtgaaaccccgtccctattaaaaatacaaaagttagccaggcgtgatggtgcaagcctgtaaccccagctactc

SEQ ID NO: 708957 - DNA, 321 bp, Homo sapiens
  misc_feature (9)..(9): n is a, c, g, or t
  misc_feature (12)..(12): n is a, c, g, or t
  misc_feature (31)..(32): n is a, c, g, or t
  misc_feature (35)..(35): n is a, c, g, or t
  misc_feature (37)..(37): n is a, c, g, or t
gctcgaccncanggtcaggtccttgagctgnnccncnagcttgtagcttgtggccagtttgaactgacgttccgggcgctccggactgatgcgcttgtgctgctcatcacgaggctgagcgtaggtataaccggcgagcacttgccaacctggcaacacttcaccggaagcctgcagttcaaagcccttggtggtattggtcacgccttcgtaagcgtccctgccgtcttcggtgctgccgacgtattgggcgaagttgtcctgcttggtcttgaacaccgcgatactggtattgagcgcaccccgtagaactcgtcgacg

SEQ ID NO: 708958 - DNA, 289 bp, Homo sapiens
ggatggagagaaaactaagcactgctaaggtaatagatacacgggaatacgggagtcaagaataaagcacttcgacctaacaatagagatccagagatctagacaggggtcacgtgggctagcacccctcagggtcgtatatcctggggcactgcaggctgtcaggactgcctgggcccttacttggtatttggcattagtcaggcattatagggaacaatctttgagtttttcttgcttgactgtctgctactggatcgtctcggggccgtcttgttttcacaatctc

SEQ ID NO: 708959 - DNA, 248 bp, Homo sapiens
  misc_feature (21)..(21): n is a, c, g, or t
  misc_feature (42)..(42): n is a, c, g, or t
  misc_feature (87)..(87): n is a, c, g, or t
aaaacaagttcttatttttangcctttgttcatttacttaanccaataaatatgcattgaatgcctgctttgcgcttatgctaggcnattagggtaaataatacataagatcggctgggcgtggtggctcatgcctgtgatcccagcactttgggaggccgaggcgggcagatcacaaagtcagaagatcgagaccatcctggataacacggttaaaccgcgtctttactaaaaatacaaaaaaaaaa

SEQ ID NO: 708960 - DNA, 301 bp, Homo sapiens
ccgagagcacttattactggccagacaggtactcagagcctgggtaaggatgcaaaagggaagagtggggagttgggcccctctgtatattgtccctgtctctctggcatctacagattggggtggagcatgtggtggtgtatgtgaacaaggctgacgctgtccaggactctgagatggtggaactggtggaactggagatccgggagctgctctctgtgcccttgaggtgaacgcggggtcaggcagggcagctgctgcagagggtggggctggatgggcacccagagctctgctttgt

SEQ ID NO: 708961 - DNA, 398 bp, Homo sapiens
agtgggctctacgctccatcttcggagtgatccagctgctgtgcttgctgagggccccgtcatgggctaatcatgggactggaggcggaaggagtgtgaagatgcctctgaggagcccgaggagaatgacgccaaccacggcgagcagcaaaagaagacgcgggaccggcagatccagaagatcactaatgccatgcgggccttctgccttcaccaacctgctgctcgtgggctttggggtgcctgcctcattcccacccgtgcctctccagatcctctccttcatcctgcacacaaatcgtgcgagcactcatccactctgcttgtcgggggcctgtacgctgcctgtgtacccctccaacccagtccgggcagcctcacgagactgccctctctga

SEQ ID NO: 708962 - DNA, 256 bp, Homo sapiens
tatgagcggtctgaacattaagtttgccctttgggagttcctgtcgtggcgcagtggttaacgaatccgactgggaaccatgaggttgcacgtttgatccctgcccttgctccagtgggttaacgactccggccttgccggtgaggctgtggatgtacggttgcagcacacggctctggatccccacgttgcatgtggctctaggcgtaggccgggcagcatgtagctcacgattagaccccatagccgtgggaac

SEQ ID NO: 708963 - DNA, 393 bp, Homo sapiens
  misc_feature (33)..(33): n is a, c, g, or t
  misc_feature (246)..(246): n is a, c, g, or t
ttctaatatatctctctatacgcatcctgtctnactggaagaaccctgatacggttaggctttgtgtcctcattcaaatctcatcttgaattgtaaatcccataatccccataatccccatgtgtcaggggagggatcaggtggaggtaattgcatcatgggagcagtttcccctgtgctcttctcacgatagtgaaagagttctcacaagatctgatggttttataaggggctcttccccctttntctgcacttccccttcctgctgccttgtggccttgtgaagaaggtgtcttgcttcccctttgccctcctccatgattgtaagtttcctgaggcctccccagtcatgcagaactgtgagtcaattaaacctctgtcctttataaatta

SEQ ID NO: 708964 - DNA, 192 bp, Homo sapiens
caagttaggactacgttctgtccagcacagtggttaataactatgggctctggcagtcacatggcctggcgtgcaatgtccctgctactatcccacataatcttgctgcaaatttcttaaatactcagcctcagcgttctccactctgctaaaagtggggattatacatgaatttcgtacccttcatcagta

SEQ ID NO: 708965 - DNA, 411 bp, Homo sapiens
  misc_feature (126)..(126): n is a, c, g, or t
  misc_feature (217)..(217): n is a, c, g, or t
aaatgttaggaagcttgtcagctgaatgagaggaggtgccttctgggtatctctgtgttggtgtatctgtgccattggctacagaacaagaaaaaatactatttgccatgctattaccttggcagntgtgtaggtgatatcatctggacttgcaatgaaaaggttcatgggttgtcaaatcccccataatcatatatcgagtggtatgagatatatncaaacatagcgaccaacacatttctattactagtgatcaaacaaactgccaccgagttatcaaaacaattgtttttgcgcacacagttgcatgcatggcaagctgttaacctctgggtggcattttcattatgaatttgttcaccacctgtcaaacttaagctacaaaataaatgcatttatcaaaaacagaaa

SEQ ID NO: 708966 - DNA, 310 bp, Homo sapiens
  misc_feature (1)..(1): n is a, c, g, or t
ncaggtcagccgtcttccatctcagcctccctgagtagctgggactataggcgccatcatcatgcctggctaattttggtattttttgtagggacagggatttgcctgttgcccaggctggcctcaaactcctgagctcaggcaatccatgtgccttggcctcccaaagtgctgggatgacagcatgagccaccatacctggcctattctccaatatttgctactgtcaatctttctttttttttttttaatttttggggaacagggtctacactctatctcccaggtggacagcaagacccttaatcac

SEQ ID NO: 708967 - DNA, 392 bp, Homo sapiens
  misc_feature (208)..(208): n is a, c, g, or t
caatagcagcaggcatatcaagactttatagctaatcactgttgtggcaaagtagtcacataaaataaaggatcattttgtaattgttgttcagcacgagcgacgcgctaaagaagagtttacgattaagactcaacttacagtaacacccagtagggacagttcactgagaatttgttcaaactgctggaaagtgattgcaacgcanatttcacctagtagcatcattatttgtcggtacaacacgccatgctgcaacggtaagaccttcagctgtaatttctttgttcagaatatttttggcattttgagctaaagcagggttcatattttaaaatccagtacccgcagcaaaaatctcagtaagattagtaccttacttctgagcttcg

SEQ ID NO: 708968 - DNA, 1073 bp, Homo sapiens
  misc_feature (47)..(47): n is a, c, g, or t
  misc_feature (66)..(66): n is a, c, g, or t
  misc_feature (69)..(69): n is a, c, g, or t
  misc_feature (136)..(136): n is a, c, g, or t
  misc_feature (146)..(146): n is a, c, g, or t
  misc_feature (268)..(268): n is a, c, g, or t
  misc_feature (270)..(270): n is a, c, g, or t
  misc_feature (410)..(410): n is a, c, g, or t
  misc_feature (454)..(454): n is a, c, g, or t
  misc_feature (953)..(953): n is a, c, g, or t
  misc_feature (992)..(992): n is a, c, g, or t
attcctggagccccgagccggaacacgttttgtccaggagaaccagntatcggggcagccgccacngangcaggagagaaccccctggagttctgcggaccagccccattccagaacatgcggcaggtgattcagnagaaccctgngctgctgcccgccctgctccagcagctgggccaggagaaccctcagcttttacagcaaatcagccggcaccaggagcagttcatccagatgctgaacgagccccctggggagctggcggacntntcagttgtggagggggaggtgggcgccataggagaggaggccccgcagatgaactacatccaggtgacgccgcaggagaaagaagctatagagaggttgaaggccctgggcttcccagagagcctggtcatccaggcctntttcgcgtgtgaaaaaaatgagaacttggctgccaacttcctcntgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctttctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtntggccttggcctccagcctggagaagggctaacatcagntcattgtcaaggccacccccaccccagaacagaaccgtgtttttgataaaggttttgaagtgaataaagttttaaaaacta

SEQ ID NO: 708969 - DNA, 248 bp, Homo sapiens
  misc_feature (70)..(70): n is a, c, g, or t
gttcggcacgatggggaagacgcagaaggtgaaggtgctcacgggcacgggtaacgtgaacgttattcancctaactatctgcggcacgcgtgacttcctgcagactttccgccgtggctgctgggttcgtgatgctggacctcgacgtctgcggggcacccccggctgagactttgccctgaacttgtccgggtagggagggccggacgatgtggcctcccagacctcctgacctgggtggttgagg

SEQ ID NO: 708970 - DNA, 376 bp, Homo sapiens
ggaagggggatgaggtagcgcgagtagccgctaggcctctcccacagtaaagacaagtgacccaaccaagtcgttcctcagtcttggtaaagcaagaagaatgacacccatagtggggagactgaaaggcaataatattggcctagcgtcccagggccgggcccatagtaggtgctatactaatggttatttcccatcgttctcccactggctttatttttcccttctggttctgtcttctatcttctggcgtcggatctttgggtggtgctggccccttctctccccgtgatctcctgcaccagcctctgcccttctgggtggaagggactgtgtagacctcgggcgtgttttcccttggggtttctcgtgagcc

SEQ ID NO: 708971 - DNA, 1782 bp, Homo sapiens
  misc_feature (249)..(249): n is a, c, g, or t
  misc_feature (1782)..(1782): n is a, c, g, or t
ggctgtcaggagagtgagctcactgtctgttatcacacctcccgagggagccgtgacgcttaccagagggcaggtgaatccagtcctccagtactgggtatgatgggatgtcccagagtctacggggctgagttggtttgagctctcgttcaagagtgcaagctggggggcctgtgctgttgccagggccctttctccgtgtagacgcgccctcagcagttcgctgtctcgcgtcgaccgatatccaanagcaggaggattgatacacgttgcacacggcgggactggcagcgagatagctcaggcatggctgtgccatgaggccttgtgaggtcccaggctgtccatgccatggcgagcacctagctcatgggaggctagtgcgttgtaccattgttgatccttgcacttgggctctcaatcgatagtcggagtgcgcgctacctcacttgcacccagtacgttggtccaggtgaacgaacatagcccatccagcgaagactcctgaacgccagtggtctcgacattgcctgacccaaacgtaatagggcatgtaggaccgcggccaatgggattggatggccctacgccactgagattgagaaggcgtcgctagttctaactcggggtgttaaccttggaattgaccatgcgtactgggcattcaacactcgtacatggggtgccggagcccctgtgataggacgtagcattttcgctaggcagcgcggaatcacttggcgttgggaccgcacttagcccgctcccaggcgaactaggcgaccattttggctcggtccccgaggagcgacacccaattacttagccgtcactttggggtgctaatactttatctaggctttcgcaggacataggtgcgctttagcgcaaacacgagacaaacggtcgtggcaccggttgctaggggcaacgaaggcactcgaggtcggagagggggctcactggcttgtctggagggccccaaagaagcattacccggcggaacatcggggttcggactacacctctggctgtgagccgccttgcgagttccaagcgggtcctcgagcccgacggcaccgcggcgctaggcaagagaaaccggtgctcaaaattagccccggtagcagtggacagccgagtggcgcaacccaccccaagcggagatcgcgccaagtcgcgactgaagccacacgggcgggagaccaaggggcagatacccgacgcgccggtctaaacgagccggcgcaggcacggcgcggcgcgacagggtgggaacaccacactgagtcctgggaagggggccgcatcaccacaaaaataccgagcgcctccagagggaccgagagtcgccagctgggcacgtgccgggaccaccccgggaccacgaaccacccgcctgaccccccggggaagccctgcccgaagagaggtggctccaggggccagaggccccccggcggccacacaccctcacaactggccgcatagtcaggaccccacaccgtacaccagcgtacagtgcctacagggcaagagccaagacgcacgcacaccagcaagacgacacccatcacgccagccacgaagagccagacacagacgccaacacacatcagctgacacgtgcccacacagccaccccacacagcgacgtgcacggactgacatacagacgaaacaccacacaaccagcagcacccaaacaccacgcaggcgacagcaccgatcagatgccacagtaatcgacaggatgacagacagcagacacatcgacactan

SEQ ID NO: 708972 - DNA, 841 bp, Homo sapiens
  misc_feature (841)..(841): n is a, c, g, or t
cggacccgcgggcaggcactgcccgggctggacgacgtctggccgtgctcccggcgaagggcagcggaggagcggcccagaagcgcgcagatagggcactggcgaaaccccgggacagtccctctccgtgcgggggcggcgcgaaagcagtcccatccctcggtggtccctgggctgctggtgtgactgctctggctggttccctgctgcgcagtagctcccctgtagccgggctgcaccggagggcggcgagatggtctgcgcgcgtcggcctcctgctgcggcgcccttgcagcttgctacttgtggtggccaccttggacgcccagccctgcgggagccggctggatggcccagtgatgctgcgcaatggatgtgcgtgagggcatttcctaggagaaagtacgggatacctcaaattgaacgaggtccccgaaaggctcccaagcttccactcgaattccagcggatgcccatcgagaagcggtttcatgtgtggtgtcccaggcttacccttgtcaagcagggcggtgttgggaccggcgccaacccttgcggccagaattgacatcgtccccctgcatgcgggggttacaggaataccgaacaggttatgcgtgccctggggcctggagaagcgatcacgttggactttgattatggctaggaccacccgggaagccaaagaattgagcgcggtacgaaaccgcttttggccaaaaaggcaacgggttaaacaaagtgggtacaaaggccagcacccgtcatcctaacccgccctggggtgaaactgggtccttgaggcattcttgccgggggaggccgggcaagattacagggn

SEQ ID NO: 708973 - DNA, 1393 bp, Homo sapiens
  misc_feature (30)..(30): n is a, c, g, or t
ggagcggggcgacggaatgtggaaatgcgncatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgtgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggtaccttctgcgggacgggccctcggcgctggtgtccggcacctgggagtgtgcgcagacccgtgtgcgtgtgtctgcatgtattcctgtgcgtgtgtgtgtgcatgcatgcttgtgagcttgtgtgtgtacctgtgtgcatggacgcacgtgtgccgtgaaccggtgtgtgtactttgtatgtctctatgtgcgcccgagtgtgtgcctgagccctgtgtgcacgtgtgcctgtgtgtgcgtgcatgtgtgtgagctcgtgtgtgtac

SEQ ID NO: 708974 - DNA, 474 bp, Homo sapiens
gaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagaggagtcaggaggtgggaggccgtgggctttggttttataatgtaaccactgtgggggtgggggaggatggtgaaccaaagcccatgcccttcccctgggctaccattgtccctttcctcacccagttggtagaggagtcaggaggtgggaggccgtgggctttggttttataatgtaaccactgtgggggtgggggaggatggtgaaccatgtatttcagtgaaatatttaatatatttaaatatcaataaaatcaaactctttgtaaaaaaaaaaaa

SEQ ID NO: 708975 - DNA, 796 bp, Homo sapiens
gctatggttgaatgagtagcctatcattcaacaatagccctggcgaagctaaacgtaacaatactgcaggccactactcatgcacctaattggaagcgccaccctagcaatatcaaccattaaccttccctctacacttatcatcttcacaattctaattctaactgactatcctagaaatcgctgtcgacttaatccaagcctacgttcatcacactgtctagataagcctctaccatgcaacgacaacacataatgagccaccaatcacatgcctatcatatagtacaacccagaaccatgacccctaacaggggcccctctcagaccctccctaatgacctccggaactagccactgtgattatcacatatccacaactccataaacgactcctcaatactaggcctactaaaccaaacacacgtaaacataataccaatgatggcgcgacgtacacacagagaaagcacgctacccaaggacaccaacgacacccgaccgtgtccaacacaacgggacatcgatacagggataaatcctaacagcacagaccctccaagaacgttcaacccctaacacacgcaagaatctctaccattgcagccctataccagcgccaggcctagctgccctacccaacccaaatcacagaagggcgaacggggctcaccaacaagagcatcaaccccggtaaataccacgtaaggagagcccgaaccaccgaaacacatccgtagtaaccagactgacgggagtcacaacccatgagcccccaacagcaaatcgaaaaaag

SEQ ID NO: 708976 - DNA, 186 bp, Homo sapiens
ggctctattttcgataatgggacttcgactcatcatatcaagcctgtatgtaccctgcgtgttatttgagctattatgatcacgagcttgttagaggtacattctctttgctcgactctcagaattttcttttctgtgtgagctcttactctcttggtttctgtaattgtctttgtttctgctttg

SEQ ID NO: 708977 - DNA, 1439 bp, Homo sapiens
aggacaaagtgggaaaaggacataaatagggaggccgaggcgggtggatcacgaggtcaggagatcgagaccatcctggctaacacggtgaaaccccatctctactaaaaatacaaaaaattagccaggcgtcatggcgggcgcctgtagtcccagctactcgggaggctgaggcaggagaacggcatgaacccaggaggcggagcttgcagtgagcggagatcatgccactgcactccagcctgggcaacagagcaagactccaaaaaaaaaaaaaaaaaaaaaaaaaaaaaattgggggggggcgtcgggcccggaaaaggtttttaaaaccatgcggtggggcgccgggggcgcccagtagggaagtgtggaccaggcgccaaacgcgtgtccctagggaaactcgtgcgcagaacaacggtgcgggatttctccccaattaaaaagccgcccgcggggcagccggacgcgttcgtgaacaaccccaaggggagtcagaacgccacacgggggctctacacaccaagggaggcccccaaggagaggctccaagataataaaattaaccgcgggcagggggtagggtgccagaacgcgaaagcaccgcgcagcagacaactgagggacatcaagacaacaagagtcagcagaacccggcacgcaggatgatcgagccacgacgcacgcgcgggacccccgaccacagcagatcatgaccgcgcaccacacacacacgccaccacaggacaacgcgaccaggcgaacaacgactaccaaggaaagcgaagccgggagatgaacagacagcgacacacgcacgacgcacgccacgcgcgcgcacgctgaggacgccggccacgcggccgccaccaccagcagacagaggccacagcgatggatatcgcgcaccagcccccgagtggtcacgacacacagcgcagaggacggacacgacagcgcgacgaacgcacgagcagaagcgcgcgaagaccgaccaggagaggggacaacccgcgggcaaaggactgaagagaagacgaggatgaagggagatgagaagggaacggagggtgaagaagcagagagcagaagacagtaatgagagtagaagagggaaacagagtaaggacgaaggggaggagcgacagggagaaagtaagggcagcgatgatgaaaggtacgaaggcgaagaagaaggagagaagagaaaagaagacgaccaagagagagccagcagaccgagagcccacaaacaagaccagacgaacgagagagcacacaccgagcaagcgacagagaacaacgcacaagcagcgaggcagaagcagaaaggcaagagaccgaaagtcagaaacgacaacgcaaaaacacccagcagcaacagccacaagcagaccacagaagccgcaagagggcacaaaagacccaaccgacga

SEQ ID NO: 708978 - DNA, 100 bp, Homo sapiens
gaaaggggcccccctttttttggcccccttgaaggggccctccccccccctaatggcccttttttccttggagatgaaaaaatatgagggggccctgcca

SEQ ID NO: 708979 - DNA, 840 bp, Homo sapiens
gccatgcagcgtgacggtgaaggcgctgcagggccgtagtgcagtctgcagtgtgccagaggacgagctggtgtccagctgaagcggtggctccagaagctgaagtccagtgtgccagagggtgttgtcaaggcaggcctgggatgggaaagagtctcggattatagcatcgtggtccaagtccaagctcaatctagtggtcaaacccctggagaaggtgctacgtagaagaaggcgaggcccagaggctggcgattcgccaccgcgagaggtctggcagctgatctccaaagtctttgtgccgccacttcagtgccgggcagatgccagcagggtcctggaacagctaccagagggattacgagaggtccctgaagtcgcctgacgctagggacgaacatcggaacagggttgggccagcctgcttcctgcacccctgaagtgactgagacaatggagaagcggcttcctccaaaataagaattctcgggagcatgggggaggttgccaaacgccaaggctacccggtgtcttgtcgcaacgtaaggtgtggtctccttgttgcaagcttggggctcatcatcggtcatacgcttggattgtcacctggctctggccaagggtgctaaggcagctccatcacaggtttgacgctaggattgcttcacacccctctagaaaatgaaaagccggtacaagcagaagggcccgggcgataaagttggttacccccagtggaaatccacggctctaaaaatgcttggtttaacagtgggaaggggccgcgtgaaaacttgggctcgactttttttttcccctggatataccgaggggggcccg

SEQ ID NO: 708980 - DNA, 1136 bp, Homo sapiens
ctcaagtttcaagacaacaaggctccatttctgtgttattcagagaaaccatgaacatcagttctatgggacagtcaggccagttcaacaccagatctgatctgccatgacacctgctgctcggccctcagataaagcccagaatccagtgtcctctcccccagcccaggctggccccacacccacaactcacccacttcacccatgggaacatcatgcaacatctcgccacagaggggtcagggagcagctcacagccacacgacgtgcaccaaggagacacgatggcaatatacagatgcaccatggagtacacaagaaagacacagacctaagtgggaagagatccaaatgctagtaacactgcaggtggatgaggacatcccagaggaatgtcagcggacgtcagccagacgcaaggcgagctgagggacccccagaaacatgacgtgggctctcagatacgcaagtctgagtgcgatgaagcagcacacaaacagcacagcgctaagtaaaccgagcccacatcgatctagctcaaaggagcccatcatcacaacagacggaagggagcagccaggaatacacaggatcaatagcaaggcaaacccagggaacggggacccacaacagtgaggaaatgacgcaccaaacgaagagtgaacaaagttagaacaggcatagacacatacaacaacaacacacgacaaagacaagtaacacgagagaagaaaaatcaagcggaaaacgaaagaacaaagacaaaccagacaaaacaacagagaacgcaaagagcacaagaacaagaaaaaagaacgcaaaccaagagagacacaagacacaacagcaccacaacaagaaacgacaaagacaagaaggacggaaaacaccggaagagaggcagagcagggaacatcacacagaacgaaaaagaaaacaaagggccaaagaaaacacacacacgaagcgaacccaaaagaacaggaaccgaaacgcacaagaaggagcagacacacacgaaaacagacaaagaaagagaaagaaaaacgcgagcaccaaacaggcaacaacaagaacacgaacacaaagaagcacaccacaagaagaagaaaaagaagacgccagaaacacgacaa

SEQ ID NO: 708981 - DNA, 364 bp, Homo sapiens
agtggcaacaaagggtgtcgggggtgggaaggtttccaagtttgcccagaaaggttagaggggtaaatgcaaattttccctaaaacctgcccccccctttttaatcagggggggaagaagggttttcaaactgtttgtttcaattggccctttaagtttagggggaaaaggcgggtttatgatccccatgctttgttcacccctcagaaggaaggggaaatgtttttggggcccccttgggttttttttttggggggggggggttttaaggttttggtttttaaaatcgggtctttttaaggggaaccacttggcccaaaatttgtcccagaattttggggccccttaaaaaagtttaatggga

SEQ ID NO: 708982 - DNA, 236 bp, Homo sapiens
taagggaacccttggggccttttttttgggggggggggttttcttttttgggggggatttgtttttttttccggggttttccccccggggttttttttggggtttttttttttttttttttttttaaaaccaggttttccccggggggcccgggggggggtggggtggcccaagttcccccccctgccttccccccggggccaaaaggggggcccccttttcccaaaaatttttta

SEQ ID NO: 708983 - DNA, 503 bp, Homo sapiens
gctcgctggttctccgagtttgtcttgacttgtagcaaccttggggagaaatgagattacacacttcttaggtgcaaagaagttttatttgtccccctcagtagagagaggatagacgcgatctggtgcatattagcatgaggaagcctggacgggacagccaggagtcctctttatatggtgccagtcatgcacggcaaagtggcttatccacctccgcaacactcccattgcaactgtctgaacgcacacgtgctccattgtccgggcttgtggctgctttgcgcggaggtgactatgatttctcatttactgacgtatcaacaatggacgggggtgggtctctccaagctgctttttagcggtgaacagtaggaccatgttttagttagacggctgtagagactaggtacttctaaagttttacttaagattttgtttttagtaaaaaatagttcttcagttgttttgcttgtatcttttgtttgtatgctgatgatgac

SEQ ID NO: 708984 - DNA, 163 bp, Homo sapiens
  misc_feature (36)..(37): n is a, c, g, or t
  misc_feature (105)..(105): n is a, c, g, or t
  misc_feature (132)..(132): n is a, c, g, or t
gcaggggtcgtggggatgcactgagggccgcctgcnnagttaccacaggggcgcccgagagtcactggttcacattctgaacaccgtcgcttggaagacactgcnttccttgtttgcgtgttccaggagganggaccgccagctggggtcttgttttatctgc

SEQ ID NO: 708985 - DNA, 336 bp, Homo sapiens
atgatcaaatgccatatgcacatatgaccaattaactacctgtctcctatcctttaccaatacattacgcgatacccgggggccatacacccctgacacagtcttttctttcatctgccccatccctgcttgtccaaggtacaaacttagacaacagatccttgctgtcctgagtggtaacttgctgtagcctagggctctgtctgctacctgggtcccgatctgaactgggcgtgggaagcaaagcagccatgggggcaggagacctccctcagaaggtgtgagggttcaggcccctgtaggattgtgggggtgagggtccatgccccacctctg

SEQ ID NO: 708986 - DNA, 499 bp, Homo sapiens
gactctagaggacccgagtgtctcgaaggacagttggatccaagccaggcattgctgcaggttctaataattcttgctagatcatgagagagctagacaaattagaatagattgacaatagtctttaaactaatctctgcaaggcatatcagctacaggaccagctgtgcttcccgatgacccaagagatgttcctttgccaatgtcatggtctgtgttgatgcaaccatgttaacagaaactccttcaaggcaggatgtaccgttttattaactatctcaggtaccctaaaatagagcctcagcacgtggtggcatgcttcagtggtttcatgatgtgctcacggaatgcatacttatgctagtgtcgcctctgacttatccccagccttctaggtgcaggaggatcagatccagacatcgaaggatgtggtcacttgtaaggatatatgatcattcttaagacacactttgtcttgacgaaacacctcgggtacccg

SEQ ID NO: 708987 - DNA, 104 bp, Homo sapiens
ttacaacggaagggaaatctgtctaaatgcaccatgaaactttgagtgaacctcttgctgaggacaatgagggcttcaatgtcaagaatgtgtctgtcaaggat

SEQ ID NO: 708988 - DNA, 1026 bp, Homo sapiens
  misc_feature (58)..(58): n is a, c, g, or t
  misc_feature (116)..(116): n is a, c, g, or t
  misc_feature (131)..(132): n is a, c, g, or t
  misc_feature (154)..(154): n is a, c, g, or t
  misc_feature (171)..(171): n is a, c, g, or t
  misc_feature (278)..(278): n is a, c, g, or t
  misc_feature (294)..(294): n is a, c, g, or t
  misc_feature (308)..(308): n is a, c, g, or t
  misc_feature (310)..(310): n is a, c, g, or t
  misc_feature (313)..(314): n is a, c, g, or t
  misc_feature (317)..(317): n is a, c, g, or t
  misc_feature (366)..(366): n is a, c, g, or t
  misc_feature (392)..(392): n is a, c, g, or t
  misc_feature (394)..(395): n is a, c, g, or t
  misc_feature (400)..(400): n is a, c, g, or t
  misc_feature (443)..(443): n is a, c, g, or t
  misc_feature (469)..(470): n is a, c, g, or t
  misc_feature (479)..(479): n is a, c, g, or t
  misc_feature (484)..(484): n is a, c, g, or t
  misc_feature (490)..(490): n is a, c, g, or t
  misc_feature (494)..(494): n is a, c, g, or t
  misc_feature (507)..(508): n is a, c, g, or t
  misc_feature (512)..(512): n is a, c, g, or t
  misc_feature (520)..(520): n is a, c, g, or t
  misc_feature (531)..(531): n is a, c, g, or t
  misc_feature (535)..(535): n is a, c, g, or t
  misc_feature (562)..(562): n is a, c, g, or t
  misc_feature (573)..(573): n is a, c, g, or t
  misc_feature (601)..(601): n is a, c, g, or t
  misc_feature (865)..(865): n is a, c, g, or t
  misc_feature (994)..(994): n is a, c, g, or t
aagaatacaaacacaaaataactcttaatttaaggagaataagaaaacatcaggtgantcttgagtactgacaaatacagccttcacctacagtaaaaattaagccaatttcaatnattttggtcatcatnncgagtctttcttcccacttggnggcttgggcccaccagntggttttgccatgatgatctgatccactctaagtacagtgactgcagcattagtagcgagtttgatagccgcgatattttcgccaggtagaggatctagaatgagcnagcttccagcatgtgncttgtacagcaggnanttnngcntcaatatcgtaatccaagcgtttttagtttccttctgtgatgtagctgnataaagtgttagagattacttcattngnnttatntccagagttttctgccagtgcgcggggaatagcttcaaatgcntcagcaaagcttcgttagtaggatanngttcaagtncaggngatgtntctncatatgatgtggnntggntggcgaantcaatttgtgntgcnccacctccgggtacaagagcgtttatnccttgtgagancgttgtggaagtattgaacaccatcgtntactgccctttctatgtcatccatcagattgtctgtagagcctcgaagtactatggtagaaatggcgccatcttccttttcatgcttaaaaaccaccacctgagtatctccaacttctgagaggtaaacactgtcacagtgtcccatttcttcaaggacaggaggtgtcaatctaggaagagctgtagcaccaacagttttacaaagtcttcggagatcccattttgagtttagcctcactaacatgatattatatttatttgnataatgaagagccatgtctgccactttgccacctgttactacgacatttgcaccagtatcagcaatagctttgacttgtgcatccatgaggttttcttctcccttactaaaattcatcaattcttcagnagtctttatcaaaactgttcccttagtttctg

SEQ ID NO: 708989 - DNA, 146 bp, Homo sapiens
  misc_feature (27)..(27): n is a, c, g, or t
cgatgatggtacatcttagtggattcnaggccaatcatcctcccaactggtggctttcattagttttacaaagacagtttagggttggggagggctattatcatttaaattataaatttctcccaaagttagctttggccatgcct

SEQ ID NO: 708990 - DNA, 293 bp, Homo sapiens
tcaatacctgcttctataacccattattctgttctagatgtcaaacatgctttctttactattcctttgcacccttcatcccagcctctctccactttcacttggactgaccctgacacccatcaagctcagcaaattacctaggctgtactgctgcaaacttcacagacagcccccattacttccatcaagcccaaatttcttcctcatctgttacctatctcggcataattctcataaaaacacacgtgctctccctgccaatagtgtccgactgatctctcaaaccccag

SEQ ID NO: 708991 - DNA, 157 bp, Homo sapiens
tcccacattgacatgtccagctgtcaatgcccacatacttcttccactgcttgaaccactggctgtcaataagataccactgcgccccgcgttggagtgtggcctcattaagggtccaagctcggacttctgagtcattgcaacacggtctctcagt

SEQ ID NO: 708992 - DNA, 834 bp, Homo sapiens
agcggaggggccggggcgcgggcgggtcggtcgtggtgcggcagcagcggcgtggaagcgcgggggctggagctcgacgggcgctgggctccggggcggtggcggacggggagggggccgccagggcgggtggctgcgggatgcgtggtaacggtgcgctggtgccgggcgcgtaggcgggctgctggaggcggactggcgggtggcctctgctcatttgtctcgggctctgctccatattgtgctgcgtgctgggcgcttgacgtgtgagccgcctgtggcgttgtcggcctgtgctgcagtggcttggtaggctggtgcaaggctccggccgaggccctggtggaaactagcgcgcggggcataccgggggcggctcaggctcggagcaggggacgcagtgcacctgagtagatggatgggccatgaggaggcgggagcggaggaaaacggggatggggacgtggtcagacagacccagccccatggttgagcaggagggaccgagacaggccacgggtgcgccctcgggagaggccgggctggcggggtgagaagtcttggggatccgctctcttgggactttcaagcccgggttgcccgggtctggttgagggaaagaggggttcctagacgacgacaactggaatcatgacgtcggacactcctaaaatcggttgagccacagcacacgatggggcctttccgcatctcacatttttaaagtccaattaatagcaccaggacaggcacactgaagcgtgaactggataacccggcagcaccagagcttgcctttgggagaactagagaagatggtcggataagcaacgt

SEQ ID NO: 708993 - DNA, 841 bp, Homo sapiens
  misc_feature (36)..(36): n is a, c, g, or t
  misc_feature (72)..(72): n is a, c, g, or t
  misc_feature (94)..(94): n is a, c, g, or t
  misc_feature (104)..(105): n is a, c, g, or t
  misc_feature (108)..(108): n is a, c, g, or t
  misc_feature (128)..(128): n is a, c, g, or t
  misc_feature (188)..(188): n is a, c, g, or t
  misc_feature (206)..(206): n is a, c, g, or t
  misc_feature (225)..(225): n is a, c, g, or t
  misc_feature (231)..(231): n is a, c, g, or t
  misc_feature (258)..(258): n is a, c, g, or t
  misc_feature (338)..(338): n is a, c, g, or t
  misc_feature (347)..(347): n is a, c, g, or t
  misc_feature (358)..(358): n is a, c, g, or t
  misc_feature (364)..(365): n is a, c, g, or t
  misc_feature (377)..(377): n is a, c, g, or t
  misc_feature (841)..(841): n is a, c, g, or t
ctccccaccccacgcgtaccttttcccgctcctgantctgcgagagtttcagcagctaccaatctttgctancctcactctttttgggtggtcncctgctctcnnccntccctgctctcgcggttggngaggtgggtgggcggggagggggcggcgggtgaggcccgccctccgctgacctctctccntttctcccagggcttccngctgctggcttggtttccnttcaancccacttcccacaagtctccagggcantgtcacttcctccaccctggttctcttcttccagcatcctcagctcctccattctcctgcggcttctccactatcttttntaaaggttnttctagctttntggttnnttatcttctgcncacacctcccacccctgctggggccccaggtcagcgccggcccgccgcgtggcgtcgggtggtggcgggtgaggtggggggtctgggggaaggcctttccgcagtcatcgcacttgtaaggccgcttgctattgtggaggtggtgatgctgcagaagcgtggaggagcggcagaagcccttgccgcacacggcgcacctgtagggccgctcgcccgtgtgggagcgctggtgctggatgagagtggaggagcgattgaaggtcttgccgcagtcggggcagctgtaggtgcggcctggcaggtgggtgcgggcgtggatggccagcaccgagctctggccaaagcgcttgccgcactcagggcacttgaagggcttctcccgggcgtggctgcgggcatgggggataagggccgaccgctgggagaagctcttgccgcagatgccacagctgaagggcctctgn

SEQ ID NO: 708994 - DNA, 1180 bp, Homo sapiens
gttgcggggctcttggttggcggtttccgtgctcgattggggtgggtttgtggtggcttcccgtgtgtggccctttgtgggttctccttgttcctcttggtcgcctgtgtgcctgtattttcttttatgtctgcgatgttcttgcatcccctttttttctggttatcccctctgggtcactttcgggtgtgtcccctggttccctgtcctcggttgtgccccgggtgatgtcccccatgcatttgccctgcgtgtccatccacttgtccctgttttcctctcattggggtgtagtgatgaggctctttatgtcttttcttggccatgggggccctcttcccttcttgtgccttgtgtcctttgtgtgtcttccctcttgttgctcctggtatctgttgctgtggaagtatacccttcaggggttattggtactggtccctcacctagggtacagggagaagagagatagtgtgtgtccctcataggtatatattatccaccctcagaaataattcgatttgtctgtaccaagtgccatcaaaggaatcctacgttgtacaattgtactgtccaggtctccggggtcaggtatacggtactgtcatgggagtcgctgtagatgcggtctccttcatccgcttctagtaattaccacctcagacactgcctcagtctgctcctaatatgtccgaaaggtaaatgggatcaggtggacgatctcttccttgctactagtggacccgtgttacactcgtgtgtggtctgctagtgtaagtaacctgttaccggcaattatttgtgtagtgtcaaaccttgttcacagtgcttctaaattggcagcctcttgcctcaatgggaccgtgcacctctccctgccaggagttaactagtacatccgtgtgcaccctgccatgcaggtttctttctaagagaaatacgagtgtgtctcctgtagtaactgtaagaaaagtccatggagtgcacgatagttgtgcctaccccagattgtagaatgttaagggcactgaggactcaggcaccacagtgcgtgttgcccctggtcattttctttaggtctttgccttgtatccctcctcttcattggtttaatgtatcgctaccaatcggtggaagtcctagctcttactccattgttataaccggggatcgacacctgcta

SEQ ID NO: 708995 - DNA, 231 bp, Homo sapiens
agcatcgatactttgacaaagctgacaaacaagcagtgaggaaaaagagtccctatacaataactggggatactggctaggctagccatatgcagaagattgaagctggactcctttcttataccatacacaaaaattaactgaagatggattaaagacaaggtaaaacccaaaactataaaaatcctggaagaccggccggacaaatatatttgtccggccgtccaaata

SEQ ID NO: 708996 - DNA, 1149 bp, Homo sapiens
  misc_feature (851)..(851): n is a, c, g, or t
  misc_feature (956)..(956): n is a, c, g, or t
aactgggagtggtgtttgttcaaccaacagcacgttgttttgcctctagccattagcacgtagtgccgatcgcaccacaatataatagtgccgacgaccaggttgagaagatggtattgtatgagcattgtgggaagaaaaaaagaatggtggcctgtgctccaccggcacaggaagaagtggggcgtcggtaataccacagatataaaacctcttcgtcactatggggcacgctctagcacgatcgggtggtagtggtccccgaccaccttcggtcgtcagttggtggaagaaagtataacaggggagaagatctcacctacggcgggtctcttctgctaaagagagaagaggggcggccccgtctttggtcagcatcattatcatgtgggtggaagacctcgttcttttagaagagcgcaacaacaacatcttttcttccggcagtgcttacgtgggacacagcgggaggaaaacatgttctctctgcagaggcggagcacaataattttatgtgctctcctctcctaaaagagggctgtttcacacacgacactctctgttgccacacatctgctcacagcagagagagaggagtatgacacacacagcagagagcgaggtctcagagagtgtaagagtgtttttgttgtgtgggagattcccaacagctgttgagaattgtggtgtgttcccacacggcacacacagcgcgggcgcatctgctctgtgagagactctctttgagagagaactctgtggagatatgtagttctacagaggcactatgtctctctggccatctctttaatatatcttcgcgtgagaaacacagcacatatatatatttntgggggtgtggttaagagagagccacacacctaagagacttctttttgagagcccccctctcacactcacactatgcctcttcacccactcgtggcgctctgtcnctcttgagagagagtgataaggtgggggtgggagagttgagaccacagagagaaaaggggagagaagaatttcgcgggaaagagaccccaaagtggtttgtgaaattctttttgtgtcccttttaccctacagaaaaggtcacaagggttttaattataaaagccctgtatataaaacatttggggccctgta

SEQ ID NO: 708997 - DNA, 1168 bp, Homo sapiens
ggctctgaccgctgcagctaccccgttagcatatcattacagcgtcgcagcataccccatatattggttggccacgtcttgttacatgactagagtcccacaaatttgtctgcgtcgtatgagatcgctggagaaattcgcttgtcatggtctgtgactatatactggcccggaagttgctgttgtcgcggctgctacattaaatgctttcatatcgacgcttggtttaactggtcggcacactctgacatacgtagtccttaactagtggcagccacaatagttctccggtgtgttagatatgatcgtgttgcttccaacgaggctgtgcgcacttccagaagggcccacggagagtaaccgtgtgttcataaccggcgtgatttgtgctctcacagtttctttgtttgcccgccaccgttgtaggtgttttaacagggagtgtgtgcgcttttggtattcgagatatagtggtatgcttggcaccaaagatatttgtggcaaaggaggttcttgttggtgtactgtaatggcgcctgtttagagttacatgcagtaagtatgtctgtagagagatggtttctagtgtgctcgtgttagttaagtgtgcaatttgcgcctcactcaatatgtagtaggtatttcccaacctgctggaggtcagccaatcttgtgaacctcacgggaatgttctacactacgtgttctgataatctctggtaataacgactttcacgtattggctgtccgttgctttccgtggtcccgcttccaaacgagtattgtctagtcaatacagaggttggctaaagtatttagtcgtaatatcggacttgtttgttgtccccctggagtctctgtataatttgtatacggtgttcctagtataatactgtagtgatccttcatgaagaccgcaaaggctcaaaatttacggtccattgaaggaccattctcattgaggactgtattcttattcaatggtcaatttgcttccatgatatctcagttttagaaatagaagttctttatgaacttagtgtccattgtcatgccatgtttttttttttccattcctttttcgctgtaattattggaatttctggtcctgggaagaatcaaacaaaatcttaagttctatgagataccgctggggaacatattctgc

SEQ ID NO: 708998 - DNA, 249 bp, Homo sapiens
atttaattttggttggtttccccggggggggggtttcccaaattaattacccccggttcccccttttcccttttttttttaaataaaaagccaagccttttttttctttggtattttaaaaactggaaaaaaaaaaactgaaaaaccttggggggaattttggacttttttcctgggtaaaaaatggaccttttttagctttatcgtgggtgtttattttaagtaataaagtaaaaaagataaagttga

SEQ ID NO: 708999 - DNA, 917 bp, Homo sapiens
aggtgtttgttccgcgcagggtgcgcgcgcgtccctttgtggaggtcctcgccgccgtctgctgcttgtaatgccaggcgggggacccgccgagtccccacccctctttctgggggggacccggactcttcgcagcaccttccctgtcggccgagacacttggtgtgcgtcttttcggcccgctcgcgcacaaattgcgccccttggtgggcgcttctgaacacaccgcccgctgtggccagtggcctatgctccgccctccacgtgggagcaattcttggtccgccccccagtttaaggagcaccacagggcccccacccaggctgtctgtgaatcggctctgtgaagggattcccccccccctctctgcccccgaccttttttgggaccccctcccccttggagaacaccacactcacccgcgtttccacaacctgaaggattggaacatgggagagccccgtataattctcttgcgagaaaaaaaaagaggggtatacaaacactcgttggttactccacactatctcgcggcttatttcattttacaatactgacgcgatattctccttaacgcctcttcttccctccccccccattatttgcttcgcacgcacggtggacacctacacaacgccttctttaaattacccctccgcaaccccgagttcttctattaaatcctatcatcgggtttcaatgccctatatcttattgtcaccacaacaaagctccttctggtccacaatgacatatgtggcgccccccccgcgcgaataagtataataacatgctgcccgcctcttgcaaggcgatcacaaacaccccaccccttcttttctttgtcgtttcacatttttacgattttaatacccccctgtggggtaaaaacccccaaaaaaccccccacaaaaca

SEQ ID NO: 709000 - DNA, 895 bp, Homo sapiens
  misc_feature (137)..(137): n is a, c, g, or t
tacttcagactatcttgatggtcaaagtgtacgaactgtaattttacaatttatactgccacatgattgtaaatttgagtgtcttaagttaggacatggtgaaacagctatttatggctggattgtggcgtcaaaantgacgttattttgcacaaaaagataacataatgcggaaggaacagggctggtataacatgaaattactgggcaagacttcactatatttggtgtggaacatttcccttcaagatcaccttacctgattaaaccctttagatttcccttgtggttttcaagtttccctcaaaacgaatgcaaatggaaataataggcagaattgttaagcccattataaacaataaaggtgtaccacaaatattgtacatgtattattgctgctccttcttcaaaattaaatacagggtttaaaaaccacattaatgtggtaatcaacatctcaatggatacaaataaggtgtgcttggtatacattaatattttcttccaaagatatatcttgtggttagaaaccacaaaaaaaataaaactagtaatatgtgtatgttatctatctctacatattccaggcatatgtttagggttaataagaatctgtcctggtaacctgtgtcttgtgggatttccatttgtggttccaatccaaattaggcaccacgaactggttaaggtgtatatgaattaggctagaggattttgtggagcagacaccgtgctgttgtagtcagataacttagtacagacccctaaagtgtcatttgtgttctcccacgaatagccctttcttgcggtttcccagggacactgcgtttaaaaacatcttgcgtctgaacaattgttccaggtgataccctagccaaaagggtcgataaatacc

SEQ ID NO: 709001 - DNA, 384 bp, Homo sapiens
  misc_feature (342)..(342): n is a, c, g, or t
tgtgtttgctgcaagccaaggggcttggcttggctccctggctcctggggctgctgatcctacccttggtccagggctggagccttacaacttgtgtgaagaggagggccctttcggtcccactctctcggaagggaggaagtcttaccagcagacccttcagaccaaattagacgattggctcaaagaggagttctgtcctaatttgcaccacagtcctccatgactgtcccctttctcacatcttcccactcacccccaccctgctggctggagcctatgacccgtcagctcctagtcactgccaggcagagccagctcttctcccagaggtgcatctgncccagcctgtcagggccttgctgttgtcatcccttcttcctc

SEQ ID NO: 709002 - DNA, 417 bp, Homo sapiens
ccgggtcatcataaaaaagtactacacgcgcctgggcaacgacttccacccgaacaagggggtgtgcgaggagatcgccattatccccagcaaaaagctccgcaacaaaatagcaggttatgtcccgcatttgattaagcgaattcaaaaaggcccagtaaaaggtatttccctccaactgccgggggaggaaaaaaaaaaggaaagcccattatgttcctgaggtttcacccttggatcaggaaattattgaagtagatcctgcccctaaggaaatgctgaagcttttggacttcggcagtttgtccacccttcaggtccctcagcccccagttgggatgaatttcaaaaccccccgggggcctgtttgaattttttttgtagggctgtattattttcaataaatttggggcccca

SEQ ID NO: 709003 - DNA, 263 bp, Homo sapiens
tctagaggatccctgtggtactgctggagatctcaccgagtcgcgctacaggttaccaccacggcgagcgggaaatcgtgcgtgacattaatggagaagctgtgctactgtcgcccctggacttctgagcaagagatggccacgggtgcttccatgctcctaccctggagaaagagctacgagcttgcctgacggggcagggtcatcacccatcgggcaatgagcgggttccgcgtgcccctgaaggcgagtctttccagcgg

SEQ ID NO: 709004 - DNA, 314 bp, Homo sapiens
ttacaggcaggaactaccatgcctaaccctttcccctacctttcttttttggaacaggatctccctttgtcacaaaggctggagtgcagtggcgtgatcatgactcactgcaggcctcaacctctcaggctcaagtgatcctcctgaatgcttgggaccataggtatgcaccactgtacctggctaatttaaacctcctatttcttgtataccaggtctgcgaggctcacacctgtactcctaccactctgggagaccacaggctgcgaggaccgcttgaacccacgacttcgcgactagcctgggccacctag

SEQ ID NO: 709005 - DNA, 281 bp, Homo sapiens
ggccccccaggccctttccccccccccagggtttttaggggccaaggccccgcccccctttttgggtggttaaatggggggttaggggggggggtccccacctccctttaagggcccccccattttttgggcccttttccgggggggggaggtcctttggggcccctaggggttcttccttgggaaggttttgggggggggtccccgggggggtgggccccaaaggcctttgaaaacgggggttctttcctgggctgaattaaaagggggtttccccctga

SEQ ID NO: 709006 - DNA, 214 bp, Homo sapiens
  misc_feature (1)..(1): n is a, c, g, or t
  misc_feature (7)..(7): n is a, c, g, or t
  misc_feature (9)..(9): n is a, c, g, or t
  misc_feature (24)..(24): n is a, c, g, or t
  misc_feature (35)..(35): n is a, c, g, or t
  misc_feature (50)..(50): n is a, c, g, or t
  misc_feature (59)..(59): n is a, c, g, or t
  misc_feature (73)..(73): n is a, c, g, or t
  misc_feature (75)..(77): n is a, c, g, or t
  misc_feature (79)..(80): n is a, c, g, or t
  misc_feature (87)..(87): n is a, c, g, or t
  misc_feature (120)..(120): n is a, c, g, or t
  misc_feature (129)..(130): n is a, c, g, or t
  misc_feature (145)..(145): n is a, c, g, or t
  misc_feature (150)..(150): n is a, c, g, or t
  misc_feature (154)..(154): n is a, c, g, or t
  misc_feature (157)..(157): n is a, c, g, or t
  misc_feature (162)..(163): n is a, c, g, or t
  misc_feature (166)..(166): n is a, c, g, or t
  misc_feature (169)..(170): n is a, c, g, or t
  misc_feature (174)..(174): n is a, c, g, or t
  misc_feature (178)..(179): n is a, c, g, or t
  misc_feature (181)..(183): n is a, c, g, or t
  misc_feature (189)..(191): n is a, c, g, or t
  misc_feature (193)..(193): n is a, c, g, or t
  misc_feature (205)..(205): n is a, c, g, or t
  misc_feature (207)..(207): n is a, c, g, or t
  misc_feature (209)..(209): n is a, c, g, or t
nccgctnangcgcgctgcagcaantgcagtggggnagaggcgcagagcgngcgcagctntatgccaggtgtgngnnncnnctattcngcgggtaataacaactactaacctcttctatantctaaatcnncacctatcaaaatanacctnaaanatnaacanncanacnntttnaaanntnnntcaatnnnanaaaacccccccncncnccccc

SEQ ID NO: 709007 - DNA, 519 bp, Homo sapiens
tgaagctaccgcgcacaacagaagtaacccatccctgtcggtcttaaagtggtagggttttacaattcatgataccagtgacacagtaagttgttaacggatactatatcgcactgggcgaaatctagcccagtatgtcattgtgtgcccctcgtatctgaggaggcctgtgttggcactatcgtggtactctgcgttcactgtgctctagatttacctgatctatatagttgtttctgagtagcacggagtaggaaagaaccacatgtaaatatccttagagaccatcctgcagaagacggtgctaactcggggctggaatcctccatctatgatcctggatgttctcctgaaggaatgagcgtagcctgttttataacgtcgcgactggaaaaacaaatgacataaatgtcataaagtttattcctgtgtatacacactctgggttcaggaggtttcgtgcttacatttcactactcaaatgccttcgcgaatttcagaacattcctcaccatcact

SEQ ID NO: 709008 - DNA, 539 bp, Homo sapiens
ggcacccggggtgtgctatgggatgagcagcggggagtgtgggggtcccgagcaggaggatccgtgctgtccggcgcgacaggccagaggatgattctgccttggggatgatacagcatgataaaagcatatgataaagctgtggcttcattaggcattgtctaaagaatgtgacttgtgaaaatttcgggtaaaccaaaaaacaaattaaaagaaaagtgttagaagaataaaggccaaaaaaaaaaaaaaaaaaaaaaaaaattttggggcgcgggggcctaaggaaaagaggttttgaaagccatctctgtggggggccggcgcccaagaggtgtatggtagcacccgtgcggcaaagggtgggcccaagagaaacccggcgacacaggatagggggggtgggtttccaccccaaaaaaaaaaaccggcggggggggcaaccgagcgtgttggggacacaccccgaggggaggacggagggcatacggggtcaccacacgaggggcagaggaggccaagtaattacagcgcagggg

SEQ ID NO: 709009 - DNA, 146 bp, Homo sapiens
gggtaaagaaaaggtaaatttaaaaattccaataattaaatatttccatggaaaactaatgggaagactaatggattttttatattgcaggggaaaaggtaaacttgtttttgatggtatcaagataaaatttatttaaccttgga

SEQ ID NO: 709010 - DNA, 897 bp, Homo sapiens
  misc_feature (307)..(307): n is a, c, g, or t
agcgggaccggcgtgaggcggcgcggcagcgcgagggacggcagtctcgcgcgggtactgcagccactggggtgtcagtgtgtaggtcggagccatgaacgcgttcagtttctgctgtctgcgagagggatatatagatagactgagttgcgtgtgcctctgtttaactagagagatgaagtactggatacacgtgaagcgatggcagagagaagacgcttcacgctagagcaactgaataccaagtgggggaattttggctaaactgcacctggcagggaagactgatggaaggcaggaactaaangcaagttgtagacacaaggatcataagtagaatcatcgttgaattgatgaatggggttgaaagtgtagcgtcgaattgcttgcatatcagttagcgaatggaatgcatggggggcaaagtgaatctggacacagagggaggcacagacatattcaaaggctgctcccgtatcaagtagtacagatggccaggtggtttgcaagattccaagacgcgacagttgggcccctgaagccgcatattgggacgtagtccagtggctggatgagtgggaatacaagtttgggaggaatagtctctgagacgaacatatctagtccgcgtagcctttggaacgaggggcctggcaggtgtgcgcaatgcatccctactgcatagccagacgcagtgctcccggctcggaagtctgaatgcctgtgggaatggctgtaaatttacgcaaactagtaatacacacgggagtggagcttttgatctgggcgtagttggagggctggttgaattcagtcgaggaagtcttagcagagagcgaattgatttgggggtccaatgggtgccttacactgcaagaggaactttacggagaagat

SEQ ID NO: 709011 - DNA, 380 bp, Homo sapiens
caattggacgaagtctctcaatttcttctgtacaacccgtcaagtaggaatgaggagcactgaaataggatgcatatgtatcatgcagtagggagttggtataagtaagcgtaggtccaacggtgagccagactggtcgaatcgtactatctcttccaaatatatgaaggcgtcttctaccaagacaaaacagctcaattatatgaaagatgtctacaggttagactagtatagccaatatcaggttacttctgtgatacattaagtcaatgtcaacgtacagcatgaatgacgtccccggtgtgtgctaacgcttctacagatcctgtggcatcccccatggatgacagagtgcacttttgtactcatgaaaagaccag

SEQ ID NO: 709012 - DNA, 615 bp, Homo sapiens
  misc_feature (199)..(200): n is a, c, g, or t
  misc_feature (615)..(615): n is a, c, g, or t
gaatatgatgaatagctgaaacacaaggaaagctagaagaaaaacttcaggagtggaagcgaatcccccaagtgatgtatatctctcagtcaaggagacaggacaaagtacttgattggcacttctgtgcaaagtcttgcaatttggctagatgccacgaccgtcgtctcgaaggctcgtctccgcgttaagcactggnngatcagggcatggaatggcaccttatcgtgcgagggtattcacaccgtggtgccccagacaccgaaccctatggagcaccagagcttcaaaaggcgacaaactggggggcattaacctttcccgaatggtttggtttgggccccgtgtgctggagggcctttattatcaaggcccagagggaaaacaggggcccccgtttaaagaaaaccgcaatttttataacaacccacacctgtggagaacaagttaaaccataggctcttaagggttgtggcccgggtaaaccaaaagggaggggatatatcccggagccgttataaacccaaagcaggggcgcgccactttttctcaagggcggcaaacttggggcttcggcccacaccgggttgggaaaatttaaaacgcccttgggan

SEQ ID NO: 709013 - DNA, 117 bp, Homo sapiens
atgtgcggggtccatggtctgctatctttctgtaggtatcacacgatgaacaagttgagaaccaccatactgaagggatagggtatcacatgatcgcatagagttcccctaataagg

SEQ ID NO: 709014 - DNA, 643 bp, Homo sapiens
  misc_feature (248)..(248): n is a, c, g, or t
ccattctaatcgcaatggcattcctaatgcttaccgaacgaagaaattctaggctatatacaactacggcaaaggccccaacgttgtaggcccctacgggctactacaacccgttcggctgacgccgatagaaacgtgcttcagccaaggcagccgccgtagaaagcccgcgcacatctaccatcagcccgtcgtacatcaccggccccgacgctgtagctgctcaccagtcgctgcgttctactatngaagcgctccccgctgcccgcgatagccgcgaatctccccgcgtgggtgcagagcctcctacaacgcgtgatgggcctgcgctaatttctaattcgtaaggcgctagcgctctgagccataggccgatttactcgaaagtccttctggatcaggggagtgaagacaagttcaacacgtgcagaatcctatcggcacgcgtgcaatacaggtcggcaagcctggggcgtaggacaagggtaaggtcaccctagaaatccacaatacatcctactaattccgatacgtttccacccccagtgaggacacgactccattctgcgtaaaccatcactcaagaaccaagtgtgaccgtaacaatgaaaacgctggcggctgcaccttgtataacatcgca

SEQ ID NO: 709015 - DNA, 1416 bp, Homo sapiens
  misc_feature (445)..(445): n is a, c, g, or t
tataattggggaaagggggggctcccccccttcccattaaaaaccctttttttgccccaaggtgggggggggggtgtggggggtgtgtaaaataaaatttgtagaaaataggtgtggggacgccgtgttacagggggtctccggaagagggggtgtgtgggcaggacagagaggtctcagggaccccgtgaggccgtgggggtgtgcccggtggaaaacaccctctcctgtggggcgcctcgaggggtgtgtgggcccccagttatcttctgtgccctcgctgtggcaccaggtgcagcgtggctcctcgcgtaccgcccgtgtgtttctctcctctacaccctctctggggtggacgcgggcgagccacatgtgtgtgtatccggcgagtctttctgtgtgcaccctctctatcagagagacgcctctcacactctctcctctnctctctatgagagcgcacaagtgtgtaaaaacagaggcgcctccccccagaacacacacgcgcgcgcacgagagtgcactccgcgcgcgcaagagacacagaatctcggaaacacgggcgcgcgccagagaagagaggcgtggccccccccgcgagcggcgagagagaggtggcgcgtgcgaaggggcacaagcggtgtgtacatcccgcgagagggttgtgtaaagccagaccccccccagagaaaaagatgcctccgtgacccgcagactcttgtgttgtccccatacgtagtagttgccccccccgcgtggagtcactatactgtgaagcccccactgatatataattaaaacaaagaggagtgtcgcccccacgaggtgatctttcacatagtagaaaaaagacgcagtggtggagtgctaaatacaacccacaaagttgcgtagaaaaagagaatctccaccgacggggcaccccatctcagagtgacgagccgctctatgaggacgtagagaggagagacaacaaaagagggggcagagaaggccgacaccacacaaaagaagtggggatatcatcaacgagaaagacaaacagaccaactttctacaaatcagccaacataaaaaaaggagggggtctaattaacacaccccacctttctgatgaagtggcgctactgactcaccagagatagtagcaaaagggtcaccccacaagaaaaaaggcgagcgatgtatatgtgtgctagctcccccccctagtcagtaaaaacgtcggttaagcttaacgaaggacgagggtgtgattccacactatacctcacactgagtagggccccccctttttcaacacagaagaatactagccgcggcagcgagtctcgccagatatacatactccaagcagaagactgcataaagtaggaggcaggtagaatatatacagtggcatgcagtgcgttgtgt

SEQ ID NO: 709016 - DNA, 106 bp, Homo sapiens
acttcctggaggagcaggctgagaagaggggaatctccggaccccgaaaccctacacatctggaagaacaacagccttcctctccggttctggggtgaacatcctg

SEQ ID NO: 709017 - DNA, 467 bp, Homo sapiens
  misc_feature (430)..(430): n is a, c, g, or t
ctggaagaatgactgggaggcctcaggaaacttaaaatcatggcagaaggcaaaagggaagcaaggaccttcttcacatggtggcagaagagagagagagagatgggggaagtgccacacacttttaaacccgtcagatctcatgagaactctttcactatcacgagaacagtaaggaggaaatccaccctcatgatcccctcccctgacacagggggattacaattccgacgtgagatttgggtagggacacagggccaaaccacaccagatatagataaagataaaaaaaattaagaaagacaaagttagataaataaccctataaaggttaaataacctttaactctataaccctataaagataaataaagaaaaagatagataaagttggtatcataaggtattgggctatgtggattatgggagnctaagaagtccttacaatctggccatctggaagctgg

SEQ ID NO: 709018 - DNA, 394 bp, Homo sapiens
  misc_feature (93)..(93): n is a, c, g, or t
  misc_feature (142)..(142): n is a, c, g, or t
  misc_feature (186)..(186): n is a, c, g, or t
  misc_feature (191)..(191): n is a, c, g, or t
  misc_feature (218)..(218): n is a, c, g, or t
  misc_feature (237)..(237): n is a, c, g, or t
tgatttgtgtgaaggtaatcctgttaatcccacagtatctcttattttattagctcttcccatgagagagccaaggaacccatgctaaggccnccaagagttaagccatttggatggcaattaaaatcaacagggctgggcntggtggctcatgcttgtagtcccagcattttggggggccggggncggcngatcgcctgaggtcgggagttcggcgnacgcctggccggcatgatngaagcccatttctactgaaactgcaaaacgtagcccggtgtggtggcacatgcttgtggtcccagctgcttgggaggctggggcgggggagtcgcttgggcccgggaggcggagattgcggtgggctgagattgcgccactgcactccagcctgggc

SEQ ID NO: 709019 - DNA, 521 bp, Homo sapiens
gggcatttgtggaaaccagatgtgctggcagcttacgggggaagtggcagtgtggggtgggggatttatgcattggcggttggttccatttcggccaccaggactgaccctcgccccactccgtccgcaattcctatggagcctctctattttacctctttccgtgcatccactgcacaccgcacaaaagccacattcagctatgctttaggagatcctggattgggaatctgaggagggaagagaggaaggacaggtcagagtatcaacagaagatgcacaccatacatgctaccgttgtctaacctcagattgtcctgccaattcgactgagaagcattccaaccagtccgccatcatatgggataatcattccacgagaacaccggcacccaaatatataaacccagttcatagaacatatataaccataggcatatcaggtattacacattacccaccttgagttggatgataggcttagaaccccacatcaataaccaaacaacacttccccatgg

SEQ ID NO: 709020 - DNA, 232 bp, Homo sapiens
ctagtgactctagagtatccccccgccaaactggattcactgggtttggtaccttcagccctctaaaagcatagggcttagccatgcaggcttccttgggctttctctgtgtgtgtagttctgtaaacactatatcatctgttaagatccagtgtccatcgaaaccttcccacattccgtgactctagaccccttcagtttttggaaagcagggttcctctgccagtgatat

SEQ ID NO: 709021 - DNA, 117 bp, Homo sapiens
  misc_feature (64)..(64): n is a, c, g, or t
ggaccctcctgggccttaaaggatgcggactcatcctcagccagcgccatgttgtgatacaggngtgtttgttggatgggtttaaaaataactagaaaaactcaggatgcttcttga

SEQ ID NO: 709022 - DNA, 807 bp, Homo sapiens
catgagactgttccccccatcgaaagctgacgctggtcctttctgtggatggatttctcagagtacacagatatcagcatgggtgtgtttcaggtctcccaaaattcacacctttgagataagtaccatcagcacgtcaaaaatgtacacccatttagattgtggtatgcaaatgtgcaattgcgaaattgaatgagaaactgagattcctcagtaatggtgaatatttcgctctttagacctaaaacatcttcattgagtagcttatatttgaccatgatggttaaacatttgcctctacctctgattatgctgtgctgtcgacgtttaacaccttccaagttacttatgtgtgtcctgtaacacaggtgactgaccgtactgagagggaatggccaagagaaaggaagccagacactaggagaatgattaacttctcatagttccccacattgagaagcatacggagtgtatttagcctgtagatgtggtgatatgcaacatatcccattgcctggttactggcattcctaagatcttcatggtatttgcaaactgggataattcacagattagaagagtatctggacagttaatctctgttctccttacaaattcctttgtgctgtggaacggatctggctagtgatgactagtctatcaagccttgctcaaagccttagtagaacacccactatggatcagcttacgttacttggtagacgttttgccacctctggttgtccggaaattgcgtacaggtctcgcttccaagacggaacctgtttccggagcgcaggtacttct

SEQ ID NO: 709023 - DNA, 385 bp, Homo sapiens
agcatctaacgacagtcatatcaggttagtcgagtaggaaggctaaaactctgagaacactttacatcaaacccccttatccaccaatattaatacttccaggtcttgcgaaactgcagacaagtcattctcggtatgaaactcagagatgagatggggatatgatgaacattctgttgcagttgtttgtgtgagaacacaggaatataccggatgcgccagtctcaacacgatttctcctccaccctaaactccctctttcagagcagcccttggagatgctcttcctaagccctcattaagtccatctgtgaatttagctaagcctgccttgaacttgtctactatttcaggttgcataaactctcggggagggagtcccaca

SEQ ID NO: 709024 - DNA, 892 bp, Homo sapiens
gaaacgccagaaactggtgatcagcagcttcccagtaagatctcaggaggtgggtgagtgggcttaagcatgtgcatgaagaggcaaaatggttgatgcttagctggtacatgaccttcctctaggaacactcaactgataagggaagaacacctcaagtgagcacacatatagcttcagtaaacacactcacatgcagcccctcccaagtgctggcaggccattgtacatgcagactgccaacatataaaaccacaagtcaaaggtcaaaccatgcacttgaatctctcaaggtccctactggccctcttccacgtgtactttatttccttgcattcctgttctaaaactttttttttttttttttggaaagggagtttcgctctggtggctcagggctgggagtggcaatgggggcagatctcagctcacaggcaacctccacctcccagggttcaaggccgattctccggcctcagcctccggagtagctggggattatagggcatgtggccatcatgcccgggctaattgaatattttaaggtaagacgacaggggtttctccaggtgggctcaggctgggtctcgagctccgggacctcaggtggttctggcccacctcccaaagtgctggggattacaggcgtgagccaccatggcccagttaaaacttttaataaggtttcactccgtgcggtgaaactggcctgggttacttactcggtcttatgcccctgggttgaatactctcttctgaggaggcaggatacaggttgctgaggcccgtttggattccacgggtactaaatctccatacaagagaatataatggggccataaattgaattgaagttttgatacaaagctaacatgtcgaattaccttgtgat

SEQ ID NO: 709025 - DNA, 164 bp, Homo sapiens
aagatcacgccactgaaactcagccagggtgacagagtgagacctggctcaaaaaaaaataacaataataatgagaatggtccagcagtggcagcaccagcacattttggggtctagaattgacacaggcaaggaacatgaggcgactgggtccagggtaccga

SEQ ID NO: 709026 - DNA, 397 bp, Homo sapiens
  misc_feature (276)..(276): n is a, c, g, or t
tgttgtgtgggggtgtcccgtgcattgcaggacatccagcagcatccccggcctcctgctccgtgccagtagcgccgcaccccgccgttgtgacagcccaggtctcccggtgtgcagaatgcccgctggtcatgctgagaggtacaggggtgctgcccccagggtttgaacgctgtctaactcccacctctggtgtgtctctcccctgtgtgtagcgtggagtcactggatgagtgtggtgacctccctgtgtccagctgccctgggctgcaagcnggtccctcctgcagcctccaggccacccttaagcagagctggaccagcctggccaacatggtgaaaccccatctctactaaaaatacaaaaattagccaagcgtggtggaactctgtctca

SEQ ID NO: 709027 - DNA, 471 bp, Homo sapiens
agccatacctgcttctgctacagcccaccattgatgggcgtcacacctgtgccgtcacgtttgcggcgtgcgcttccctcgcagccctacactgtcactgttggcaagcctgtaacccgagtgcctgccgggtggttggccggggcctccagcccaagggtgtgcgggtgaaggagacagctgacttcaaggtgtacacaaatgggcgctggcagttggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcaggaacatcgggcgcagtcccttcgaagtgaaggtggggcccgagttgtggcactcagaaggtacgtggcctggggccctgggctgtccgggggctgctgacgggtaccgagctc

SEQ ID NO: 709028 - DNA, 188 bp, Homo sapiens
tgactctacaggatcttaaggtcgtataaaatgtagagcgatggtaaaagaactgagagatcatgctgatagtaacattgtaatcatgcttgtgggcactaagagtgatctacgtcatctcagggcagtcctacagatgaagcaagagcttttgcagaaaagaatggtttgtcattcatcgaacctct

SEQ ID NO: 709029 - DNA, 142 bp, Homo sapiens
agttcaggtttcagaacaggggacaggaaaggcagaaaggagagttgcaatgatgccacactcctagcacattacccccatcctatacagaggctgtgagagaaagggcgacaaaacgattagggaaagtgaccgggtccat

SEQ ID NO: 709030 - DNA, 433 bp, Homo sapiens
  misc_feature (112)..(112): n is a, c, g, or t
ttttttttttgagggggaggtttccggggaccccccataaagaaatcaatggcccaagcgggctcgttgaaacccccccgctctgggttcatgcaattctgcctcagcctcntgagtagctgggattataggtgcccgccacccgtaccccagctaatttttcaatttttagtagagatggggttttgccatctcaaagcctcagtgatgtttagtagagatggggtttggccatctcctgacctcaagtgatccacctgccttggcctgccaaagtgctgggattacaggcatgagccactgcgcccagcctggtgtaatgttttcaagattcatcaggttgtagtatcattacttcattcctttttattgccaaataataccccattgtatggatatgccacattttattaatcccttctgtcgtcttctc

SEQ ID NO: 709031 - DNA, 242 bp, Homo sapiens
aaagtagggaggtattggttaaactaagggagaactcctaactctcaaggtgagaagaaagaaaaacaggaagaaagtcgtggactggattgtcttccctggagtgcatcgcgttgcgatccagagaagcagaagctatgacaacataactccccgcgcaccatgctacaactcacaacccccagatctttctgctgtcacttccctttcacaggcccctcactctccttcgcgaacgccac

SEQ ID NO: 709032 - DNA, 103 bp, Homo sapiens
atgtgccactagctcatgcctgggcgacagagaaagactcctgtctgaaaaaaaaaaaaggagagagagagagatggggtttcgccacgtttgcccaggttag

SEQ ID NO: 709033 - DNA, 821 bp, Homo sapiens
gtgctgtctcactataaagttctccgctcccagacatgggtccctcgagtatcctgccatcggaatgcgcagcagcaggcatacgtggagaaggtgaagagcttccctaaggatgacccatccaagccggtccacctacacagcctatcctgggatacaaggctggcatgactcacatcagtgctgggaagtcgacaggccgggataccaaggtgaacaagaaggaggtggtggaggctgtagaccatatgtagagacaccacaccatggtggtttgtgagagcattagtgggctacgtggaacacccctacgaggcctaccggaactaacaagactgtcttatgctgagacacatacaagtgatagaatgcacagaggcgtatctataagaaatggcactaaatctaagaagaaggcctattacccacatactgcacagaaacggacaggatgaggatggcaagcaagccagcaggagaacggactacaggcagcactgaagaagtacgtgacaaggtcatccagtgatcaaagacacagcacaccagaataacagcctgcaacccgtcagcgccaagaacgcaaggcccacacaggactgggagaaacacagggtgaaacgggaggccacctgtggcccgagcaagcatggacaggggaccgcgaaccaggccatgcacagcaagagtacctgaggaaccaacggagaaaggacaggaatgacatgaacgacgacaatcggggatgccaaagggcaaagagcacaagggggaccaaccgtgagacacaggaaacagcccgaaaacaacaggctacacag

SEQ ID NO: 709034 - DNA, 803 bp, Homo sapiens
tgctgccttctttacactgccagttttgacaaatacaggtgtttgtctattttattttacatacaacatatgcctacatttctgtcagcgtattgcacagtaacttttcacagtgcattgtgattacttattggtaactgtatagggctgatggcagctttactagatcactggttataatttgggacaaaaactgctacatcaactttcatctcgcccagagtgctcaaggctggtatgactcatgtggatcaggaactgcaattgtgaattccgtgcccagttgcctctcttggtgaactgtggaaatggccacctgggtttacccatatcaggaagggctccgggatggcacctatattggctgataattgcaggatgcaaacattccattcattagctgtgactcgagctgttaacttttctagactatagatcaaaatgtgacacattttatgttcaatccactatttgtcttgcagcattataaatatcacttctttattcttttagtaatttaggggagcgcgacggacggagaaagggatcctgatgcccttggcatacttcacaaaagcagctgtgacaacctccaaatcagtttacttcactttccaaaacctatttccaatcaccaggacaagatccatccaaaatatactcgtacattctcacctgtggattgtctataccttcaatcctcagtatgtgcccaaatctgtgctgtcattgaacaggacaccacctcatactagtggggtacacctactaatcattatccgaagcattattccccaacacaa

SEQ ID NO: 709035 - DNA, 441 bp, Homo sapiens
acgctgctaggcacctggctcaaaggcaatgtgctgaccgccgcggaagcgggcggctggtccgccgagttcgatcacgatggcacaatgcacgagatcggcgtgctggatgtcggtaccgacggcgcgtttgaggcagaattgctcctcccggacgcgagctacggtcgcagaaggtcgacactcgtcttgcgccgcggcgctctgcagatccgcggcttcgtagcctttcccgacgcgatcgagctgaacaaccggtggggtggcgcaatcggaccgatgatacgcgtagcgggcgggtcggacgacgacgacgatctcgctggcgtgctcgagcatttcgccagcaatccccgcgagacggcgtcagcttggcggagatccgccaaggccgcgccagaagccaggcagacaggctctcggctcgtatcgttgtccgag

SEQ ID NO: 709036 - DNA, 83 bp, Homo sapiens
  misc_feature (79)..(79): n is a, c, g, or t
cctaaataaagatttaaaaatttaagcttttaaaaagaaaaacagttacataaaaattgaccagtgaaaaaaaaaattnaaaa

SEQ ID NO: 709037 - DNA, 338 bp, Homo sapiens
cgtcgaccgtaccattccgttccattccattccattccattccattccattccattccattccatgccattccatgccattccactcggtttgattccattccactccattccttttgggttgattatattccattcaattccattccattccacttgggttgattccattccattcctttccattccattccattcccttccattccactcgggttgattccattcctttccattcctttcggattgaatccattccattccattcctttccattccattccattccattccattgcactcgggttcattccattccattccattccattcgtcgac

SEQ ID NO: 709038 - DNA, 887 bp, Homo sapiens
  misc_feature (305)..(305): n is a, c, g, or t
  misc_feature (308)..(308): n is a, c, g, or t
  misc_feature (312)..(312): n is a, c, g, or t
  misc_feature (320)..(320): n is a, c, g, or t
  misc_feature (330)..(330): n is a, c, g, or t
  misc_feature (340)..(340): n is a, c, g, or t
  misc_feature (356)..(356): n is a, c, g, or t
  misc_feature (397)..(397): n is a, c, g, or t
  misc_feature (399)..(399): n is a, c, g, or t
  misc_feature (658)..(658): n is a, c, g, or t
  misc_feature (669)..(669): n is a, c, g, or t
  misc_feature (672)..(672): n is a, c, g, or t
  misc_feature (675)..(675): n is a, c, g, or t
  misc_feature (712)..(712): n is a, c, g, or t
  misc_feature (722)..(723): n is a, c, g, or t
  misc_feature (837)..(837): n is a, c, g, or t
  misc_feature (839)..(839): n is a, c, g, or t
  misc_feature (842)..(842): n is a, c, g, or t
  misc_feature (848)..(848): n is a, c, g, or t
  misc_feature (855)..(855): n is a, c, g, or t
gttattattcattatggtagaatcattttaattcacgtgcttgtgttcagtttgtggtctgagagatgtaccaatgtcaaattaccgtgtaccacctaatgtttataggagaaagcaaaatacatcagcttggtagttaacacatcaaatatttcttgctgcttctaggagaactttttggtgtgtgtggaatggctgagcaaatattaaaattgttaatatgcagccatatatggaaggttcctgtggggttgttttttcgtgttttttttttttgggggggggattatgtgcctcccattcantanaaantgagaaantggtctgggnttccaaaatnttgactttgaatgggntcaatacacacacacagacttttttttttattttgcccacntntataggcagttgcatgctagcatgggttttttataacaatataactgagttatatgggaattataaatatttccgtcacttaaattggtccttggtttagcctgaaaacctttatggctcaagatcagattcctgataacccctctttagagctacagggagctggcttaccagttaaaacacttcttagggatcaaatatacgatgtaattttccaaaatcgttttaattaaacggtgtttcagtgtaaaatggttanccttgtaaganggntantgtgtataagaatgtaggccttaatatttcacatgantcaaaacaanncagttttaaaaaaatattgtggaagcacaagtgcatggcattgactgaatgctgtaatatttctaaaaagtttctacatccagattatatgtctgattcatagtaaaatacctntnatnaaacantgttttntagaacaagagaaaaacaaaaacaaacaaaaa

SEQ ID NO: 709039 - DNA, 347 bp, Homo sapiens
  misc_feature (41)..(41): n is a, c, g, or t
  misc_feature (49)..(49): n is a, c, g, or t
  misc_feature (74)..(74): n is a, c, g, or t
  misc_feature (112)..(112): n is a, c, g, or t
  misc_feature (114)..(114): n is a, c, g, or t
  misc_feature (161)..(161): n is a, c, g, or t
  misc_feature (253)..(253): n is a, c, g, or t
  misc_feature (267)..(267): n is a, c, g, or t
gccatcctgcacaagctggaccagttggatgccagccgggnccgcgcantccccttctgtgggcagcggggccncttcaagtacgagatcctcgtcaagacaggctggggcngnggctcaggtgaggggccgcggcggggtggcagggcctcccctgctcntcactggctgtgctgggttgcaccctctgggaaatgagtctcgtcgcaggcgtcagaacaaaggcagtttttgcaagtactgtgtgaagggntccgtgtgttcatncttgggaatgacctcgttgagccactcaattgttccttgaagaactaggacaagcttccttaacttggaaagtaaggttt

SEQ ID NO: 709040 - DNA, 177 bp, Homo sapiens
  misc_feature (8)..(8): n is a, c, g, or t
  misc_feature (65)..(65): n is a, c, g, or t
  misc_feature (142)..(142): n is a, c, g, or t
  misc_feature (176)..(176): n is a, c, g, or t
ttgccagntcccggagtgaggaagggcctgagcggcgtgggcggccgtagatggagtagcggggngccgtcgtgccgcgcacggtcatgcgagcgggcaccaggtggcctgccggggccgcacgtcgtctgctgcgtggggnaagcgcgccgaaggtgaaggcgggggcggcggtnc

SEQ ID NO: 709041 - DNA, 923 bp, Homo sapiens
  misc_feature (26)..(26): n is a, c, g, or t
  misc_feature (83)..(83): n is a, c, g, or t
  misc_feature (90)..(90): n is a, c, g, or t
  misc_feature (166)..(166): n is a, c, g, or t
  misc_feature (170)..(170): n is a, c, g, or t
  misc_feature (178)..(178): n is a, c, g, or t
  misc_feature (180)..(180): n is a, c, g, or t
  misc_feature (189)..(189): n is a, c, g, or t
  misc_feature (197)..(197): n is a, c, g, or t
  misc_feature (209)..(209): n is a, c, g, or t
  misc_feature (504)..(504): n is a, c, g, or t
  misc_feature (509)..(509): n is a, c, g, or t
  misc_feature (512)..(512): n is a, c, g, or t
  misc_feature (516)..(516): n is a, c, g, or t
  misc_feature (518)..(518): n is a, c, g, or t
  misc_feature (545)..(545): n is a, c, g, or t
  misc_feature (572)..(572): n is a, c, g, or t
  misc_feature (576)..(576): n is a, c, g, or t
  misc_feature (579)..(579): n is a, c, g, or t
  misc_feature (591)..(591): n is a, c, g, or t
  misc_feature (611)..(611): n is a, c, g, or t
  misc_feature (615)..(615): n is a, c, g, or t
  misc_feature (665)..(665): n is a, c, g, or t
  misc_feature (684)..(684): n is a, c, g, or t
  misc_feature (749)..(749): n is a, c, g, or t
  misc_feature (896)..(896): n is a, c, g, or t
cacgcgcggcgtgggcccctgccggnaggcttcaaggtccgccccctcccccacctaaagggttcaacctccaacaacttggnaattgtnaccaacccaaccccaactggttcggggtaaggcctcccggttcctcctggcccctggcctacttggctggctggtncctngtgccccngnatgcccctngctaggtncccccccctgcncccccactcaagagttaagagcaggtggctgcaggccttgggcccggaggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacagtngtttnagnacangnaagttttcttctccttctggtcccctngtttctcatacccccaaactcagatgntggnggncaaggccggcgngtgttcacccaggcaggagngggntgtgtccagggtggggcggcccctttggctctccctcctgttccaggggnagcatagggacgggaaagnaggtggcccggggggggatatgggggggccccagccctgttcccaaagctccctgctcggctgcncctcgcccgcctttatataaattctctgaatcacctttgcatagaaaataaaagtgtttgctttgtaagaaaagtctggaaagtagcagaatcatctcaaggtgtcaaaggagccttcagtcatcgtctggggggcaggacaggcanaggggttggtccacttaggtgttgcct

SEQ ID NO: 709042 - DNA, 803 bp, Homo sapiens
ggacatgaactcatcatttgtatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattacacaagtcaggaaacaacaggtgctggagaggatgtggagaaaataggaacacttttacaactgttggtgggactgttaactagttcaaccattgtggaagtactcttttactgatattttcttattatattgctacaggcaacatcagtagaagctatctagtaccctaactaaggatcacattcacattcttacagccaagg

SEQ ID NO: 709043 - DNA, 159 bp, Homo sapiens
atatagcttgagaggtctgtgtctgtgatgtggtgtgtgaggtttgatgatagtgtgtgtggtgtaaaatctgtgtgtgtgtgaggtctgtgtgtggagtgtgagatctgtatgtgtgaggccagtgtgcttcggtgggaggccaggttgcttcggttg

SEQ ID NO: 709044 - DNA, 931 bp, Homo sapiens
gttgctggaatgaagaagaagggtgatcttgattactgcagctagtaaaagtggaatttgatgaagaattcagtggagcaccagtagaaggtgtaggagaagaggcattgactccatcagttcctattaataaaggtgccaaacctaagagggataagaaggagccgtggtaccagacgtgaagaataagacacctaacatacatcgtgtgtaaatcctagatgctagagaggaaaagtgaagaaacggtaatccttgggtcagatgatgaaatccaagtcaagaaagtgatttggaagaacacagaacctgtggttattccgaaagagattctttgcgttagaggagagctagcgagtccgaaagtacctaaatacgacatttgatttctcgagaagacggaggatgatgatgctgatgatgatgtatgatgacgaaatagagtgatttagaggaatagaacacgttaaagcatctcccataacaaatgatggggaagatgacctttgttccttcagatgggttagataaagatgaatatacattttcaccaggcaaatcaaaagccactccagaaaaatctttgcatgacaaaaaaagtcaggatttggaaatctcttctcatttccttcatattctcagaagtcagaagatgatcagctaatatttgacagtaatgaagaagattctgcttctgtttatttcaccatcatttggtctgaaacaggacagataagttccagtaaaacggtagctgatacaaaggcaacacgtcttcagaatacaggccttagcccagaaaccgaaaagagaagtgatgcatgatggcgacttgactgaattcagatgggattcgatcaacaacacacaaggaagcagggaaaaaggcacctggctgaaaaggatatccggaggacttaactacgacgaa

SEQ ID NO: 709045 - DNA, 145 bp, Homo sapiens
gatgggtggaaatacagagggggcatgagtacagattcccagttatctccctttcttcgccatactttttatctcaagttctcagtttaggccttctgatcaataccatcctacaggactctccccaacatcccccaccagttcg

SEQ ID NO: 709046 - DNA, 954 bp, Homo sapiens
  misc_feature (25)..(25): n is a, c, g, or t
  misc_feature (90)..(91): n is a, c, g, or t
  misc_feature (104)..(104): n is a, c, g, or t
  misc_feature (116)..(116): n is a, c, g, or t
  misc_feature (143)..(143): n is a, c, g, or t
  misc_feature (153)..(153): n is a, c, g, or t
  misc_feature (165)..(165): n is a, c, g, or t
  misc_feature (175)..(175): n is a, c, g, or t
  misc_feature (187)..(187): n is a, c, g, or t
  misc_feature (189)..(190): n is a, c, g, or t
  misc_feature (198)..(198): n is a, c, g, or t
  misc_feature (207)..(208): n is a, c, g, or t
  misc_feature (244)..(244): n is a, c, g, or t
  misc_feature (246)..(246): n is a, c, g, or t
  misc_feature (251)..(251): n is a, c, g, or t
  misc_feature (318)..(318): n is a, c, g, or t
  misc_feature (320)..(320): n is a, c, g, or t
  misc_feature (330)..(330): n is a, c, g, or t
  misc_feature (341)..(341): n is a, c, g, or t
  misc_feature (343)..(343): n is a, c, g, or t
  misc_feature (345)..(345): n is a, c, g, or t
  misc_feature (368)..(368): n is a, c, g, or t
  misc_feature (374)..(374): n is a, c, g, or t
  misc_feature (376)..(376): n is a, c, g, or t
  misc_feature (397)..(397): n is a, c, g, or t
  misc_feature (405)..(405): n is a, c, g, or t
  misc_feature (443)..(443): n is a, c, g, or t
  misc_feature (457)..(457): n is a, c, g, or t
  misc_feature (464)..(464): n is a, c, g, or t
  misc_feature (531)..(531): n is a, c, g, or t
  misc_feature (550)..(550): n is a, c, g, or t
  misc_feature (565)..(565): n is a, c, g, or t
  misc_feature (584)..(584): n is a, c, g, or t
  misc_feature (602)..(602): n is a, c, g, or t
  misc_feature (790)..(790): n is a, c, g, or t
  misc_feature (863)..(863): n is a, c, g, or t
  misc_feature (867)..(867): n is a, c, g, or t
  misc_feature (887)..(887): n is a, c, g, or t
  misc_feature (890)..(892): n is a, c, g, or t
  misc_feature (933)..(933): n is a, c, g, or t
cttgaaaaagatgggcttcaagacnggaggggaaatgcagtttctatttacctttaggccgatttcccaaaccatttgcgaagccggttnnagaagaggagagncgaaggatcccncccgtctgatagccatccgccttaagnacttactttngatccccattgnatccataatncctacccccgananngtctttgnctggcaagnnagggatggagaggcagaggcccagggggcctctgancnaaagncgcatgggtggtctgaaaatagagttgggcctaatgttgacttctattacgcctgcatggagcagtngngatgaatacnaatacatcacntngnaacgcccgtaaaacacagatcanaatacncnatagggaatggttaacaaatngcctgaanaatatacaatttggctttttcagttgtaaactgaggtnaacagagaaataangaaagcnatgagaaaacgaaacagttaccaaaggaccattttctataatcccgtcttatgtagcactttgagtnactcatcaaaatattaatntaatatatatctgtnaagtgttagaccaggtgcnggggacaaaaggcaagcnaaaatagacacactatccttagaatttataatctagtcagagagggacattcaaataatcacataaagatacataaaattacaggcctggcgcagtggctcacatctataattccagattttcggaggccgaggcagtggatcacttgaggtcaggagttcaagaccagcctcgccaacgtggtgaanctcgtctctactaaaaatacaaaaattagccaggcatggtggtgcgcacctgtaatcccagctactcaggaanctgnggcagaagatttgcttgtanccnnntggtagaggctgcagttagccgagatcgtgccactgcactncagcctgggcgacagagtgaa

SEQ ID NO: 709047 - DNA, 129 bp, Homo sapiens
aggggggggggggggggccccaaaaaccgggttttttccccccccccccccccccccccgggggccccctttttttttccccttgtgtgtttttattttttttccccttggggggggggggggggggga

SEQ ID NO: 709048 - DNA, 1274 bp, Homo sapiens
gtggacgcgtgagtgcggaggcgcgggcggcggagggaggccggagctgggcagctgctggctgtgcgccatgtcctgtgaacatggactgagctcaagcaccagtgtcatgatcaaccagattctgtgctgactgtgctgggctgcgcggccgaccaggcgaagcaactgctgcagtgcgtgcccactggcagttcgagacagccctcagcgccatttttccatggagaccaacatcccctacagccaccatcaccaccagatgatgtgcacccccgccaatacccctgctacaacccccacaagttccctgacagctctcaccatgattctcccgatcatcaaggccatccgagagcttccacagacggtgtgcagcagtgcagccccagaatggcacgtgacatagccaaagataagcacaccggcacaacagattcaccacccaatgcggccgagacaagagagactcttgctgcactcacagactggacacccatcgtggcacggcacgtcaaacccacgggtggagcccaacaaggaaaccaagcatgccacgcaacgagaccccgtgagttggaaggtcagaaggcaacagacaatacatcacggagaaacaaacaagggcacaaacccacatcggaccaccacgaaaagggcaacacagtagagaaagccacaaggggagccaaaacaataacacatggacaggacaaaagagagctacggcagacatagccacaacgcccaccacgaaccggatgcagcgagagacaacgaccaagaggagaagggagagcacaggggaaggaaagacaacgaaggagcaacgcatatgaaacgcgaggagacaggcaggcagcacgcagacgacaagcacgagaggcacagaggacaagagggagacaaagagcggcagcgaggcaacgggagacggacacaaagaacacagcggcgcggccagagcggcgcgacgcgaaggcaccagcagcgaaggccaggagcgacaagcagaacagcgggaggaaggcgcggagacaccgacacctgagcggccgagagcagacagacaccacagcacaaaggagcgagccgccggaggcagcgaggaagaaacgcgcacaggcctcccgaaaagaacacacagaaggcgctggcacggcaagagcgggagggagaggcacacgcaacacggaggaagcgaatagcgaagagcgagaggaacaaagggagcacggggagacgaagaaaagcagaaaaaggaggccacgact

SEQ ID NO: 709049 - DNA, 168 bp, Homo sapiens
  misc_feature (149)..(149): n is a, c, g, or t
cgcccgcacgagcccgacctttccgccgcgctcaaggacacccgcgcgcagtacgagaagctggccgccatgaacatgcaaaacgctgaaggattttttgaagaacccggattcaccgtgctgaccgagagcgccgccaagaacccgangccgtgcgcgccgccaacg

SEQ ID NO: 709050 - DNA, 334 bp, Homo sapiens
atttcccagtatgatttttctttctaaaaaagtaccatctggccaggcgcggtggcttacgcctgtaatcatagcactttgagaggcagaggtggtcggatcgcctcaggtcaggagttcgcaaccagcctgaccaacatggaaaggctccgtctctactaaaaaaacaaaattagctgggcgtggtggctcatgcctgtaatctcagttactcgggaggctgaggccagagaattgcttgaacccagaaggcagaggttgcggtgaaccaacatcattgcaccaatgcactccagcttcggcagcaaaagcgaaactccgtctcaaaaaaaaa

SEQ ID NO: 709051 - DNA, 965 bp, Homo sapiens
  misc_feature (554)..(554): n is a, c, g, or t
  misc_feature (626)..(626): n is a, c, g, or t
  misc_feature (717)..(717): n is a, c, g, or t
  misc_feature (770)..(770): n is a, c, g, or t
  misc_feature (775)..(775): n is a, c, g, or t
  misc_feature (781)..(782): n is a, c, g, or t
  misc_feature (789)..(789): n is a, c, g, or t
  misc_feature (955)..(955): n is a, c, g, or t
  misc_feature (958)..(958): n is a, c, g, or t
tctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagaactatcgtgagcataggtgaccctaagaaaaaatatacaagatatgaaaaaattggacaggggcttctggtacngttttcactgctactgacgttgcactgggacaggaggttgctatcaaacaaattaatttacagaaacagccnaagaaggaactgatcattaacgagattctggtgatgaaagaattgaaaaatcccaacatcgttaactttttggacagttacctggtagganatgaattgtttgtggtcatggaataccttgctggggggtcctcactgatgtgntaacngaaacnngcatggntgaagcacagattgctgctgtatgcagagagtgtttacaggcactggagtttttacatgctaatcaagtgatccacagagacatcaaaagtgacaatgtacttttgggaatggaaggatctgttaagctcactgactttggtttctgtgcccatatcccccctgancanaacaaac

SEQ ID NO: 709052 - DNA, 606 bp, Homo sapiens
tctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagtatgtatctacatttacatcattgttaaattgttcacggctcgttaaacattggcccagatggattgtgacttacactgtacattgtgacttacaagtatacagaatcactggtatccttatagcaa

SEQ ID NO: 709053 - DNA, 1317 bp, Homo sapiens
  misc_feature (554)..(554): n is a, c, g, or t
  misc_feature (626)..(626): n is a, c, g, or t
  misc_feature (1095)..(1095): n is a, c, g, or t
  misc_feature (1224)..(1224): n is a, c, g, or t
tctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagaactatcgtgagcataggtgaccctaagaaaaaatatacaagatatgaaaaaattggacaggggcttctggtacngttttcactgctactgacgttgcactgggacaggaggttgctatcaaacaaattaatttacagaaacagccnaagaaggaactgatcattaacgagattctggtgatgaaagaattgaaaaatcccaacatcgttaactttttggacaggtaagtatgactattccttaaacaccgggagaaaatgtagaaattttaagtctcatggtttcgggggtggggctggccactttggaataaactgtcagtgccgagaaataagatggaagaaagaagaggagaggtaaaaatagcacagtgcagttttagaaggtccttctctgcaaggacatcacttggcaggtgagagaaggcagttaattgaaggccatagctggtggtgtttatactcatcgcaaacgacctgaagcgaacacatgaatggttggctgtgattcgtgtcttgactgacagaggggactggttacatggtttttaaacttgtggatcaatttttatttcaaatgctatccttcatggacaaatttatatgtctatcaaancctcatttagttgaggaattaatgttaaataacagaccaaaaagcagaatagaaaatgatgcatattggctgggtgcagtggctcacacctgtaatcccagctactcaggaggctgaggcaggagaatngcttgaacccaggaggtggaggttgcagtgagccgagatcgcaccactgcactccagcctgggcaatggaatgagactccatctcaaaaaaaa

SEQ ID NO: 709054 - DNA, 768 bp, Homo sapiens
tacgagacgaggcgagacaagaggtcgtgtcgaagcatgtgatgccaggccgagcgggagctgaccaggcttgactcgtggtacagaactgaggcaccagtccccttgcgaaccgaaggtgcctcgcagtgtgatggatggaggcccagccctgagtgtcaacgccaaccagtgctagcctggcactggggcctacagggtgtgtgtagtgctggtgctgtgccgcagcctgtccaggggccttctctcagtgtccctgtgtgctgattggtgtgcctactgctgctggccctggcaacaatggccctgactctggcccctcgggaccagagccccacccgatctggaagctggatcctttaccatgggccataggccagtgactaggccgggcctgggcctcccatcggggccggactaggacgaggccccggggaggcccctggcctaccagaccacttttactcaggcctgacagccgccaggaagatgcaacgtgcccatgccaggcgcccgccagcacttgggggccattctggccagcgccagcgtggtggttgaaggctctgtgtgctggcggtactattcctctactgctctccttcgccgtggacactggctgcctggcggtcacccggggctacctctttcctcccaaacttctggatcctggacctgtgcaccatgggctgctggagcagcatctgtgggacgtggcatcaggctgacaatgtggtgtggcaggcgttgaggagccctcttggggca

SEQ ID NO: 709055 - DNA, 542 bp, Homo sapiens
  misc_feature (14)..(14): n is a, c, g, or t
  misc_feature (34)..(34): n is a, c, g, or t
  misc_feature (42)..(42): n is a, c, g, or t
  misc_feature (89)..(89): n is a, c, g, or t
  misc_feature (101)..(101): n is a, c, g, or t
  misc_feature (111)..(111): n is a, c, g, or t
  misc_feature (133)..(133): n is a, c, g, or t
  misc_feature (162)..(162): n is a, c, g, or t
  misc_feature (184)..(184): n is a, c, g, or t
  misc_feature (346)..(346): n is a, c, g, or t
  misc_feature (351)..(351): n is a, c, g, or t
  misc_feature (492)..(492): n is a, c, g, or t
  misc_feature (495)..(495): n is a, c, g, or t
gaaaaaagattggnaggggaatttttgggggggnagcccttntttgggttccagcatgaaaacagggtagcttggggttatagagaaanagtgtttcccanaccttttccnggggaagaccccaggattggcntttagtcagcaaatggagataacagagtntggctttccaatcccaatttcnttgccccccccttgccccccccccgaaaaaaattgagcacttaaacccttcccttttggagggggccccctgaagcgtcaggctgggggcagtttggtacggaacatatttattgcctccatgcatgtgtgtgtgtgtctgtgaggactggtgtgcgtgganacgtntgaagcaggcgtgtgggttttttcagggaccacagaggagggagcagtttgcagtgcccagccaccctgaaatccccaataatggtgcctcagtgggccccagagttccagtgggagagtacgttccctcctgtctccttnttnttttccgcacctccatttttgtggataataaataaatatgcacaggt

SEQ ID NO: 709056 - DNA, 225 bp, Homo sapiens
tttgaatgtttgtctgtgacaagtaccctatttgtcgtgtgacattttaagttgtaataagaagtattaccaatttaaagagtgcctcctgtgttccaaggtgctttggttggccaattaattaatttttccttccttggaattccttaaaccaaccttaagcgcaaggtattattagtattctcattttataataaagagtgcttgagtagcttgtctgatgtt

SEQ ID NO: 709057 - DNA, 375 bp, Homo sapiens
ctgttgttgttgctgttgttgttttttgagatgaagtctcgctctgtcacccaggctggagtgcaatggcacgatctcggctcactgcaacctccacctccagggttcaagcgattctcctacgtcagcctcctgagtagctgaattacaggcgggcaccaccatgcctggctaatttttgtatttttagtagagacgggtttcaccatgttggccaggctaggcttgaactcctgacctcgtggtctgtccactttggcctcccaaagtgctggaattacaggcgtgagctactgtgcccggccacatctaatatattaatagagggataaaatgaagtcctaaaaaataattagccagcaaaataaagtcaag

SEQ ID NO: 709058 - DNA, 305 bp, Homo sapiens
aaacagctaacagccaaactaaaatggctaaattccagaggccacaagggaatatcttgtaaatatatgtacatattcaggcagatatggtctcccaagctgagtttctagaaattgatgttttctagacattttctaagtgggttttgttagtgtctcacttgggctcactctttctaggtttaagttagcccagagattgtattttactcatggaccactctatttatttcacattttactcagtaatgatcccttggggttctataagggtcataagggcccatttcgccatagtctctcca

SEQ ID NO: 709059 - DNA, 402 bp, Homo sapiens
gttgccaaacactactgccatgcactaattcttgatatgttaaaagtctacatataaataagatcataccactgcgctttaaagctaagtgattcttacatttacattcattgcaagacagtgtaatgcaacagttaagaacacagtgctatctaacgcgggagagcacaacaaaggcagtcaaagacagctcccattttccctctgtcaaattaaaatgacacgccccttcctctcggggaaaaagcccaggtcagctgctgtgatcacacgtgattcttcagggctggagaccattcagtgccaggaaccaagtaaagggatagtgcagaatacagatcaaggcctggcactgctggtcagcttgccacgctatataaaaattagcatcaagcttccaag

SEQ ID NO: 709060 - DNA, 300 bp, Homo sapiens
gggggagcgcgcaggcatggcaagccggtcttcctgctcaacaagcttgcgtgccaaaatgcccatcctgggagttgggtacctggaactgtcccctcaagagggacgtgaatgaggccgattagaggctgggcaattgaacgtccagagataccgaccatcatcgcagctgttgctcgcaatgtggtaccagatatgatcaatgtaggtggcgggtggaccagtctcatcgcatcatagtctcacgggatgcaagagttggcttcgtacacgtcggctgatggagcctcgtttcatccg

SEQ ID NO: 709061 - DNA, 371 bp, Homo sapiens
tctggagtactatgtgcagcaatttctaatctactgtctactccctacgcttctcgtagtcagagtcatccacccgcataagcgttccagagtagctataaacctagaggcatgctccaacacatccagtgaacttttgtatcttttgtaaagattggtcaagccatgttgcccacgctcacaaattaacttagctagtggccccctgaattagcagttaagtccgcgattcagcgcccgtttcataggctgaatctctccgtattcacgctgtctaatcagactgccttagctgtcaaaccagcagattcgattctggatgaatgacaggccctctgagtgagttggctctacgatttgacaagatgcta

SEQ ID NO: 709062 - DNA, 223 bp, Homo sapiens
  misc_feature (180)..(180): n is a, c, g, or t
ggatgctgcggtcactctagatcctatcgtgtgccggtgtgatgtgcgattctaatacacacacttaagtgtcagtgagataagctaatgtaaccatatcaaacaaatagttctcttgtagcccctttagtctctaagagatccgaatccagaaatattcatagggtactatcatgactnattattaagtctcagtagctgaatctgtacgtatttttcttca

SEQ ID NO: 709063 - DNA, 226 bp, Homo sapiens
catcctctccagtatgcattcttttatgttagtaagggtcgaggaccaattaaagcctttgccacattcttcacatttgtagggtttctctctagtatgaattctcttatgtttcagtcaagggttgcaggcacagcatcaaatgctttgcccacattcttccaccacttgtcaaggttactcctcccagtcatgcacattcatcttcatgtgtagtcaagcattt

SEQ ID NO: 709064 - DNA, 226 bp, Homo sapiens
  misc_feature (3)..(3): n is a, c, g, or t
  misc_feature (175)..(175): n is a, c, g, or t
ctnatgatggaagactgcttactatatccaatctgaagctgagcctgtggcctacagggaggagagacgctgaaggtccccccaggctggggatgggcggaggggggagcctaggctcactggtgtgacctcatgcaatgcccagtgcgagggtgtgtcctacagatgagttggncgagaagggctcccaaggactttgcggactgtcatctcatgcccctcccca

SEQ ID NO: 709065 - DNA, 130 bp, Homo sapiens
tgttctaagcatgctgggagaatcactgggagaaagccctgaaaagaaaaactattgctcctgaatttatctgtatgagcaagtatgtgtgagagagacagagagagggagagagacaaggtaggccgag

SEQ ID NO: 709066 - DNA, 289 bp, Homo sapiens
tcaggttagcatattacgtggggtgttctaatatactaaaccttcacatgtttagctaattctgaagtccgtggatgtaagctagaagcttatgatccgattcaccaactttcaacaatctactggtccatgaatgataagttactgtcttccgctaacaatagaaagagcggattcctttaccactccccaaatctaaactgggtttccacttaagagttactcagttgagaacacttaatatcaagtacaatcattaagtggcactgatactaccattatatcagag

SEQ ID NO: 709067 - DNA, 345 bp, Homo sapiens
ggccgttcacctgtcagacgagtaacgcatgtatcctacaggcgagctcagtggaggaacagaaccctcccgtgagcagaagggctcacagctcgcttgatcttgatatacagtacgaatacagaccgtgaaatgcggggcctcacgatccttctgaccttttgggtttataccatggaggtgtcagaaaggttacacagtgtataactggcttgttggcggccaagcgttcatcgcgacgtcgcttccttgatcctacgatgtctggctcttccgtatcattgtgaagcagaattcaccaagcagtggattgttcaccctactaagtagggaacgtgagctggg

SEQ ID NO: 709068 - DNA, 144 bp, Homo sapiens
tgtcctctcactcgcccgtctcacttctgagagccaccgataccacgttcgtctccatacacagacatgttaaagcatgggacgtaagtttaagggagacgtgagaaaagatcagtggttttcacaaagcttcaatgaagcagc

SEQ ID NO: 709069 - DNA, 231 bp, Homo sapiens
actccatctaaacgatatttggagggcagcatggtgctcacgtgtcgacggaacttgtacagggaggcatgcacctgcagtggtgaatacacgtcgaccagcatccatgtatgcgtgattgggtcgtcatcgcggatctcctgtatctacggagcatgtatggggagttatgcatggcagtggtgaatacacgtcgatgatggaggcatgcatgcatgctcgggtcctgga

SEQ ID NO: 709070 - DNA, 384 bp, Homo sapiens
  misc_feature (9)..(9): n is a, c, g, or t
  misc_feature (31)..(31): n is a, c, g, or t
caaaaaacngcaaacaaccaaaaaaaaaaanccaaaacactctgttatgtgagaacagactggaggaagaaagatggaagtttttttttttaaaaaaggtcttgcccgggcgcagtggctcacgcctgtatcccaacactttgggaggctgaggtgggtggatcatgaggtcaggagatcaagaccatcccggctaacatggtgaaaccctgtctctactaaaaatacaaaaaaattagccgggcacggtggcgggcacctgtagtcccagctacttggaaggctgaggcaggagaatggcgtgaacccgggagttggagcttgcagtgagctgagatcgtgccactgcactccagcctgggcaacagagcgagactccgtcac

SEQ ID NO: 709071 - DNA, 330 bp, Homo sapiens
  misc_feature (4)..(4): n is a, c, g, or t
  misc_feature (70)..(70): n is a, c, g, or t
  misc_feature (145)..(145): n is a, c, g, or t
  misc_feature (220)..(220): n is a, c, g, or t
cganttgggacaatggcgtctcttggcacatcttggttttctgtgtgggtctctcaccatggccaagganaaagtccaaaggaacacgacccgttcacttacgactaccagtccctgcagatcggaggcctcgtcatcgccgggntcctcttcatcctgggcatcctcatcgtgctgagcagaagatgccggtgcaagttcaaccagcagcagaggactngggaacccgatgaagaggagggaactttccgcagctccatccgccgtctgtccacccgcagcggtagaaacacctggggcgatggaatccggccagggggttccctgggg

SEQ ID NO: 709072 - DNA, 123 bp, Homo sapiens
gtcgactcttgatctcctgacctcatgatccgcctgctttggcctcccaaagtgctgggattacaggcgtgagtcaccgcgcctggctcattttgaaatttttgtagatcagtgtactgttgt

SEQ ID NO: 709073 - DNA, 256 bp, Homo sapiens
ttcgatgtgggctgaggtgtcaggtgcgtccgcaatccactcgaggttcttgacagccgccttgagggggagaggcagcgatacgttcgtcgtccagctggatgcctcaaaggtgccctcgtggctgtactgcaccacgcccacacgcgtccctgtctcggacttggggtccttagcgatggcacccagcctgttgaccacgttgatgacgggggacttctccagtgtgaagttggtgtacccaatgctctcggag

SEQ ID NO: 709074 - DNA, 287 bp, Homo sapiens
aatctcagctcatgcatctccactcccgcgtcaggcgattgtctggctcagcctcctgagtagctgggattacaggtgcctgccacgagtggccagctgattttctgtatttttagtagagacggggtttcactgtgttggccaggctggtcttggaactcctgacatcaagtgatctgcccgcctccgcctcccaaagtgctgggattacaggtgtgagccaccatgcctggcctgtataattttcttaatttttaaaaactttttgaaatagattgcggtgtctg

SEQ ID NO: 709075 - DNA, 685 bp, Homo sapiens
  misc_feature (222)..(222): n is a, c, g, or t
ggcgcggtggctcacgcctgttatcccagcgctttgggaggccaaggtggtcggatcacgaggtcaggagttccagaccagcagcctggccaacatagtgaaacctggtaacatagtgaaacctcgtctctactaatgcaattagccaggcgtggtggcaggcgcctgcagtcctagctacttgggaggctgaggcaagagaatcgcttcccttggaggccngaggaggctctccctccctccccccccctctctctctctcctcccctttcctctcccccttcttccctctctcccccctccctctcccgcttcccgttccctttcgtcccttcctcctctccctcctcccctccccgctttccctctctccccccctcctctcctccccccctgccctccccctcctctccctcctccccttcccctgctctctgtccttctcccccctcttcccctcccctctctcccccctccctcccccttcctttcccccctcccccctcctttctctcgctccccgtcccccttccccctccgtccccgctgtcctccctcccccccccttcctcctctctctccccctcctcgtccccctccctctcccccctctctctctctcctcctctctctctccttctcccctcctcctccctcctcccctttcctcttccctcgctctccg

SEQ ID NO: 709076 - DNA, 423 bp, Homo sapiens
ggtctgtgctgaggaggattagtataagaggaaggcatgcctcttgcagttgagacaagagcaaggcaactgtctcctgtccgtccctgggcaatggaatgtctcggtataaaacccgattgtacgttccatctactgagatggggaaaaaccgcctatctcacctatcaccgcctatcaccactccccaatctcaagtacccagggacacaaacgctgcggaaggccgcagggtcctctgcctaggaaaaccagagacctttgttcacttgtttatctgctgaccttccctccactattgtcctatgaccctgccaaatccccctctgtgagaaacacccaagaatgatcaataaaataaataaataaataaataaataattgtttttcatgtaaaatacaatttttttcccttaacaaaaa

SEQ ID NO: 709077 - DNA, 377 bp, Homo sapiens
caaaggcaggagtccttttagtgttttgtttatttttggaagaatatcaatagtggagttttgtggtagcctgaagaaatactgaaagaagagccaaacccctggcatgttacaattctccattacaaaataatcaccagcttcctcaaaaccatccattaaaatcattttccgaccgggcgcggtggctcacgcctgtaatcccagcactttgggaggccaaggcgggtggatcacaaggtcaggagatcgagaccagcctgggcaacgtggcgaaactctgtctctacagaaaatacaaaaatttgcccggcgcggtgatgcacacctgtggtcccagctactttataggctgaggtgggagaatctctcgaacc

SEQ ID NO: 709078 - DNA, 583 bp, Homo sapiens
atgttctattacactacacatcgattggagtggatatatatcttaaagtaatctatttctacagaaagtgtgtacttctcacatttcacaggatcagaagttgatcttttaatactggaaaacaccaacgattagggtctgtcgtgactggataaacgctttcgtgcatttttgtcttaagtcagtgggacaaaaacattcctggtctggagactttctttctctctctctttccttctctctttccttccctcttctatgttgctgagcgggtagggcagagggataggaagggaaatagggcaaagctatactctagtggtggaatgtccgtggggtaaatttgtactgttttgtcctccactgaaggtgttaaaagtgtgcaaaggctgcatccccgtcagtgtgtttggaatcatggtgatggtgtttgggcgtcataagtgggatgtcatctggcgaccggcgcagcgtgagggtgtaatctggcgggcaaggtgagcctcagtgtgtcgtgtgcctgcagcgactcacactcgtgatcgtgttcagctggttcatctgcaaagacatgatctcttcc

SEQ ID NO: 709079 - DNA, 240 bp, Homo sapiens
ggagctggacagcacagagcgggcctgtgacactctgttgatgtgcatcgtcactgtcatgaaccatgggctacgcaacggtggtcgcgttggccacattcttcgcaagcccttcaaagatgagtctctctttccagcccgagttgtctattaccttctgttcttcttcatcggcatcatcattgtcctaaacctaatcttttgggtaatcatcgacaccttcgcttaccttcgtagtga

SEQ ID NO: 709080 - DNA, 113 bp, Homo sapiens
  misc_feature (78)..(78): n is a, c, g, or t
ctgtgacgtagaatatgtgctgtctgtgagaccgtgttcccaggagcactgactgatggggacgcttcccatgttgtngggagctctgcggctgtcatggctgtagttttcgt

SEQ ID NO: 709081 - DNA, 683 bp, Homo sapiens
gagaggctgtagccccagaatcgcttgtaccccgggaggttgaggttggagttgacccgagatcatgcgtacatggcacatttcccaacctgggcttaccagaagtgagacttttcctcaagagaagattgataataataattaaggaggaaattagacccaggtcttcccaggctggtccaacatcctggccctccgaatgatccctccccaccttcgagccgtctcccaagccagcccgggacttaccaggccaaacaatccacccatgtcccagctgtcccccagcgctttcttaatcttggtcctttcttctttgcccccagagaccctcctagaaggccatgtaagcccagccccctgccagagtgccgtccaccccgcccctcttgggcctgcccgttggctctgtttgccctcctcttgtggcggcacgggccctttgtggggcttctgtgccctgctcttggggcccacaggcggggctggtccaccacattcccacggcccccacagccttcaaagatgggtaaaggagcttgccctccctgggccccccacccttggtgaactcgccccacccaccccccacgccctgttccctgccaccccctcctagtggggaactagtgaatgacttgacctgtgacctccaataccataaatgtgatccccccccccca

SEQ ID NO: 709082 - DNA, 133 bp, Homo sapiens
ttagatgtagtaggatagtatgtatctggtccttaaagagaatctggaaaagcaggagggagggtggcttgtgttgttgggacatggcatctagaccggacagcgtcgttgaagcttgcgaggaaaacctgag

SEQ ID NO: 709083 - DNA, 116 bp, Homo sapiens
aagggaaaagggcgttaaagtaatacatttttataccaaatgtgtttatttttttgtacaagtaatccttaaaattgcaattgtaataggtgttaaaataaagtttttaaaaaatt

SEQ ID NO: 709084 - DNA, 564 bp, Homo sapiens
cgaccgcagctgaagcacatccctgcagccctggcgctggactccgatcgccgcaagttgccctctggcgccatgtcagcagaactggagctgccctggtgcatgccaggaggcagagccatgccagtggactcactgtgcgtcagcaacttgcacttcagcaataatgggaacgggggcagcgttccagcctcggtttctatttataatggagacatggaaaacatactgctggacgcacagcatgagtctggacggagtagctccaagagctctcactgtgacagcccacctcgctcgcagacaccacaagataccaacagagcttctgaaacagatacccatagcactggagagaaaaacagctcacagtctgaggacgctgatcttgacagacggaccgacgttgaccgcatctcgaagacacccctcccgcatggctatgggcatcggtcacgctcggccggccacatatcccccccaaggagctcctctcaccccccccgccccgcacggcccaccctcagcatgaggacacatgaccgtcctgcaccaccgggggcc

SEQ ID NO: 709085 - DNA, 438 bp, Homo sapiens
ctgtcattcaagtatgacacccctgatgccacctgtgctgtcccccatctgacagaaatggactgaggcagctgccagaggggatatgaaaaagcaattaacattttcagaaggggtggccttctatggtgtaaccttgttgtactgagattgcagggaagagacacaaagtttccagtcatgatcacaagaatagtatttcctgctggagtgattttttggtttgtttttatgaacatcctggattagtttgcaaaacattttacatttgaagaaatccaaaactcattttgcctgaagagttatattctttcatcgttaaatctgtaaaattacaaatataagtgtgtgtctgctttacttactcttcacaaaatagtatgtgtctagatctgattgtcataggcttgttctctcagaattagaagccaaaagaaa

SEQ ID NO: 709086 - DNA, 189 bp, Homo sapiens
actgtagatagatcatttgtgtgtgatctagtatagtcatctctttttgtgtgcatggaccaggcgcgagagtcataacatctaggtgctgggcccagagataggtcacaagctctactattggcaaacgcccaggtaagaaagtagagtcacatcaaatcagttgatgggccaacgagatatgtcaca

SEQ ID NO: 709087 - DNA, 739 bp, Homo sapiens
gtaggaactgcagtaagtagtggctggttgttcaaaatcatgggatgtagagactgaacagaattgcttctgagtgaactgaggcatagagagcggctgatatagtcaagcttgcctcttcttgaggagcaccaacatctgttatctgcaggatgctgcatagatttcttgtaaactggcattctagcctaagtgatgttcaatctaggctaagcatgggagagtgaagattaaaaaaaatcccgtgggtccggtaaatgacaaggtcatattaagaagttcggtgtaatactttgtaagagggggaagatagttgtaatgtgtattctatatgtagtgtgagagatttccctgagttaagtgtggaaaatcattgggaagaaacatgttacttgagggtgttaggagtgtacgatgattaggaagagtttggttacaggattcgtagaagtaagtgagagataagtatggtgggagttgtgtcagggccattcacaattgggttaggggtagaagtcgacagtgtacactttaacggtttgtaacagttgggatcctctgggaccgtggttaatttgcgtggacaatgctttgtacttggacttctaaggatgggtagctgaaaaggagcaccatgtcaagcatttgagcaattcttaaagtgtggagaatttgttcagaattgggggatggtgacctgatacggaggctgtaagtccttggtcaggggactgggacg

SEQ ID NO: 709088 - DNA, 1095 bp, Homo sapiens
  misc_feature (415)..(415): n is a, c, g, or t
gctcatgatgtacgcgcagtccaaaggcagtctactacgctgcacgctggaggatgacatcagtggccaagcccaacatacctcgagcaccatagaagaactttgcactgacagcagccttcacgaggcactggtatgcatccatgagagattctccgcacgctgggcattcaattggctacagatgttccaagtcagctgagaccctgcagcctgatatgtagcagttcattcgtcatgttactaccaggtgccaagacacgatcgactggactcctgggaccactattcatgtgggttgaacagtctggcaaacccgcgagcaaggcatgcagaacgcacgtgtgaaccgagcagcagaagcacaaccttgcgtgataccggctttcaaaagccggtcaccatcgttcacagncagccgtcgggcgacgtcgacttccttcagctgcgcattgcgcacagactccgagacacactgcaacgcgaccacacagcacttctgagaacagccacggtcgcctgccgcgacacggacgcattgtgacaccacgcacagacaagagagtgacgcaacgacgccctcgaagactatacacagccacgttcaccactggcagacacagccgtacactgcagcgagtgactttcattctagggccattcaccacatgacgacgggcggcacttcatcacgcattccagcattacttcacaaccgtactacagcactggaagacgtgttcttacttcacgccagatgaggacacatcgtagcaaccacgagaggcacaacgactcgttacaacgaacgtcatcgtgcgagggtgactgacccttgtcgacgagagcccttcagatacagaccagagagagcgcaccctgaccagcgagggcgccgcaagaaggcaacaccccatccgggtaaccacttcaggaggcacccgaacgggctaacctaccaagaattcgagatcagtatcacaccaaaggcgaggtcggtcagcacgagcacgagggtagcgaccgacgcactatcggacacgatataaaaacgacactaggcagcattcatcgaaaccaaaacgcgcaagcaca

SEQ ID NO: 709089 - DNA, 357 bp, Homo sapiens
gcgtgcgtctgggctggcttgtctctttgtgcctcagttctcgggctggctggtaatgccctgcgaatattggtcggtcggccttgatctctttctgggtcagctgtggctctgccatgtgcgtgctttactgtgacgttcgccgggcagtcccactttgcggatgtctgtctgtgtgcgtgctcgctatgtgcctgtcagcggaccgtgccggtggacgtgtacctgcctgtgtgcacgtccacgtacgttagtgtgcatgtctgtgtgcacatactatgcatgtcttacatgttagtgtgtctgcacgcatttgcacattgtgactgcatgcctgtttgtacatgatagtgtatg

SEQ ID NO: 709090 - DNA, 134 bp, Homo sapiens
acgacggcagagaaagatcgattggccttgtgtcagtatgctgaattcctaagatgagcatgaacactagtgagctgagagtcagtcactactgcatcggggtgaactaatccaggtttccagagaactgaatt

SEQ ID NO: 709091 - DNA, 130 bp, Homo sapiens
ctagaaatacacaaagcaaggagagccaaagctacagaccccacaaaaccagacgagctacctaagcaacagctaaaacagccacccgtctatgtcgcaacaatagtgggcaagcatttatcaggtcgca

SEQ ID NO: 709092 - DNA, 117 bp, Homo sapiens
atacctccgagacgtcgactttctgcagagaaggaccacaccaacctgcctcagtgaggtgatgacgccaaggattgaactggtggtggctccagcaggtgtgacgttgaaagaggt

SEQ ID NO: 709093 - DNA, 913 bp, Homo sapiens
gtgtgggctgtgagaggtctcgtcgctctaggaatagcgggtttggcagcaattgttgcatatggattatataaactgaagagcaggggaaatacctaaaatgtccattcatctgatccacatgcgtgtgtgccagcccaaggctttgttgtaggagcaatgacgtgtaggtatgggctatccatgttatcgggaattctggggcaaaacctaagccttagaagaagagatgctgtcttggtcttgtctggaggagcttggtttagttagatgtcttattattagagttacctattattgttggaaataaaactaatttgtatgggtaagatggttaacatggcatttcgaatattggcttcctttcttgcaggcttgattttgctgtggtgaccgaattactagtgactagtttactaactaggtcattcacggcaagtcacatgttaccgttacacatgtcacctaaatgcacttgatggtgttgaaatgtccaccttcttaaatttgaagatgaacttagtctcaagaagatagaggccaatctgagggttctcccggtttgctgcagaatgcagatattcgattgttcgcataggaagtcctattttgccccagtaaattcaactttggtctggctgttggggagggctgcccgcttaaaaaatcgtgtcacaaaggtccgggaatatacctggtaaccgtccccactggacatcttttcgcgtgtttcacccaaccgcagcgctaaacaagcgggtacagtttatagaacacgggcacgcaaactcggcccatgtggcgcaaattgggcataaaaaaatctgcacaaattttcccccgagaagcagtggctgccaacagacaaaggtggggcgctacacattcattctttctactactgccaaagggt

SEQ ID NO: 709094 - DNA, 549 bp, Homo sapiens
  misc_feature (359)..(359): n is a, c, g, or t
  misc_feature (395)..(395): n is a, c, g, or t
  misc_feature (455)..(456): n is a, c, g, or t
tcggggggggcaatggtgaggctgaagcttaaggaccaagtgtgggtgcaggtgggtgtgggtgactacattggcatctatgccagcatcagacaagacagcaccttctcgggatttttggtgtactcggactggcacagctccccagtctttgcttagtgcccactgcaaagtgagctcatgctctcactcctaaaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggntggatttttgcccaagaccaaaggagtgtgctgtgntggcaagtgtaagtcccccagttgctttggtccaggagcccacggtggggtgcttttttnntggtcctttgtttttttggatcctccccaccccctcctggtcctggggcgggcccttttttcagagatcactcaataaacctaagaaccctca

SEQ ID NO: 709095 - DNA, 147 bp, Homo sapiens
gagagctgagcagtcaagatgtgtgacttcaccgaggaccagaccgcgagtcttcctccatccctttccactctggatctgatcccaagcactggagttcagggaggccttccactgttttgaccgacaggtgatggcaggatcttt

SEQ ID NO: 709096 - DNA, 953 bp, Homo sapiens
gcttgctggcttactctgagtagaggatgaacttgaaggtctcctttgatcatgttcgtctgtgtgagcttccgtgagtaaaccttgtgtcccatgattcttctccttgctcactcactcgcacgtatgcttgtctttcttgatgtcctggaagataccaagaatgctgccttatgtagatcctttgaagatcagcttcttatggccaggatcactttttaactgcgtatcgtgcccaggttcacgacgttatgtgcttaggctcttgagacctttattcacatcactcaatgtggtcttaatggacatgcttaagcaagagtcccaaacatctccatttactgcattgattcctgttgcatttgtataattcaatcctgtttaataacttttatttgagaatcatggggtacatgtgcagaattatttaaaaaagacatattgcagtaatggtgaggtcaaagtatgactaaatccatcgttccaatcaggtcagtttgttctaacttgtgtgcctccattacatctctcctcttcgtcttaatattcctcagggtcataactgttcgcaatctttaatcctccaatttatagcgtaatatttatatccccattatacgttgagaaccatgtgagcattaggagattgccgtgttgcctgcattcagtgagtaaggataagggttgccaggttgcattccatattggctcgcaagaacacaggtttcaattcgttaataatgggatggagtagaaagttgccaaaggaatggtaatggtgggaaccggcattgttattgtatttcaaccaaaggaaatgagatgggccatctggagaattgaatgccgaaatcatgtggatattggttgaaataggtgcacatatttgctgtggtatggacaatgtgaattggcgattatgggatgagggattacgggcgacgggttaaatt

SEQ ID NO: 709097 - DNA, 444 bp, Homo sapiens
ataaggataagaaaagtttctgtaatagatgatcctccaaattaaaatagaatgtgtagtttcttcaatgtgcgaaaatgtaaacttacctcaagcatttctaaatcaagttttctagttctagactgacagaaatgatgggacctggtggtttattcttcttggctttcagaactgtgccgatatatacaaaattactatctatgacaaagaacagagcagagctgatatttcagagttcaaaacagcatttgaaattttctacctgaccgtggaatccgatgatcctgttatgatcactctctcatcatactggagacagaggactgaacctgtatggcctgtgagaattcgcttgcattccaatgtgtttttatcccagatctaggatggccaataagatccttttgatcaatgtgatgatggggtgctgtggagacttgt

SEQ ID NO: 709098 - DNA, 232 bp, Homo sapiens
gatcccccgtgctccatgggttcggaatttctcgtttgaggaggttataaattctggagattgagggtgattattgctgcatccatgtgaatacacctactgccacagatctacacactttaaaatattttaaatagcacattctatgtatttttttacagtataactaagtaattacaaccattgtctcccactagcattctaaaatattgttgctatgacatgattcaag

SEQ ID NO: 709099 - DNA, 653 bp, Homo sapiens
gctctgtgtccacagagagagagtacctgtgtggatgctccatccgttgggggattccctagcctctgtgtacacttactgagagtacctatgtggacttaaatgatagctactgtctggcgtggcgcttactgtctggctgtgtgcatctactgtctggtgtggcagcctacgtgtctggcggtggccctactgtctgtcgtggcggctagtgtctgcgtgttggggctacccgtctgtgtgtgggcctactgtcggctgtgagcctactctctgtgcgtgggtcttgtctctgtcgtgggtctgctgtctggctgctgggcctactgtccgtggtgtgggcacaactgtctggcagtgggctggccagtcgatagggctggcacgtgcaatgagccggtgttcgtgcagccgtgagcgcattttgatgcaaatagaaggaatcagctgtgggtatataactctccgtatcataccaatatttaggactacactttgagaagcactgtattaatgtattccttgatctggacttaagtacactacccgggatatctaaacggagacgggatcggggaaccagcgattgggtccgggatggataacacatggtaggtgtggtcacccggagacttgacaaataaaaatacccg

SEQ ID NO: 709100 - DNA, 187 bp, Homo sapiens
  misc_feature (7)..(7): n is a, c, g, or t
agggggnccaggcccagggcaggggtcaaaggcccaggccctgatttcggcttcccaaagatctttccgccttagttaaaagcatgtgtcgggaaattcctcaaagggctcaaagtccctgtattttaaaacctttttacaatgtaaactgttcaaaactgttttttgtaacaaaaccttgttttta

SEQ ID NO: 709101 - DNA, 161 bp, Homo sapiens
tcacaagtataccttgctgtgtagtatacaacctagtccacagacccaacacaagagtacacaatgtaaaataactacaggatatgtgtacgaggtatatatgaaatgtagatcaattctgtctttagattcaggttacattcacaagataacttactagt

SEQ ID NO: 709102 - DNA, 332 bp, Homo sapiens
  misc_feature (300)..(300): n is a, c, g, or t
  misc_feature (304)..(304): n is a, c, g, or t
ctggccttcatttggtttagtattctggcaatgttttaccaaacagcagcttttcttctgggtttagctccagctctccctcacatattgacttttaccaaaccctttatttttactcacttaacctgggtcaggtgctcccaatagtcaagctctcaccataagcatctggcaccgagaacctgacaaccatgactacagagtgtttcctgcctttaaattatccagtttcttatggaggatagtgcttattctcaaaataggaaagtcataaatcagcaaaaatgttattaatctagnctanttaagcaatatactttaaaaatatatga

SEQ ID NO: 709103 - DNA, 168 bp, Homo sapiens
  misc_feature (13)..(13): n is a, c, g, or t
ccccccccccggnttttttattggggggggggggggggaacatttttcccccgggaaccccttttccccttgggccctttttgggggccccttaaacccggtttggcccaaaaaccgggggggggccgggcggggtttcccggggttttttcccccccccgggcccca

SEQ ID NO: 709104 - DNA, 384 bp, Homo sapiens
tgggaggctgaggcagagaattgcttgaacccaagaggcagaggttgcaatgagctgagaccgcaccactgcacccagcttgggcaacgagtgaaactctgtctcaaaaaaaaaaaaaaaaaaaaaaaggtttttaaaaaggccaaaacccctgtgtgggaaaaaggcattttttataggggccgggcacccctttaaaaccccccaaaggttttttccgggattgcaaaaaaagggggttctttcttgccttttaagctttttttttttttaaaaaaaaaaaatttaaagggcctaggggaattcttttttttggggggttgggggaatttttcgggggggggaaatttgaaattttaccaaggccccttaaaggggttaaaa

SEQ ID NO: 709105 - DNA, 1096 bp, Homo sapiens
cccacggcgtccggctgcgccgagcgctctgagggttcgtggcccaccgctccttcgcggtccctgccgccaccgtgtccacgctcagcgtcggtagcagaagatggtgggttcggaacagcgccatcgccgtccggtggtagtgcggggccctgtttcatggggtactgctgtctacttcgagccgcaaaagtacgaagtgagcccaacttcaagaacaggtcttcgaggaaccgaggacacagaaagcaggaagcgtcggccaggggagagagctgggcgtttccaaggtgtacctgaccttaaagatgctgaagctgttcagaagttcttccttgagaggaactacagcttggctgaagagttgactagactcagagggtggaatatgagagaggggcgtaggaccatcgtgacaaatgcaattgctgtgtgtggagcgccagcagcagttactgcaggtcgtgtacagcaaactcttccagcaccagtgttccagatgcttctgagctaagctcgccaggaagttagtcagagaatggtaagtgctcagagcgttggctgaagatgatgtggaatgagaaacaaatgtcaacactactacatatctcagttaaacaatattttaaaaattcttggtagtcgagcagctctgggggaataagggcaattatgcttgttatgaactacactgaaatctaccaaagttaacgtatactttggtggatccatttgtctatgatttatttttcccagggaaacggggattgggcagaagaaatttcattctataaataccgtatgtgagttactacagcttccgggacatgggaaatcctggaaactagttccacgctaaacggtccattgcaccgggggcagtgtctaaaaatccccgggggtccgtcttggaaaccacggccgaaaaagagtctgtggagcaacgagcaaaggtgccaatatacgagcagcaatgtcgcatgtggcactggtacaacgtcgtgtgttcaacagcataacatttgctaacatctcattatatagacgacaatagagacgtgatgacagatacactgtgcgatgacacggcacggca

SEQ ID NO: 709106 - DNA, 431 bp, Homo sapiens
ctgcttgcactggctggaaaggccaagaccaaggggctgcagagtggtgtggacattggagttaagtatgcggagaaacaggagaggaactttgacgacgccaccatgaaggccggccagtgcgtcatcgggctgcagatgggcaccaagacaagtgtgccagccagtctggcatgacagcctatggtaccaggagacatctctatgaccccaagaaccatatcctgcctcccatggtaccactgcaccatcgagcctcccagatgggcaccaacaagtgtgccagccaggtgggcatgacagctccagggacccggaggcgaatctatgacaaccaagctgggcaccgtgacaagtgcgactaactcttccatgtccctgcagatgggctacacgcagggcgccaacagagcggtcaggtcttcggactg

SEQ ID NO: 709107 - DNA, 353 bp, Homo sapiens
  misc_feature (179)..(179): n is a, c, g, or t
  misc_feature (345)..(345): n is a, c, g, or t
gtccgagatccggcgaggataggagtatcggatcaaaggacagctcagcacgcagcatgcagtcaaaagcttagactagcacaccccacgggaaacagcagtgattaatctttaggcataaacgaaagtttaactaagctatactaaacccagggttggtccatttcgtggccagccancggggtcacacgattaacccaagtcaatagaagccggcgtaaagagtgttttagatcaccccctccccaataaagctaaaactcaactgagttgtaaaaaactccagttgacacaaaatagactacgaaagtggctttaacatatctgaacacacaatagctaagnaccaaact

SEQ ID NO: 709108 - DNA, 634 bp, Homo sapiens
  misc_feature (255)..(255): n is a, c, g, or t
tcgtatacaagcgtacaaaggctttaaactcaatacgaacatctacgggatgtacttagatgccttaaaaaagggggcagatctaatttatatttgaaccctacactttccaaagttcaccaatgaccgcagtactagaagattagaggcacttcacaagcattgaagaaaaatctactggatacttactttcttagcacaggtagttcttagcttaaccaccaatggcgactgggttcattctggaatcctggnaggagcttcctcgtgccacccagtgtttctgggccctctgtgtgagcagccaggtgtgagctgttttagaagcagcgtgttgccttcatctctcccgtttcccaaaagaacaaaggataaaggtgacagtcacactcctgggttaaaaaaagcattccagaaccacttctctttatgggcacaacaaagaaaacgaagactgaagttcgcctacccaaaatgaaaagtaggctttacagtcaaaagtacttctgtggatagctaaataacttcattttcttgaaatagagcaactttgagtgaaatctgcaacatggattccatgtatgtaagatactgctgtacagaagagtaaggcttccggtgccaatgaggcgtc

SEQ ID NO: 709109 - DNA, 166 bp, Homo sapiens
tatttaactcgtaagtcaggactacggctggctgggatatggcagctctagcttgggctgtgtgatttggagcaagtaccttccttctctgtgccctagtttcgtcatatacattgcaataagctgtaacagacaatccgaaggttccctccagatacaaattctc

SEQ ID NO: 709110 - DNA, 298 bp, Homo sapiens
ggtccggttggggacgagcccggagtcgagaccaatattgtaagcaaatcgttgtatggaccacttatttcatactgctgtcataaacatcctgtgtgtaatattattctctaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 709111 - DNA, 340 bp, Homo sapiens
gagctacgctatactcgcacgaaacggggtcaaacaggcgcgcataggaatcacgcatcacgcatgccgatagaaatcaccttccacccttactagcacaatccaggacgccctcggcttagttctcttccttctctccttgatgacataagcacatacttgtgcacgagaattccctaagcgacccagagaatgtatatgcctagtcggccccttacgtcgccctccccagattcaaggcccggagatgatactttgcctgttcgcctacgcaattctccgatccgtccctaacaaactaggaggcgtccttgccctattactatccatcctcatccta

SEQ ID NO: 709112 - DNA, 1184 bp, Homo sapiens
  misc_feature (133)..(133): n is a, c, g, or t
  misc_feature (617)..(617): n is a, c, g, or t
ctctcttgtttttttcgagctgagatcagactgaattcgtgaagcgatgaagagggagagagcagagcgagcagcaagagagggttgctatttgcgcttacctgtcttctgttcattggttgatattctttcngccgaggtgtgtgtacgaccacgtggggggcccctgttccgctgctgttgcccgggtgattttcggcgacacctccaagtctttgtggtactcttcttccgggcacacattggcgttcttatcccaaggtaggtcgccgccggagatgttcgtcctggcccacgcttgtcgtggggcaccccgacgagtgcgccccccgttgtgaggccaacctgggctttcactgcttcagggtggttttcccttggaccctctccccgtccccttttttgctcgcccgcgctttggccccctcgtagttggtgattccccccaccaggggtcccaaccttgcaaagcaaagttttgcttgacctgtaaggaaaagagtttgattcccccggtcttgggtataaaagctgggaagattggcccctagaagttccttgaaggtctgggtgagtgcctgccacattggttgagataatggtttcctcggcacagncccacatgtgtgtgttctgagacgctttctcacgacgtaatacccaccttttgggtctgcattttgcctgttctcgtgtattatgagcaccagaccagttgtcggtggcgtgtccatccaaagccagtggcacccagaaggctgcctgggagcctggccctaggtccacaccagatctgccccagaataaggctccaggaaggcgtcattatgtgaattattatccctgttattacactgcccacccccacatcgttaaatccagtggtggaagacaccggtctccagagactgtgttgtgttccaattggcccatatttacagttttagttagtcaaaagactggtttaatgatacaccaatagccatcgttcaaaccttccagaaggcaaaggagaatagttttcgtggacccctttggttttcttttttgcgtgtggcagttttaagttattagtttttaaaatccagtactttttaatggagaaccaccttgacccaaaatttgtccccagaagttttgagacccctttaaaaagttcaatgagaaacaaaaaaaaaaaataa

SEQ ID NO: 709113 - DNA, 1229 bp, Homo sapiens
gcacggagctcactggtacgcgcgagtgagatgcatactgacgccaaaatccgtgctgaaaatggaacagggtccagctccacggggtcctggctgcagactaccaggcactattgcctagcgtaactagaacctagcatgtacgcaggccagataggcatctagatatcctatcctgcaaggtgacacctactgtcctggcgggtgtgtacgaggccggccgaggatgaaggtcagcacagagatcttacaacaaggccacactcgaagtgatcctgaggccgaagattgaggctgcctaggtgtcgcagagcacagagccgggcagacggctgatcaggaacacgtagcgaggcggaagagcagactagggcacgtagcacaccccgaacaccacatacaaacacacgagacagcaagcaacgtaagaacagcagatagaccaggaactacataactcctaggaccatagtaacgaactaagacatagaccgaacacatagaccatgacactaagagatagaaatagccacggtagtagacacaatcgccaaaatacaacataactagcagaaggtacagacctggcagccacacatggaacaacctcgacacggagacccctacagtcgccagagcatcgctaacccatgcccaaggacacaagcacaaacgcgaagagccacgaagagccaaaacctagaactcatatgaccacaatacgaaaacacatccaaatacaaaacctaagaaacaacataactagcacacacatcacaacacaccacaaccaatacaatactaaccatcaaacaaccccatgaatacctaaaaatcaaagatagccatacacatacactaacattaacacacccacgaataacaacaaaaacaaacacataaaactacacaagaatacaaacataacccaggtctaaaaaattgaactatgccaacaatgacatcttaaaacaatcccacaacaaaaccccaacacagcaccaacccatagaagagcacacagaaacaacgaaaacccaaatagcaaaacagaaaagcaagataaagcccccaataacaaccaaggaaaacaaaaaccaaaaaaacgaacagacatggaacaccaaatcgaaccaagggaaacaaatgaagcaatgtcaagcagtagatacaacaaacagacaacagatagaaaaagacatcgaacacgaaaaagaacccaaaggcag

SEQ ID NO: 709114 - DNA, 1098 bp, Homo sapiens
aggtccaccactactggccatctgatctataaatgcggtggcatcgccaacagaaccattgaaaaattcagagaacggaggctgctgacgatggcaaagggctccttcaagctatgcctgggctctatggataacacctgataagcctgacgcggtgaacgctggctagtcacccattgactatcgtcgcttgctggcaaatctccgcagcactcgagcatacgtacttatcgtcgactgatccattcgatagccacctgtgcacaaccagcacgcactatatatacaacaaaccatgcactctacagcggcaccacttcctcacgcgccctgcacctgctgccatgcctccctgcactcccgctagcacctgccctggcctgctcacgacatccacactcctcgacacgcccccgcgctcactcctcacacaagcacaactgcgacacccacggcaccacacagaaacagcacgacacacttgccccaccttatatcctagcgcgcatcctcaccccatcatcagtagcgcgcccggattggataccacccacacccctcaacattctggctccagagatctgataccaactcacaacacaacaccctgcgccacattagtccccaagcattgacacgcccccctcatccgctcctctaaaagcgagtccagaccacacctacgcccgccagcgcatgtcatttgacaacgccgcaccactccctcgcggcacactaacaacggacgcaaccaagcacttccaacagccctcctcctttcctaaccccaacctcatgcagccgcgacacacccacccacttgcagccgcccattacccgacgacgatcctccaccgtcaaaccaaatcaaggcatcaacacaccaactactttcagcatgccacccgacacctacacataccctggcgtgcatacaacgccgccacaaattcgtcactgggaaccaaacacatcacattgtgccctagctcaagcacccaccacacgttgccctcctaagcctcaattagcccccctattgagccatactccccaacactgacagcacacttcacccccacacacgtgttcatcaac

SEQ ID NO: 709115 - DNA, 234 bp, Homo sapiens
cagcgtcagggctgatgggccctgactcttccccataataactgaccacccttgacactccccttgtagactctcccagcatgtaccccaggcagccactcttagccttgggctttgacatgagaagagccctccttatatcccatatgggccagatcctttacttacacatgggaccagtgaggtcttggggtaaaaagaccctccaaagagatacaaagggcctgcctcctg

SEQ ID NO: 709116 - DNA, 708 bp, Homo sapiens
  misc_feature (513)..(513): n is a, c, g, or t
  misc_feature (570)..(570): n is a, c, g, or t
  misc_feature (590)..(590): n is a, c, g, or t
  misc_feature (620)..(620): n is a, c, g, or t
  misc_feature (669)..(669): n is a, c, g, or t
  misc_feature (678)..(678): n is a, c, g, or t
  misc_feature (708)..(708): n is a, c, g, or t
atcccccgggctgcaggattcggcacgaggccgcccatacacaatttccatcccctgcataagtgcctcaagtagaagatggagatgggcagctgataatcacctgtcattaaaggaaagctgtcatctcaaaggcagatatgaaacaagcagaactaaatagtccgggcagaaaccaagacaatttggggaacagaagggaatttccaaaggagatactgtacctaatatcctcagtgcagtaagagaatataatagcatctgtgaaacagggagcatttgagaaactcttgaagatcaataatgattgcaaatggcatagcagtaatgttggagatgaacacaaggaggcggaagagagccctggaatcaggtagaattggaggagtcatcttgtaggttcagcatctgaataatgagggagaaataaacaaagagatcatccaagacaaagccactgagcagatggatgtgattcccagttgaaagggccctggtgtgagaagacacccncaggcaggatggaggtcctaaaagctcagaactcagggaatagaaacagaaacgcantcttaaaagtttcaagagangaaaatcaagttgcgcatagaggatctggngtctgacctctcagcagccatatggggcgcagtgggatcctttccagtngtctagcanatcagtgagacggtcccagaggtgttcagn

SEQ ID NO: 709117 - DNA, 228 bp, Homo sapiens
gtggagagcagaggcacattctagcagaggttctgtctgggcctgtcctgagcagcagaggcggcaccgtggagaggcagcgatgtctacagcgtctgtggggagctgtggacacttccgaccagccatgacaggcctaagcctgctcagctctgcacgtatgaggatcctcttattcatgactctccgcgctgctgcacctgcaagagacctgcctctctgctgtga

SEQ ID NO: 709118 - DNA, 408 bp, Homo sapiens
caagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtccgcgaatttaaggcaatgctatgttgagcttcattcatccgggatcctactatatgttgcctccctgctggttggatattatcttcatctctgccctgcattgtttagtaaaatgttatcgcgcttccatttctgcgaactttattgtgcggctctgggcctaacctttctgtggttttaaaacacatccctaccttgtattgattctca

SEQ ID NO: 709119 - DNA, 138 bp, Homo sapiens
ggataatctgctgcgcccatgctgagcctgtcacagtcaacaactgggaaacgcgttgcctctactgaagccagtggacaagtagccgaagcacttaaacagcttgatactatgtacttttggtacatttgtttattt

SEQ ID NO: 709120 - DNA, 449 bp, Homo sapiens
taacgcagagaggatcggatcaagttactactgaacttcataggtccacaaggacacgttccacaccagaatggtatggcaaccctgtcctgaaaatcatattgttagacaacggtgaaccttcgagctatgaagaagcgatggcgggcccagattccaacaaatggctagaagccatgcaatccgagataggatccatgtatgaaaacaaagtatggactttgacagactttcccgatgatctgcaagcgataggaaacaaatggatctttaagaagaagacggacgcggatggtaatgttaccatctataaatctcgacttgtcgctaagggttaacgacaagttcaaggggttgactacaatgagaccttctcacccgtagcgaagatgaagtccgtctgaatcatgtcgaacaagagtggtgatagcgcctcctctctgcgtttg

SEQ ID NO: 709121 - DNA, 104 bp, Homo sapiens
caattacagactgccattgcacactagatcagtcaaagtcacagatctggcttcagaatgcaggccactccacatacaggtctactatagtgcattacatacca

SEQ ID NO: 709122 - DNA, 159 bp, Homo sapiens
tgaaacgtatgtgtatacacgcacagatattattcctttcgctttaagatggtagtaatttctgtagcagccaagtactgaggctccctggggctgagatctccctttgtgggactccgagagccgccctgacagtcccagccgccacccaaggagccc

SEQ ID NO: 709123 - DNA, 159 bp, Homo sapiens
gtctgtccattgagggcaccgagcaaggtggacatcaacacagaggacctggaggacgggacgagcagggtcacctactgacccacagagccaggcagctacatcatcaacatcaagtgaggcgaccagcacgtgcctggcagacgcttatctgagaag

SEQ ID NO: 709124 - DNA, 178 bp, Homo sapiens
tcataaggagagagaatcagccaagcctccgaactgcacacaaacgtttaagaagggcgcttcgttatgggagatagtgggctcccagccacaagcaacgcgcaaggcccagctgtgacacacctacggaattactaccgggggggggagccgcccgggggctgtccattacgaagcc

SEQ ID NO: 709125 - DNA, 166 bp, Homo sapiens
aatcctcagaagctactaccatgtgacattctcatgactgcataatcctgcccggtgaaagaggcaggaatgacgcaggacagataagaggggtgggagcgttatcatgatggggagtcttgttctcgacatctattggaaaaacctgctccacatgtgtgaacgt

SEQ ID NO: 709126 - DNA, 109 bp, Homo sapiens
tatgggcattataggcaaagggcgcaacagggggtaggcattaagcaaccatagcacaggtctcagcgttgcacacaaaaacgagcgacgatactacctaccttgcacg

SEQ ID NO: 709127 - DNA, 510 bp, Homo sapiens
  misc_feature (410)..(410): n is a, c, g, or t
  misc_feature (432)..(432): n is a, c, g, or t
  misc_feature (449)..(449): n is a, c, g, or t
  misc_feature (489)..(489): n is a, c, g, or t
  misc_feature (503)..(503): n is a, c, g, or t
ttttgacttaattctgaaataagttaagactttggaagactgttgggaaggcataataggttttagaatgtgaggacatgagatctgggaggtgccagaggtggaatgatgtggtttggctgtgtctccacccaaatctcaccttgaattcccatgtgttgtgggagggactcagtgggagataattgaatcacggtcgcagttttccccatattgtcttcgtggtagtgagtaagtctcacaagatctgatggctttaaaaggggaaacctctttcacctggctctcattctctctctggcctgccacaaatataaaggatgtggccttttcacctttttgccatggatttttgagggcctcccccaggcaatgtgggaactgtggaaatttattggaacccatttttnctttataggattaccccagttntcaggtacatctttttncatcagtgtggaaaacgggactaattacagtagggttgtncattgtaaccaggngcacttt

SEQ ID NO: 709128 - DNA, 949 bp, Homo sapiens
gaaggaaaccagctctgccccccctaatccgcactactgctcctgcacggacgagctgaaccacttgcgcatccagacggcaaagatggtggcagctgatgcatcttcgccttcataaacgccagattctttatctccaggaagtttcaaggtgtctcgtcctcccgttacctgtgtggtggtagtcctcattccactctacgagagtttccttgcgtcagtgatgtgcacactcaccgtaggaggacaagacgggtggagttgtcgcctgaatgctgccagtcgagtccccctgacttttgttctgccaggcccgtgaatgttgcaaaacagcaacacgataaggtgcctgaagcttcggtcggaagagggatgaggtgcagtcatcgtttggtccaaggagtggcaagacattctgggagaccactgagtgggtatcctgaaggagcatttcactcgacaggggaaacccccagttcgacgtatctgacacggtgatgtacttgaggagagggaagacccttgctgtgcgtaatctcatgaggtcgctaactcggagtgacacgttgctcttgaggacgaaagatatcagtcgaaacggggaaattgagaaaccctcagctctgaaaaagctcaggctcatgctccccgagaataccttcaatacgctgtcttcctcaccgagagatagtgatcttgcctctgagcggatgatcctctgcagcagtctttgctgatatgccagaggttgaactgaagaggagtcttgccttttgtcttccagattgcaaccctaggagaccaaggctgagatgggctgagaccttgccaggagcggtacggggctctgaggccgggcgacttcaactaaatttgcggagagccgaataaacaatttgggccccagaaaaccttgccacgcacgcaaggggtcccaaccggggcccac

SEQ ID NO: 709129 - DNA, 392 bp, Homo sapiens
  misc_feature (30)..(30): n is a, c, g, or t
  misc_feature (129)..(129): n is a, c, g, or t
  misc_feature (273)..(273): n is a, c, g, or t
  misc_feature (341)..(341): n is a, c, g, or t
  misc_feature (344)..(344): n is a, c, g, or t
  misc_feature (348)..(348): n is a, c, g, or t
  misc_feature (392)..(392): n is a, c, g, or t
aattttaattaggcaaaatgttaaaatgantttcccattccctgaaagctaatatctactgatgtaaggtagaaaccatacttgaaagcaccttggatagaaagggaaattagggctggtcatggtggntcactcctgtaattccaacactttgggaggccaaggcaggtggattgcttgagtccaggagtttgaagccagcctgggcaacatggccaaaccctatctctataaaaaaatagctgggcgtggtggcatgtgcctgtggtcccngcaactttggaggctgaggtgggaagatctcttgggcccaggaggtggagattgcagtgagccgagantcngccnatgcactgcagcctgggggacagagagagaccccgtctcaaaan

SEQ ID NO: 709130 - DNA, 466 bp, Homo sapiens
  misc_feature (78)..(78): n is a, c, g, or t
tccccctacagactgacccagtttgtccatcccgggtgtatggtttcctttcctgagggtacccatagataacccccnccccccgagtttagtaaccatataattaaaagtacctcccagaatgttccatggaaataaaatattcctaacccaaaagtgtgtttaaggccccaggcacagtggctcaccccctgtaatccctagtgctttgggagataaggcgggaggatcacttaaggccagaagtttgagaccagcctgtgcaatatagcgagaccctgtctctacaaaaaattctaaaaattagctgggcatggtgacacacggctgtagtcccagatactcatgagggtgaaatggaagatcacttgagtccaggagtttcaggctgcagtgagctgtgatcacaccagtgcattccagcttggatgaggcagcaagaccctgtctcaaaaaacaaaaacaa

SEQ ID NO: 709131 - DNA, 133 bp, Homo sapiens
agtcggataaaagcccagcacatacagtatacccagggaagccaaaacattggatacccctggactatactataatttttattgttattttagagcatattccttctgcttatatattaaaaagttacctgta

SEQ ID NO: 709132 - DNA, 797 bp, Homo sapiens
  misc_feature (718)..(718): n is a, c, g, or t
agcgggtggttggtgtgcgggttacggtgggaggactcgtaggggaggtgggctgcgcttgtccagactgcatccccgaacaggatggcggagggagataatcgcagtgccagacctgctggtgtgcgctagactggaagtctcggaagtaacacgccatgcgaggcatggggacgaagtgatgcgtgagtggcgttgagtaagagtccctccggaatgggaacacgacgccgtgtgtttgcagcgtgccatcagtggggtgtggtgtgtcgtgtcggtgtactcgtgatgtgatctactagtctaaatgccgatctgtgctgtacgcggcgttttccgtgtttggtatgtcgtggtgctgtgggtgactaacttgttccctttctagcgcgctagaatcttatgaggctcctaagtaacattgggacacactgaacgaaagcagcgagataggattccgattgaatagtgctggcaggcaaatctaagttagaaacgtcgaggcatgaagctcgttggagttggcgttgagataacgcctccttgagcaactaaatggaagagaaagcgtacgactggtaccttcactgaccatgaagtcgcgattccctgtggcgtgcgggttgcatgtgggatggggacaatccaatgtaccgcaatcgtgcattcgtaaatcgtaccatgaatagtgacgttgccgttacctagttggcttccntgggagctaaatatcaaggaatgggaactccactctttgaatgtacaattgcgaatgggccaagagcggatagataaaa

SEQ ID NO: 709133 - DNA, 428 bp, Homo sapiens
gcggttgctgggtcagatggtagatatatatatatgcctctctgtctctctctctctttctatgtatatatgtatgtttgtgtgtgtgtatatatatatatacacctatatagatatatgtgtgtgtatatgtatacacctatatagatgtatgtgtgtgtatatatacatatatatattatatatatactttttttttttttaaagaaactgtctaattgtttttcagagtggctgggccattttgcatccctacggtgatgcagattttccgcatcctcaccagcatttggtggagttgctgtttttcattttagccgcgtcctggtagggatgtgctggcagggtgctgtggtcctcattcgcgtttccctggtggccagtgacgtggagcatctttctttgtgcttatttgccatctgtgggtt

SEQ ID NO: 709134 - DNA, 564 bp, Homo sapiens
  misc_feature (49)..(49): n is a, c, g, or t
  misc_feature (161)..(161): n is a, c, g, or t
  misc_feature (243)..(243): n is a, c, g, or t
  misc_feature (245)..(245): n is a, c, g, or t
  misc_feature (247)..(247): n is a, c, g, or t
  misc_feature (314)..(314): n is a, c, g, or t
  misc_feature (437)..(437): n is a, c, g, or t
  misc_feature (465)..(465): n is a, c, g, or t
  misc_feature (555)..(555): n is a, c, g, or t
taaaccacactggttaaaaagaggtggaaaattcaaaggaaaaaaagcngaaaatgtttctcattaagtaagggttacacaaaggtaatatttataaaatatatatttgtatatttataatttagagacgaaaaaaacggaatggcaaagtgatgcctgcngtggttagacctcagaaacttgaccgtttcccacaaacagtttttcttgacaaagggggttaacaaggaccaccccagtttntntntagtggccattggctggggagcggggctctaagaccgggtcctcagaggtttcaagggactggatcnccctgggcagccccacagcatgcctttggaagtggtccatggggagggtgtggtcccagtggcccaggttgtcctccgggtgggcggtcttctcctccctctccaggcagcacaccgtcagcnggacaaaccaggaggagaggggcacgcngagggccaggatcacccaggcgaaacccatctggctcaggcagaggggggctctttccggcggttggtccccctcggccacaagggaaangtcccctgc

SEQ ID NO: 709135 - DNA, 107 bp, Homo sapiens
ccggcacatgtgctgcatctgtggagcggaccactccctcacattcacaggccatggactcacgtctgttacagactcctacaacactgaccaataaaaaaaaaatg

SEQ ID NO: 709136 - DNA, 153 bp, Homo sapiens
cgaagtatacgtttggcaggggtgaagtccaaacgaaaagatacctgtccttcgagtcagtgagttaacacctgtacaccaccttggtgggagaacaagaaagctcagctggtgtgtgattgcacacgacgtggatcctgtcgctctgccaaa

SEQ ID NO: 709137 - DNA, 150 bp, Homo sapiens
gctcggtaccgtgctgcgagggtatgtgaagggtgtttaaagccaatattttgtacattgctttgaaagatgctgctgatgcttcctcagcgccgatggagggtggccgaggagagtagcctgtttctggggtaggcggggtcactgcgt

SEQ ID NO: 709138 - DNA, 218 bp, Homo sapiens
cagcacatgcgcccatggccacccatttttccaacatttcacatcaagcatcactgtcacatcacaatgcaaacacacatcaaattcaggtcaatttcaccaagcaacatgttttcccagcattcacacatcagagctcatacacttcagctttcattcatgcacatcaaacatttcatcggccaccatccatcaccattatattaccatccaccagc

SEQ ID NO: 709139 - DNA, 361 bp, Homo sapiens
ctggagaggctgcaggcacagcacatacctatagtgctatatatgttagatttatacctaagtgtttcattttttagagggattttaaattggtattgtatttaaaatgtcagtgcccatgtgtctgtaagctagcatgtagaaatagaattgacttttgatcgtttcatcttatgtcttgacgacctagttaaactcacttattagttctagtgagggctttatagaggttagattccttgtaattttctatgcagagacaatcatgttatctgtaaatgagggcagttttgtttcttcctttcctgtctgtgtgcctcttattgccttttcttgccttattgcactgatagcctcccag

SEQ ID NO: 709140 - DNA, 367 bp, Homo sapiens
atcgcttgtccaccaataccttgcataagcaggaagcaggctttggagggcagaagcaggaagcggcagaagcaggagtgcagaagcaggaagctcctgcttctgccgcttcctgcttctgcttcctgcttctgcccttcctgcttctgccactactattacgtttctgatcattatactcctgtttttttgctttgggaaattagggggattttgcgctctccctcatctttgtccaaaatttgtcaatatatccggcactataaaaatagaaatcacatgtgtatctctcagcgtgcttagcacatgtgacagcttaacatgaaactcttcctgacacagttttgatctctaatagctcaggggt

SEQ ID NO: 709141 - DNA, 797 bp, Homo sapiens
tggtcttaggtacaaaattttattaacaggtcttaagaagagcaacatccagaccccagaaataaagttgccaaggaaaccctgttatcctgtgggactgctggggcttgcaggcggtctggatccccacccttctgtctctgaaatgggggtgggggcggcagtatctcatcttaggggtcccacaatgctcacgtggtcaggcagggcgctactaagggccaatcttaccagtggggtcccaggcagcatgatcttcaccttgatgcccagaacaccttgtgtctgagcaacacgtggcgcacagcagtgtcaaccgtagtagtaaccaggtctccgctggggatcaatcaggccatccacaaatttcagggattgagccctctgtcctcggagtttcccagaaaccaaaactcgaagcctttgggccccattctcatgatgaaccgagacaccatagcaggccctccgaaagaaagccctcctaggagttggtaccgcagagactctgcctgggcaatgccaacaaaagaccctctagtggcaacccttttcaagcataaacgctctaaagtggcccttgtggaaaagacaaaaccttttttgaactctacagcaagctagttcccggaatccggcggcctttttacaccaagaacattctgtggtccgggggcaaccataatgatttccggccctggtggggtaaaccgcccctaaactccgagtagcccttttagccagattccgagaaaaaatcattcaggtcagttgaagatgccccacgcgacatctct

SEQ ID NO: 709142 - DNA, 898 bp, Homo sapiens
  misc_feature (20)..(20): n is a, c, g, or t
  misc_feature (78)..(78): n is a, c, g, or t
  misc_feature (136)..(136): n is a, c, g, or t
  misc_feature (164)..(164): n is a, c, g, or t
  misc_feature (299)..(299): n is a, c, g, or t
  misc_feature (301)..(301): n is a, c, g, or t
  misc_feature (303)..(304): n is a, c, g, or t
  misc_feature (306)..(306): n is a, c, g, or t
  misc_feature (318)..(319): n is a, c, g, or t
  misc_feature (364)..(364): n is a, c, g, or t
  misc_feature (399)..(399): n is a, c, g, or t
  misc_feature (415)..(416): n is a, c, g, or t
  misc_feature (418)..(420): n is a, c, g, or t
  misc_feature (422)..(422): n is a, c, g, or t
  misc_feature (424)..(424): n is a, c, g, or t
  misc_feature (430)..(430): n is a, c, g, or t
  misc_feature (456)..(456): n is a, c, g, or t
  misc_feature (463)..(465): n is a, c, g, or t
  misc_feature (467)..(467): n is a, c, g, or t
  misc_feature (473)..(473): n is a, c, g, or t
  misc_feature (477)..(477): n is a, c, g, or t
  misc_feature (487)..(487): n is a, c, g, or t
  misc_feature (494)..(495): n is a, c, g, or t
  misc_feature (500)..(500): n is a, c, g, or t
  misc_feature (543)..(543): n is a, c, g, or t
  misc_feature (665)..(665): n is a, c, g, or t
  misc_feature (674)..(674): n is a, c, g, or t
  misc_feature (698)..(698): n is a, c, g, or t
  misc_feature (710)..(710): n is a, c, g, or t
  misc_feature (712)..(713): n is a, c, g, or t
  misc_feature (727)..(727): n is a, c, g, or t
  misc_feature (829)..(829): n is a, c, g, or t
  misc_feature (850)..(850): n is a, c, g, or t
gggaacatcctttgtgaggnactgtagcctttttttatttgaaactacttaaactccaagaaaagctcactaactctntttcaagtgcaacaacaaatgtaatagctgaaaatagctaatttaatgattatttgtnacacagacacgattatgtgagccaaganagcctccccacctctgtctcccctgtggaggaggaggtctttgtgtgcttttgtgtgatggttccactgaattcattacaatagaaatggacatttgatattcataacgatccaacatctgagcaatcttctttngngnnanaccatgtttatnnctcttttctaattcttcaggatcaaatttccaccaagtttcaggntcatgaaactctactctgtatccttttcctatggncacttccacatatggnntnnntngncaagcntgtatattagtgttatctattataantggggannntncctgancganagcgtgtgtngggctgnnctggntccagtgatgggcatgagcaagttgattaacattatacctgtncccatcttgatggtgaaaatagtgatcagtgctgaacacaatgccatcacgattctgaccaagcagaattcgagacaatgttgttttcccagaaccaggcagacctcttaaaagaataagtnacttctgcnatttatttaacttttcctcttganactgctggttcncnnacctgtctgttccnttatgcttgtccatacaatgatctttccagcatctttctctgacttcacagaaaccattactcacatatcgatcttgcatactgcagccatttccagagggntgaacactactcctattctcnctacagtcagtatatttcattgttctgatcaaaagtcatgcaattcag

SEQ ID NO: 709143 - DNA, 903 bp, Homo sapiens
  misc_feature (1)..(1): n is a, c, g, or t
  misc_feature (9)..(9): n is a, c, g, or t
  misc_feature (94)..(94): n is a, c, g, or t
  misc_feature (264)..(264): n is a, c, g, or t
  misc_feature (274)..(274): n is a, c, g, or t
  misc_feature (298)..(299): n is a, c, g, or t
ncttagcgnggaacaagaaagtggtttacattatgaaccggatcatgcctatcccagaaacattcaaatcaagcccatgagtacccacgtggcnggggggggtgaaccaatataaatccacaagccagcttgattccaccaatcagagaagttgaagatgaatgttgactcccaggagaccagaactatttttttaaagcctgacaaacttcataaatggggatgggacttttcttcttacatgctgagggggggggggaaacnttagggtgancaaaaatagccaaaaaataaagtnnacggatctttctctttgtctggcttgaatattgcttccatgtattttggaaaagaaaatgatttcatttataaatgaacatactaaaatagtcatgtatagcctctagcatttgagattatttttatttattagaaagagaaaatgttttttcttttcattggcaaatatcttccctatatctaaacatgggaaatctaaatgaggtaggggtcagactccttatgggggggtgtctggtggtgctttttccttgggggagaggagtggcctcaccccaattatggggagtaagggggagggatgtgtgagaacgtttggaagatggcctaaaaaaaagatatgggcttgttggccaacggtgggaggtgggggggcgtcgcttaaggggggggattcaggaactgggtgatggatcgttggcgagggagttggtaggggagaggtgtttctttttaaggcctggtggggatcgacaagactgggatagccacgagaacgtgggggaaaggcgcaatggccggacggtggagggcgtgtggggtttgtattagcgggcgcgtgggggtgaacacgggttgggtgattgcgaagcgcgaggtggg

SEQ ID NO: 709144 - DNA, 899 bp, Homo sapiens
  misc_feature (300)..(300): n is a, c, g, or t
  misc_feature (302)..(302): n is a, c, g, or t
  misc_feature (304)..(305): n is a, c, g, or t
  misc_feature (307)..(307): n is a, c, g, or t
  misc_feature (319)..(320): n is a, c, g, or t
  misc_feature (365)..(365): n is a, c, g, or t
  misc_feature (400)..(400): n is a, c, g, or t
  misc_feature (416)..(417): n is a, c, g, or t
  misc_feature (419)..(421): n is a, c, g, or t
  misc_feature (423)..(423): n is a, c, g, or t
  misc_feature (425)..(425): n is a, c, g, or t
  misc_feature (431)..(431): n is a, c, g, or t
  misc_feature (457)..(457): n is a, c, g, or t
  misc_feature (464)..(466): n is a, c, g, or t
  misc_feature (468)..(468): n is a, c, g, or t
  misc_feature (474)..(474): n is a, c, g, or t
  misc_feature (478)..(478): n is a, c, g, or t
  misc_feature (488)..(488): n is a, c, g, or t
  misc_feature (495)..(496): n is a, c, g, or t
  misc_feature (501)..(501): n is a, c, g, or t
  misc_feature (544)..(544): n is a, c, g, or t
  misc_feature (666)..(666): n is a, c, g, or t
  misc_feature (675)..(675): n is a, c, g, or t
  misc_feature (699)..(699): n is a, c, g, or t
  misc_feature (711)..(711): n is a, c, g, or t
  misc_feature (713)..(714): n is a, c, g, or t
  misc_feature (728)..(728): n is a, c, g, or t
  misc_feature (830)..(830): n is a, c, g, or t
  misc_feature (851)..(851): n is a, c, g, or t
tcgaatcgagctcggtaccggtatgtcctcgatcgtgagctggtggcgtctgttctgggttccggtcgtggtgcatcaccagatgttgattaggattatacctgtacccatcttgatggtgaaaatagtcatcagtgctgaacacaatgccatcacgattctgaccaagcagaattctctgtctcccctgtggaggaggaggtctttgtgtgcttttgtgtgatggttccactgaattcattacaatagaaatggacatttgatattcataacgatccaacatctgagcaatcttctttngngnnanaccatgtttatnnctcttttctaattcttcaggatcaaatttccaccaagtttcaggntcatgaaactctactctgtatccttttcctatggncacttccacatatggnntnnntngncaagcntgtatattagtgttatctattataantggggannntncctgancganagcgtgtgtngggctgnnctggntccagtgatgggcatgagcaagttgattaacattatacctgtncccatcttgatggtgaaaatagtgatcagtgctgaacacaatgccatcacgattctgaccaagcagaattcgagacaatgttgttttcccagaaccaggcagacctcttaaaagaataagtnacttctgcnatttatttaacttttcctcttganactgctggttcncnnacctgtctgttccnttatgcttgtccatacaatgatctttccagcatctttctctgacttcacagaaaccattactcacatatcgatcttgcatactgcagccatttccagagggntgaacactactcctattctcnctacagtcagtatatttcattgttctgatcaaaagtcatgcaattcag

SEQ ID NO: 709145 - DNA, 144 bp, Homo sapiens
agagtgagtagtagattgtgtagtgggaccagcgtgtcgatactggcaaagttgtgagtcgaatcctggaagccctgcacgaacaagacctgggtcctgcgttggaatgggccgtctcccacaggcagcgcctgctggaactca

SEQ ID NO: 709146 - DNA, 301 bp, Homo sapiens
cggcttcgaggccctggagacgcccttcgtcgagtatacggaaagcctcggcaagttcctgcccgacctcgaccggccgaacgcgggcgtgttctcgttctaggacgacgacgaatcctggctctcgctccgctacgacctcaccgcgccgctcgctcggttcgtggccgagcactacgacaccctgcccaagccctaccggagttttagagccggctacgttttccgcaacgagaagccgggaccgggccgcttccggcagttcatgcagttcgacgccgacatcgtgggtgcctcctcg

SEQ ID NO: 709147 - DNA, 118 bp, Homo sapiens
gaatgagctgcaccagtagcggacatagtagcgtcagtacgcggtagcatcgagtacccctatgacgtcccgactatgcaaccaacacaacatacccccagcaggcgtgaccgctccg

SEQ ID NO: 709148 - DNA, 1743 bp, Homo sapiens
tccagtcgccatggtgccctctagagacgttcttcagatcgggggaaactgggaagatgaactggagcgtgagagctaataatgtctgggtggaagcatcaatcggcacttcgtgaaccggtggtcaaggatgctcaggcacgtccaactgaggctgggttggtgcttccccgcgtaactgcctattatcagaggtgctgcctcggccaggagggtctatgagtcgcgcacacgtagttgcgtagttgggggtcgccgcgacgcacacctagcttgaacattgagtgaccattacagtggaggccgtattgtgaactgaggagcagtagtccacgatctccttgggcaactgtagtcaatgatggagctagcggtgcatgtgctagaggtgggcgtagcggtccatggggggcgagatactaggaggaggcaagcgagcaaatgtcatgtgtggcgtggacgtcgacgagttgaggcgattgagattgtgtgcgagagatacacgtaggggcctagtagcctcttggcgatgaagggtgaacatccgagaagataaattcgtgggcgttagacgggtggagggggaccgagacgcgtgattaattgacgaaagcggcgaaaaagccctggggccaatgccacctggaaacgaagagggatccgtaggttgccaggacgtctacgcatcccaagaggagtcccaatacggggcaggacattagaccgcggcaagggcgaagcgagggacggcaacccgggtcgtgcaccctggcgcgctactgtaggacgctttgaatgaatgtcgggccccactgtgggaagcaccttggggtagaatggaacgtcgacatagagaaggaccttgaaaacaacgggacactcgagcgggaaaagattacctcgggggaggaacaaaaggccctacccggacgggcagtaggggtcctggaaaagcttgccagaaaacggttcatacatgccacttggccgggcatggggccttccacagaaaggcggcacacccggggtacacttcacgaccttagtgggggaaaggccgcccgttgggacacactgtgtgcgtagcagcccatatgatcccacgaggggacgtactaggcggtggcaccattcggggcgtgggccagcaacactgtagtctaagcgggaaaagcatgtggggcccaacgcgcacaggatcgctcgacattgtctggagaatggcgcttgaccggcatgcagaggagtgcgggtggcaacggcgttccaaagggccaggactgtcagagggggcacatcctttgcgaatcgcctcgggacacacaggaggagggcgcccgaggtacgacgagagtcccctgacaaccggatataccatgaccacaacggcccatgggcagcctactgaccgcgcccaagaaggcccacgagtacaagagtggcacgctacaccagtgccaaataggcacaagaacagacgggtgcacaacctgcgaaacaaacacagcggaggaccgacccgaaaggggcaagatggccaccaggatagatgcgctaccagcacggagcggcgtgcagcgcacgacagcgcacgccacaacaaaagacgcgcacacaacccacacgaggcacacagacgacaacgcagcaggacatacgacacaccaccagcagtagcaacaagacctcgaggaaaacaaagagaagaccgaagcaggcagcagacaccacggagcctagacg

SEQ ID NO: 709149 - DNA, 413 bp, Homo sapiens
  misc_feature (413)..(413): n is a, c, g, or t
agagaactagatattagtcagtctgttcttgttagattcgtctccatgtgatattaattgaagcacagagaaaggaggcacattgctgaaggaaacctatgtcctttagacagggagatggctttacaccagccagagacaaactcagatgactaagctgttgatcttcatctgctctgtcttaatcttatggtaggctgctatgctgttaaatgtgatgctgtcagcctgcagattgactcgcctcatcctgttatataccctccttggctaagcaggcttgcttatgagcagccttgcagcactatgctacagaagctgctgaatcaggcctaccagcgttcagttgctcttttgttggcttgggctggagtatcacgctgagcttgagcactgtggctctagatatgttn

SEQ ID NO: 709150 - DNA, 334 bp, Homo sapiens
catagatagtcaccgctccagcctgggctgacagagccagactcactcaaaaaaaaaaaaaaataagccggggcgtgatggcggggcaccttgtagtcccagctactcaggaggctgaggcaagagtatcacttgaccccaggaggcagaggtggcagtgagctgagatcacgccatggcactacagccggggcaacaagagcgaaatttggtctaaaaaaaaaaaatatcagagggctcctcctatgctctggatcaacttctctcggtaaaaacgtaaagctctctccgggggtcaggggtagggccggtgccgggggaaatacggggtgtg

SEQ ID NO: 709151 - DNA, 356 bp, Homo sapiens
tgggtgcaggagagtttgcatctcctgccaccgagcatacatcgttctgtttccctgcattcgttcctggctgtgtttcctgttggcactacacggcatatgataatgtcgtggctacgtacacccctgcgactctgaagaacattgccaacaagtttaagtgcaggttaaaactggcctgtctacactgttggtactcaactttgtgctgcccttctgcaggtttgatggtgatgagctcaccacagatgaaaggatacggtccctggctcagcggtggcagcccagtaagagtctgaggctggaagaacagagcgccaaagctgtggatacagacatgattatcctgccatgct

SEQ ID NO: 709152 - DNA, 161 bp, Homo sapiens
  misc_feature (119)..(119): n is a, c, g, or t
atacactctgctctggtcagcagttctgctcagcactagtagctgggatacaggcgccacatcagccagtacttgtgtattttagtaagacggattcatcatgttggcaggctggtcgnaactcctgactcggtgatcacctgctcggactcccgaagtgc

SEQ ID NO: 709153 - DNA, 134 bp, Homo sapiens
ataaaaatggctgaccctaacaatatgtacaaaaatatacaatgtaaataaaaactacaaacaaataacctttttaaagtacttacaacaaaaaaagcagggccttggaagtcttggtacttttttactcccct

SEQ ID NO: 709154 - DNA, 579 bp, Homo sapiens
  misc_feature (186)..(187): n is a, c, g, or t
agaataaaagggcccccccgcggcggggggggggcgccataaaaaggggtttttttttttaggggggggggggcccccctccttttttggggggggcccccccgggggtgggttttttttttttccccccccctttttttttttttaaaaaaaaaatctttttttttttccccaattttaaaaaannaaaattttttgtgcccccaaaaataaaaaaaaaaatttttttttttgcccccccccccccccccccccccggggggggtgttttcccccccccaccaaaaaatttctccccccccttttttttaataaaaaaggggggggggtctctcaagatttttttattaaaacccctcttttttttgggggggttttatatttttttccctcccccccaaaaatttttttttggggggtccccccccccccaaaaaaaaaaggggggttcccccccccaaaaaaaaggccgggggaaaaaatttttttttttcccccggggggatttattttattggccccgggtctaatttctttcccctaacctttattgggtaaatggttggctaggtttctgta

SEQ ID NO: 709155 - DNA, 216 bp, Homo sapiens
aattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtctcatcccaaaataaaagtttatttaatttaaataaacattttataaga

SEQ ID NO: 709156 - DNA, 672 bp, Homo sapiens
  misc_feature (554)..(554): n is a, c, g, or t
  misc_feature (658)..(658): n is a, c, g, or t
gaactttcattctgctttgaaaataaggcttccccacagaatttacagctatctataacaggacagtgcaatatttatattaaagagtaccaattatgtcacttttcaatttacatcttactgagaatataccgaaatatattgaaatatatactgaaatatattgaaatatcactaaaaggaccatctctaatgtctcacaatgactgttgcaaaggaattcttaatcgtgggtgtgtgcccatgtgtgcatatatgtgtttgtcatttgaagtcctgaaacacgaaataccttaaaatctacatggtaaatttgtactccatcttaaataatatataattgagattgcaatcactcttaagaaagatataaactcaccaactatgtaaaccttcataatagtacacaaaagcttatttctgttgctacagttacatgatatcaaatgttggcctaatcatctcttggcatagcatgatgatacatagtgggaggctaccatcacctaagtatgaaggtgtctccatatacagtggtacccatatggaactanactagatcagtggtttataaacctatttgtatttgcatcttttaaattataactcatggcactcattactgacaaatagatcacatgtaccctattcaataggnttgtttttattctt

SEQ ID NO: 709157 - DNA, 970 bp, Homo sapiens
tctctgtagcaaacgccgtgatacgcggcagcggttacttcaatgagcatgggcaatatctgtgctcctagggtagcatcctgctatatgattagtcgtatggatgattaaaactagtaatattggcccggggtcattagaacgtgctgagcgaactcaaatggtgttgctggccgatcatttgaccttgttagcctagtgcagcagcgatattgcaaaagccgagtcgtctgctggatccaaaattagcgcgcttcgggacgtagataggggcactgctcttgtacaccggtgagcgaatagtagaaggggtttccttgccagccattgaaaaccagattgggcactgtgttgcacaccccgtgcttgggacatttgatccaccggattctatgggggctcctgatgtccatccaggaataatgggtcggcaaatggggaaccaatggcaacggcctttgatattaacttgacccttgaaagcatatagtaatccccaagggggtgtcggattttgaccatcacacttgtgggtgtccggttgctaaagaaaccaatttacgatgaacggtgatgtccagcctgtaacgggaggccaacttgcccaagctatgttcgaccaccattcgtgtgggggtggggtcacaaggtgtctcccaattgaattgccaaagattggagccaggctttgaacatgggtgtggccttggccttttaagaacagggtatgctgggtgaacacaaggagccctgaagagtacgacagcattctgagtaggaccccaatcaagtcgtgagggaacgaaaagagctcctcattggggcctggagttgaccatttgcgacccgtggaggaataatggtgtgtacaatggacccaaagcagtgtggtccatagttgcctgccaatggtagaaccagcattaacgggtcatccatgatgagtcagacacacgacacagatagtacg

SEQ ID NO: 709158 - DNA, 117 bp, Homo sapiens
gtgttaactgatcaatagctcagaatcagtgacactagcgacatctgctctgccttgttccctaggtgacacttccctctgtttctctttccttggctcccattcactcttccagaa

SEQ ID NO: 709159 - DNA, 190 bp, Homo sapiens
atgtggactcctttaacctctccaccctgatcacaagcacaagaacacatcttgattactcctgccagcatgacccatggaccataactatgattgatcgtccacactaatcgagagaccaaccggagaaccccctatacgatcttgaccgcaacggggaggtccgatagctaggtctgcaggacttcac

SEQ ID NO: 709160 - DNA, 579 bp, Homo sapiens
tccagctaaaaaccaggcgacgtgccgcgaggatgataaaaatacggtctcccccacaactaaaaagcctgcggggaacttgttctgcttcagcccaagagggatcaaaagatcaaaagcagtttgggaaggccaaaaccgtcaagggatggtgggagaaggaaaatccagggggtgtggggtctgtttggcaactggggtgaagggattgccctccccctgctgggatccccccagcccctccggtctggcaggaagggtgcagcctgcaacccccaagggcaggtgtggggctgccagatgctccaggcagggggccagaaggggctcacaaaggcttgccctccagggagatgacggcactgccccccagcttctctgccagggtgcaggcgtccttgacctcctcgtagcagattgcttgcaattcatgcttgatccctgtcagcttcttcttgatggcgaccttggagctggcataaatcattttgctcttaaggggcgcagactcggttgcccagaagataaacaccagatcctccttcttgctctccttgggctcataggttgcatcataga

SEQ ID NO: 709161 - DNA, 371 bp, Homo sapiens
tttttgagaaagagtctcaacctgtcacccaggctggagtgcagtggtgcaatcccggctcactgcaacctctgcctccagggttcaagcgaccttcccgccttagcctcccgagcagctggtattacaggtgtgtgccaccacgcccagctaatttctgtattttcagtagagacagggtttcaccatgttggtcaggccggtatcaaattcctgacctcaagggatccacctacctcagcctcccaaagtgctgggattacaggcatgagcaccacgcctggccaagcattgtaaacttttacactgttcatatatgaaagtgactccaactccttgaaaattttgtcttctggacatttgcgtcgacg

SEQ ID NO: 709162 - DNA, 170 bp, Homo sapiens
cgttagagttgcgccgaacgatgattcgagataggcgacgtccgcgcgatctggatggtcggggcgttgatgcgatgccgcctgccgtgggccacgatggcggctttgattctggtttgggctcggttcaatgccatgcgcgtgctcctgcgtggtggcgcggcccgcgg

SEQ ID NO: 709163 - DNA, 148 bp, Homo sapiens
gctatagtaccatctcccccgccaataaaaaagagaagaaaaaagagaaacccgctggcacctattctaaataaagctaagcatccgtttgcctgcctagctaaatagcattagcgatcccttgggaaatcctccccttgcaataaat

SEQ ID NO: 709164 - DNA, 288 bp, Homo sapiens
tactggtgtattcactcgccattgtctgcctcagtctcccgagtagctgggagtacaggcacccgccccacgcccggctaattttgtagtttttttttagtagaggtgggatttcaccatattggccaggctggtctcgaactcctggcctcaagtgatccgcccacctcggcctccaaaagtgctgggattacagacatgagccaccgcacctggcctccattttgtttttctttaacattgattgctttggctatgtgggatctttggcgagtgaaattacggcca

SEQ ID NO: 709165 - DNA, 262 bp, Homo sapiens
ccctttgcattgcctactctctgcctgctccttgtactagctcggccatcttgcgctcgtcctccacctgcagcacgatttccttcagcttctatgtattactagcttcagcgacttggtggccgcctgtttctctctggcctcctagactacgacctgctacctctagctatgcaatctagacctccagcgcagcgatggtaggattagaacttggacttgacggccccctccatctcgtggagacctgctccggaagcta

SEQ ID NO: 709166 - DNA, 405 bp, Homo sapiens
cacagcgttcgtctttctctttgccattaagaaaaaatttcccagttggaaacagaaatgagacagagcaaaaactaaatacaaaagaaaagataaaacaataaaaccgaaccaaataacaacctctccccactaaataaacccaaacaaaataaaacaaaacagagctctataattccactcttaacagtctcttcctttctggcactggtcaaccccctaaccccacaaagaggagattccctccttcgggggctcaccaagttgccctatcgtcagaatgggcagttccttttaccctatgatagatccagccccgttcgctggggccttgctcaggcttctatggtgagaccccctaatcctctcctcctagttgggcatctgcctgtgggacgagggaca

SEQ ID NO: 709167 - DNA, 165 bp, Homo sapiens
agtaggagcacacgttctcatccctctcccccaaggaggggattatccaagtattgtttgagctaggaccaagtaattttcctgagtctcccacacacaccagatgtctagaagctttagtacgccctttcactaggagaaagctaagatgccaaatgagcacta

SEQ ID NO: 709168 - DNA, 1463 bp, Homo sapiens
  misc_feature (1279)..(1279): n is a, c, g, or t
gctccagtcaaccgttacacaccggaccgtacacactctgtcgaaatgcaccactgacagctttgacgtgacacgctcttcctggggaccaactgtgggcttcaactgtcaacgacactgtgtcatgtcacacggactgtctcgctcgtgggcaaccgttgctggtgaccacgcacacacaactgaccccacccacactggaacgcagctgcgccattcccatggcttcacgggtgacttactccctgacacccactccagggccaacactacatgcggccgtgcttactcgcccccctgagaccttcggacttagggcccaccacccgtgccttcaccaactttggcctcggcaaaagatatatggcttgaccgactggaccgggacaacacgacttcggactccgccggatcccttgagatacacaatacatggcctcgggcaaacgcaattggggcacccccatacaccactctccactatggaaacatggtccatggagatcggaactgcattggcaccacataaggattaggacatccattggtgctcccccatagcggaacaagcccagcaagtggattgtcggcttatgaatgacaggcactgacatcccacccaccctcaacgccacacctaacgggcagctccaggcaccccagggcatggctcacccggtcgcattcctggcagaaaccacgaacacgggacctgccgcagacggcccacctggtcccactcaacagcaggcaacaactgcagaccacacccgcacagcggacaacggacatggcgaaccgccactggggccacgcgcggcgccaaccccgaaaacgagacaccatgaaccccaacgcaacgaccacggccactcccgcgcacaagcgcgccccaccaccgcgtgcaacgactactgtatcattaccacccatcaaccacatcccagcgcggacccaacaacaacaacaccatgccaacacaaccatccaccgaccggagcgcggggaaccccgacacacacgggcgccagctacccagaaaaaacatggggcaccggggcacacacaccaccaccggcggcaccccccatccagacacacagcctaccaccagcgaccgacgcacacacgagcggaccacggggagcatcacacgtggacgaccacaccactagggacgcactccgcagcacccacaacacccgcccctcaccgcacaaccacgcgcccccaccggcaacgacaaacccggcttcacacaggcagcacgcacccaccnacacgtcacgacacacacacacacctacaaacacacgccccagatccagccacgacacgacagacacaacgcgacacaccaccgaccccccccaccctcccaccccacccggtcagcaccgcgggccacacacaccagtgacccgcccatcgtagcactcggccacgcaccacaagatgagaac

SEQ ID NO: 709169 - DNA, 786 bp, Homo sapiens
cccgtttccccggattcgtcgcccccccgccggtatttttaaaacgatttgaaaaaataggagtccttgtcgtgggacaacccacgttgcacaccccgaaggatctacacttgagagagggacctttgcataagaccgtttcaccctcgcacgacaagtgtgcccacacctgcgttcacagcccgtaactggaagaggagcacagcagtgtgctccaaaggggaggattccccggcaccgaggatcttgatgcgaggagcttcttctgaggagctcttggccccatgtttgtcgaccagtctgctgctggagaaagaagaggaccagaggtttgaagatccagcttccagccatggttgtctgaagactccggagccatttaccggatttaacttcccctcccctcctatcgttcctccagactctagtgtctctttctcacccctattgacccgtgatgaaaacatctgtaactactagccccccgagtgacctgatgagggagccactgcagctgtcagaggcgaccaggaacgtgtctaggcgcacgactataagcacctggaaaggctgatcccgagttcacagggaagaggaagttgcctctgagctccctctctctgcgctgctagacctggtggacatttgagccgcctgacctgtggggagggggtctctcccgaagagtttctgtttttactccaaataatgttatttctcagatgcttgatgccctgttggaaaagtgattaatttaatcatgccgattaaccctttaaatgtcca

SEQ ID NO: 709170 - DNA, 929 bp, Homo sapiens
gccgcccttttttttcttttttcgtggtgattggcgaacataggttcagcaaaaatatttgggagaataaaaatcgagaaactcgggtaaagaaaagccacagtgaacaaacagtatacaaagttatcccccaaatgtggataagaacctagcgagttcaaaagataggcccaggtgagaagtaggcccaacccggccaggcctcgaaagtgctccgcgttaaactacacgtagaaaggtggacgtgtaatgggcattcacattcaaatccatgaggagaaaaaactacgggaggaaatcttagcaacaccatggctgccaccacctgcagggccagtttctcactaggatggaacaagaagcgtctctgaggaacaattcacattagtacaaaaaacagtgatacagccattcccaagagagcagagtaaggatcacaagggcagtcccgaggaatccagggtacagcctcacaggggccctcacccagcctctcccgagagggcgacggcgctgagagccagaacagggggcaacagctgaagacgagtatatagcgaccctggggacaaagcctagcgcaacacattcaacaggagcattaaacaacttcccatatgccactaacactttaccctataacactaccacgtgggctgcggaacccctggaaacatccggaagaaaatccaacgcgatgcgcaggaacccgctcgagcgagacgagcgcatcgcgagacccaggaacggctggaacctggggacccccaaaaaggggccaaccaggatgcaaaacgccagcgagcacgcagctacggactggcctcagggaatgtagacacagccgacattcaccaagaaggccagaacaaaaaggtacccagggagcacaaaacgggccccccgaggccaagcagacacacactacc

SEQ ID NO: 709171 - DNA, 681 bp, Homo sapiens
ggacggagcagaaggcggcgcgcggaggtgaagttgctgctgatgggtgctggggagtcagggaagagcaccatcgtcaagcagatgacgatcatccacgaggatggctactccgaggaggaatgccggcagataccggagaggtggtctacagcaagaaccatccagtccatcatggggcatggtcgaaagcccatgggcaaaccctgcagatcgacttggccgagcccctacacagagcggacaggacgcacagggccagctatcaggacacatggtcactgcaaccgaccagaaggaagcaaaggcacgtgcaacacactggatgcaccctgtcacgggcggtcacaatccaggagaggcctcataggggacctgacccaaatgggtggtggcaacgagcacatggcactaaagggacccgattcacacaggggcagtacacccaagctcaaccgacgtcaagcggactaaaatacctggaaaggacgcagggaggcagtactagggcaccaagcagcgtgcaaaaacgtcccacccaaaacagggaacagaactggagcaaaagggaaaaccgcccgtagagagacccacagaggacaatcgaggacgaaccacgtcacacccatatcaagagaaccctaacagtaacaacggcaaggctggcaatggtgactggac

SEQ ID NO: 709172 - DNA, 140 bp, Homo sapiens
tgaacaacagacattagagttgagaatgatatggacatagctcagaaatgccagaatgctggcacatggcaattgactgtgaatcctcactatgagactccccaatgataacatgtccctgctgatgccttgacttttag

SEQ ID NO: 709173 - DNA, 286 bp, Homo sapiens
  misc_feature (1)..(1): n is a, c, g, or t
ntaataatccacattaaaaaaaagttctttctatacctatgtgtttatttgctgctttatgttttcgttatagttgtgatgtgttattttttttaatgggatgccaaccattataaattttatctttttttttttaagtttttttaatactttaagttctgggatacatgtgcagaacatgctggttggttacataggtatacaaatgccatgttggttggctgcacccatcacctcgtcatttacattaagtatttctcctaatgctatccccgcagcccctcac

SEQ ID NO: 709174 - DNA, 703 bp, Homo sapiens
cctcagcctcctgagtagctgggattacaggtgtgcaccaccacacccagctaattttttgtatttttagtggagagggggtgtcaccatgttggccagggtgatcttgaacttctgaccttgtgatccacccaccttggtctcccaaagtgctgggattacaggtgtgagccactgcgcccagcctgtccattttttaatcaggttatgggtttttgctatgaatgttgagttccttatatattctggttatgaatcccttgttagatggtgtgttaggccattcttgtgttgctataaagaaaatcctgagtccgggtaatttataaagaaaaaaggtgtaaatggctcatagttctgcagactgtacaggaagcatggaccaggcattgcttggcttctggggaggcctcaaggaactttcactcatagcagaaagcaaagcaggagcaggcacatcacatggcaagagagcaagagaagagaggtggaggagatgcacacactgttttaaaccaagccagatctctcaggaactcatggtgttagaaaaggaattacaaagaaatcaacagaggtgtgtaagcagaaatcagttggtacgtaagaaaacccaattccctgagaaagagaagagtggagtccttaaaattaaatggcggttctggtggtaagagtggtagtatcctccttccaggttgta

SEQ ID NO: 709175 - DNA, 972 bp, Homo sapiens
agcgggagagcgtcatcgtccccgactgtggagaagtgtccggggtagccccgttacaggaatgtgtttctgatcatctgaatcttaatcatgtccaagctgcctgcaaagattgtgcctgaagagattgacaagcactgcgtcttctatgttcaaggattgagtgccaacagttaacgaagtaacataggacagttatttcgggaactgtggccaatgatccaagattgcataaggccgaagttgtcatatacaggacattggcttaagtgactcctctatggatgtatggaatctcacctggctttcgggatcagtcttattcggatggagcagagtggagacttgtttcatcgtagggtctggtgaaggcagtatagagagtgatccctgtggcaggtgtctgcgtagcttcactgtgccataggcaggtagcttgatgcaagcgtcagttctactggagacgaaaatctctggctgtcgcaaattcagagtatcaacgtccgatggtctatctcccaaccagtgcatggagcgcataggcgagctgacaggtacacttaaggccatgtacaggagtatcatggccatgggaccatacgctcgagaatcaagcaaggcgtgaagtacaaaggctgcgagctagcttagagctgggtcgtggccacacatttcggcggaccacttgagcagtaaaaattggcaagtttttcgcaataccctattgggcacaagggatcatcgaggctatcattccagttcgtaagacacgccgtggggccgtttctgccggaaacactttatgcgttttccatacatgtgaacctcacaacaagccacacggggctttgtcaatctctgacacttcaacaaataggtgtttcagaggggccccccgaattcattgttccctggaagggttcacccccctttttataaacagaacactgtctccggatagggcgttttcaa

SEQ ID NO: 709176 - DNA, 470 bp, Homo sapiens
  misc_feature (431)..(431): n is a, c, g, or t
cttgtcggccgcccgggcaggtactatgagattggtttgctagagaactatgctattgtatttatctgtggttttcaaacaaggctcctaaatagaaacaatctaatagaattatcaacattttctaattccatcttcctagttaggggaaaaagaagagcttgaggagggataaaaggtaggaaaaaggttttttaagccacctcttagtaaccatgttatggaaacagagcccaaactagtatagttctataatctagatttcttggtctgtaaatcccaggatttgttctattaaaaagagcaaattcttagcaattgtcattatccattgcattggtcactagctgaggactaccactcaaagaaattcacaaaataattttctaacaaatagaaaaaaaaaatttagaaccctagtaagaagattnttttttttggagacagagtctcactgcatcacccaggct

SEQ ID NO: 709177 - DNA, 1040 bp, Homo sapiens
aggaggtccgtggtagcgttctcctcactaagctgcctgcgcacacagtgggggatgtgaaatgtgacatggaggtgagctgcccagatggctatacctgctgccgtctgcccagatggctatacctgctgccagaggagaggtatagcatctaagcgggggctggggctggcaaccaggctgtgtgctgagaggaccacatacactgctgtcccgcggggtctacgtgtgacacagcagaagggtacctgtgaacaggggcccaccaaccaggtgaccaggatggagaaggacaaccaacgacatcacacatcagacatgaacagacccacaagccatcgaagagagatgtccacgtgatgataatgtacagacagacatgaagcactcatcgcgaatacatgctggacacaatcacgatctgggaaacgaggaggatgatgataccaaaacaaaccaggacgctgtcccgacaagctccggaacaccgagcacagcgtgaccccgcaggggcaaaacgtgatgtacgaatgagcgggaacgagtcagacagaaggaaagcgaagatccgagcgcgggagctggacacaacgagtcccccggccgcacggccctcacacatcaacaaaccgagaacacaacgagagagagccagcaacacaaaacgcacaccgcaggggacacaaatgagaccccaacactgagaagggaagaagcgcaagggcacgagagaacaacgaagaggagagagcacagaccagagaagacgaagcgaccaaagaaacaaaaaggcaaaagcaaggcgaaggacagaaggagggagagagaaacaacaaggagacaaaaaggagagaaaagcgagcaagaggagaagacgacgagcaagaaaaaggcagcacagaaaggagaagaagaaccaacaggaagagagaaacagagagaaggagaacacagaacaacgagagaaacacgacgcaagaaacaacggagacagcacgaccgagcgccgagagaggacgcgcacacagaacgaacaacaa

SEQ ID NO: 709178 - DNA, 326 bp, Homo sapiens
  misc_feature (156)..(156): n is a, c, g, or t
cgggggcgctcgaccaatcctcctagggaccaaataaggtgggtagaattcaagggaaaattcctcataaggtggtcccaaggatgatggaattgttgaggtggttaataatattaatgtttgtgtaatccggctaatgaggattaagggcgaaanggggcctgcggggtaatttccgatgtttgaaagccctgaagactaagttcggactcccccttcggcaaaggtcgaaagggggttcgggttggtctctgctagtgtgggagataaatcatattatggccaagggtcatgatggcaggagtaatcagaggtgttcgtcgacg

SEQ ID NO: 709179 - DNA, 236 bp, Homo sapiens
  misc_feature (90)..(90): n is a, c, g, or t
  misc_feature (189)..(189): n is a, c, g, or t
cctacaaaaaccttattcaagaccacatttctgacctcgttttctactactctctccctctctcacagcactgcacctacgctgatcttngcgttgttcttcaaatacaacaaacacatcctctagatcgagagtctacacttgctgttcacatggcacagaattatctacccccccaaccccacattngtcctggctgatgtcctcaagtctctgatcagatgtaatcgaccgat

SEQ ID NO: 709180 - DNA, 435 bp, Homo sapiens
  misc_feature (351)..(351): n is a, c, g, or t
  misc_feature (429)..(429): n is a, c, g, or t
aattcggcacaaggcagggtcaggcaaaaaaagccatatttttcttcttgcagagagcctataaaaggacatgcaagtagggaggatatcgctaaattcttttcctagcaagcaatattaatattaataccctgggaaaggaatgcattcctggggagaggtctataaacagctgctctgggaatgtctgtcttacgtggttgagataaggactgagatacgccctgatctcctgcagtaccctcaggcttactacggtggggaaaaactccaccctgggtgaatttgtggtcagacgtttccctatttttttgtttcaagatgtttattcaagataatacgtggcaccgntgaacatgggacccttattcagttagtttctgtgtttggccttttctcctgtttcccttcaggaaggcaagtggatcntttgtt

SEQ ID NO: 709181 - DNA, 1115 bp, Homo sapiens
ggacgaccggggctttgagtcagcaccccagggccgccccccgctgcatcctcgcagatccgtgctttatcccctttgcttctctcccgtactgggtcgagtcctgtcctgcgctcgtctgcctgtctggtttgcatgttgtgcggccgagcgcggcatggggccattataccctttggcgtgggccggttggagccccgcgtgagctgccgcggggtcgagacgcgatggcctgggtaagccgagcgacttggggtgctgggttcggggatgcggtgtgcgcagtaccgtacatggtagaaatgtttaccaagccctagagaagtcgcagagatagcagaatgtaccacataacctagattgcaatgataccgcctggataccgcacggccctgcaaccgcccatcaactcacatacacggacggaatctatcccacaggcaggcgtcgcttagcaagagcgagtctccgacgaccgggaagtacgcacctcgatgtattcaccttattgtctttcaaagatccgtaattgtgagataccaggaggatattcccggggggattggattgcaaaggcgaaaagtcacgacattgtccaggaattggaacacacatcagctcgcgtgcattcgcactgtgacagtgttccaagcaccgggatgagggcacttgtgtattacccgtggtgcctctggcatggtgtcaccgttcacagcgacttgaaagtgccacccaaaacagccacggtcagataagtgtgagatgccgcccattccacaagttacccactgtaaaaggcccccatcgtggtgtcccaagtcaggagcgtgggtattgctggccactttcccccaagtgccacaccaagaccgttgttataaaatcctaccccctattaggcacccgatgtcacacttgaaagcaaagtgatatccccaacacaggaggcgacacttgagggagagaggaaccttccaaaagtggttcccttcgacaattatccgtttttcctcaaaccccattaatactgggcgtggattcgccacatggctagcaacccagagtgcgaatgcacaattttcttggggaacgacccactggaatgacatcacaaa

SEQ ID NO: 709182 - DNA, 470 bp, Homo sapiens
cggacaagctgaggtccgcgactcgtcgctaagattccgcaaaactgagatttcaattgaaagattcaccctttccgctttctttggcgcccttcaaccgtgaaggaaatgaaggttgagaacctggaacccgcttccaaagaccaagccctttctctgtgcctcacaacgtctgcgctgtagctgtttatacccttttctctgggaggagattgaggtctgaagtgagtgacttgctgacgtccttacaagaatggcgacctggattaaggcatgcctctctccagcgtggactgctcctcctggggtgactgatgcccgcaggacgcgacgtctctggccgcaatcggctcctcccgcgactggcaaggggactgcggcagaggatcgcgcggcgcggtggacggggcgagcgactggtcgcccccggcgcgctgtgattggcggcgtcggggcgtccgattggcgtc

SEQ ID NO: 709183 - DNA, 131 bp, Homo sapiens
aggaacagatgtagggtgaaaaatggatgttgcattagctctgggtatgtaggccgttcttcaccctacatgaatccaaaggaacagatgtggcatcttttgtaaaacctgattcttggagactaaaaaag

SEQ ID NO: 709184 - DNA, 354 bp, Homo sapiens
gaaggcgtaacgttatttcacattgcatacctgtatcacaacatctcatgcactccataaatatatacacctaggtgtacccacaattttaaaactgtaaaaatagtaattttagcttatactaaagcataacattgaaagagcaaagcaaactggaaagctcatttgtatttattataacatgtatcaattcactaaaatctctatggaccagtaaaacataagaatgccacatagcagatgggttaccacttctctttaaaagagaaataaattgcagcttctcactaaggaatagctaatctaaaaacaacatcttcacgtgccaggcacggtgggctcatgccctgttaa

SEQ ID NO: 709185 - DNA, 451 bp, Homo sapiens
acagaaccttaaaccaaaaactctaacacatactggttaagttagaaaaattataggctgggcgtggtggctcacgccatgtaatctcagcactttgggaggccgaggagggtggattgcctgaggtcaggagtgtgagaccagcctggccaacatggcgaaacgctatctctactaaagatacaaaaattagctgggtgtggtggcccacgcctgtagtcccagctactcaggaggctgaggcacgagaatcacttaagcctgggaggcagagattgtagtgagctgagatcgcgccactgcactctagcctgggcaacagagcaagactccatctcaaaaaaaaaacaagaaaattaaaatttggagactaaaatatctatgtcaatctagatccaaatggtaaaatacctctccaatacgatcacctgaaacaccaggaaagccttta

SEQ ID NO: 709186 - DNA, 1314 bp, Homo sapiens
tgggggtttggggaaagaaatttaaacctctttttttaaaaaaaaaaaaatttttgcaaagaaaaaaaaattattgtgtgttgtgtgagaaaaatagagaaatattcggaggggggtaaaaaaaaatttcataaagcccccaaatttggtgctaaaaacgagagggtacgcttgtgtgtagaaaaatgctgtgggagacaaagaatatattcgctggtcacttcgcggggtgtttctcacagatattctctcaaaggacgtgtgaaggagtagaaccaccacaagaggttttaacaaaatctctaaaaataaaaaataagaaggaggaccacccgagaaaagaagtgcaggggggtgtgggcgcggcgcgcccggggagggagagacaccccccaaaacaagggggcgcccccacgggggggggtggtgagagccccccccccgcccctcctcgcagaaaaacccacaggggggtatcaaaaaacgtgttctctcacgtgtgtggaccccggtgacccatagtgagtgggaggaagagtgtggatctgtctatgataaaagtgacgccataaaagagtctccacagaaaaattctttggttttctccccacctctcacaaattaccagggggggagggctattatgtggtgctcccccccgcggggggggccgagcaagacacaaaaagtgggggggggaaagacacccctcagacagcattatatagggggggacccacgtgtggagaacgccccccagtgtgaagcgaggggggagcgccccaacctttgtggagagaacaaaacggacgccgcctcaattaggggccccctctgtaagaccttcggtggcccagagaagtatatgtacacaaaagggggcagcaacaataaggggtgcataagaagggccgcccacacctattgggtggcgaaaaaaacacccgaagaaagacgcacccctcccagtggggggggggcccaacacaaaggggggacaaccagagggtttcttaccaccccgcaaaaagacaaatagaaaaggagcccccaggtagaaactagcggcagacacacgtgggcacaaaaattaagaaacagggcgaacccgaatcccccttggtgggaaaacggggaaaacacccgcgggggggggggcgaaacagcaaccccctgggcacacggcggggaagagaaattctcccacccccccgacaaagagggggggggagaaacatcacccccccactgtgtagagaacacacgataacccccagaaaaaagacattctcccagagaaaaggatgtcgacac

SEQ ID NO: 709187 - DNA, 333 bp, Homo sapiens
ctgggatgtggctaggacagcgatgggcgttcccaggtctatcaaaccaggatatgctcctgcatttacgtgctctcggatctcagagccagatgtgaccaccccaaccccaacttaccctgtctactgtagagtcttgagagttcctaggatgggcagctagaagtgggccccacaagagaaaccactatcctcccctccgaaacctaggatgggcgattgctccagggaatttaacaagattgagcactccggctgattatcgagtttacccagggcgtgcttcatgctgggagaaactgcaagaaccgaggttcgtacaagagtggcatc

SEQ ID NO: 709188 - DNA, 280 bp, Homo sapiens
cacgagggatattattaattgtctttcattcatcgtattattcatttgttcttccagaaagaaaatgattggggattttccaattttatggcctggagtgaactgaccgatcctgataaaggatttatatatgatgacaaagttacctttgaagtctttgtccaggcggatgctccccatggagttgcgtgggattcaaagaaccacacaggctacgtctgcttaaagaatcacggagcgacttgttacatgaacagcctgctacatacgttatttttca

SEQ ID NO: 709189 - DNA, 1102 bp, Homo sapiens
  misc_feature (296)..(297): n is a, c, g, or t
  misc_feature (300)..(302): n is a, c, g, or t
  misc_feature (308)..(308): n is a, c, g, or t
  misc_feature (313)..(313): n is a, c, g, or t
  misc_feature (316)..(316): n is a, c, g, or t
  misc_feature (342)..(342): n is a, c, g, or t
  misc_feature (352)..(352): n is a, c, g, or t
  misc_feature (374)..(374): n is a, c, g, or t
  misc_feature (383)..(383): n is a, c, g, or t
  misc_feature (386)..(386): n is a, c, g, or t
  misc_feature (389)..(390): n is a, c, g, or t
  misc_feature (393)..(393): n is a, c, g, or t
tgacaccccagcaccctcaggctagtggaggctctggtgttaatcggcactgaggcaacatggctggctcagcaaaaaagaatgaataagaacggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacggnntgnnngtggancccantancgaccggagccgtcttcccaaatcgncaccctacantgcttttctaggaaacctaccnatgatgtanagnagnntcnattcacggaattctttcgaggattaaatatcagtgcagtgcgtttaccacgtgaacccagcaatccagcagaggttgaacggtacacggttcatgctgaataagaggacctggattccctgctcagtgccctgagtctcaatgaagagtctctaggtaacacggagaattcgagtggacgttgctgatcaagcacaggatacagacagggatgctcgtccttatggccgtgatagaaatcgcggacttctgacaaccagatacagactggcgggctcgtcctgctacagacagcttgatgactacccacctagaagaggtgatgcatcgctatggagacacgttctccagatcgctatgcatccgcaccggtatcggcgatgctcacgggatgggatcgggactgcccccgccgggcaactggatcgacaagggagaccgagaacgcaaggaagaccgagggcacaaaaaacatgaaacagcgaaggcaacccggcaaaggacgagcacaagaagggacacttaggcacagcgggaactcgggggaagcgcacgacagacgcggacgcagagacacgccatagacgcccgccatacacacgcacacatcgcatctggtaaccacaacacaatccgccagacaacaaaaaggacagaagatacccaccaaaaccaaccgagaggaaagacagatgacaaagagcaggccc

SEQ ID NO: 709190 - DNA, 246 bp, Homo sapiens
gattatgcgccgccacatgccggctaatcttgtacttttagctagtgacagcctggccaacatggtgaagccccatctctactatgaatacaaacattagctgggtgtggtggctcatgcctctagtcccagtgtactcaggagtgcgaggacagagaattgcttaaacccaggaggcgggggtcgcagagatcgtgcccactgcacttcagccctgggctgcacaacagtgatactccatctcaa

SEQ ID NO: 709191 - DNA, 255 bp, Homo sapiens
aagtgatgccctgtaacattccacagatcatattatttgtatcagttgtcaaagttatatgtgatatcaatgaagaaatctctgtcgcatgtaatcggttatttctgtctcttaaaaagtatcgttagtgggctattaaacttggatctacctttttatcaatgcagtatgttctttctattcaagtatgaacttgtagagaaactatagtaatatgatcatcacgagatttatgtgctacttaaaatgtgaata

SEQ ID NO: 709192 - DNA, 324 bp, Homo sapiens
cacaatttaccctctctcttgttgatgaagatgaaggctggtttctacttttcttagttacttttaatgatgctacaatgtatgttcttgaacccatccccttgtgctcatcggagagtgctgagtgttgcccaagagaaaggcaacgggaaccacataggtaacgtccaggttaccagaagccactttaaaaagtgtgaaaaggctgggctcatggtggctcatgcctgtaatcccagtgctttaggaggccaaggtgggaggatcacttgaggccaggagttagagaccagcctgggcaacatagtgagagcccatctctac

SEQ ID NO: 709193 - DNA, 221 bp, Homo sapiens
gggccccccccccaaaggtttaggttaagaggcccccgggtttttttggggggttccctttccccccccaaggcccaaaggggttttgggttgccccccccccctggggttaggttttttttttttaggccccccccttttttcccttttttttttccccccccctgggggttttttgcccccccgggggtttttttttttttcccccatttggaagggga

SEQ ID NO: 709194 - DNA, 1088 bp, Homo sapiens
cggcggcctgagcccctgcccgagcctgggcggagctggagcgcctgcggatcctagaccctgctgcctggtgcccggtggctgggccggagcgggctggcgcctggatgcctggcccggggctgtggccggagactggcgccctgccccgaagcgactttcggtcccctgatccgctccgcctgacccctatgatgaagagggcagtccacgtggagaaggccccctggtaaggccagccagccggaggaccaccccgcagaccacaacgcccaaggcctggcaaccgagagggaggccccgatcagcagtgtgaaagcgacaccctgatgacactggctagttcaccttcactctggtcatcgtatacttgtacccctagggcagctcccgccttgagcccatatgacgcccaacctgcgaagcctctggctgcctcactggcccatcattaactacgtcgatggtgagcgcactggtgtacagccgagggggctccacttccgagcccctggagaggcccgtcctggtggagtacaccctgcctgcgagatggcagaacgcgagaccaagacctgtctgtgtgtacatggaaccattccactgcgcgtaactgtgatgccggacagatctgcatcttcatgtcgacggcatattgccaaaacacagagaaccccgcagggccgctaggggctccagacgagcaagagtagataaccaagagggaacaaatcatacaaagaaggacaagaagtactacacccatacaggcacgcatcatgaagaaagataagcacatacatggagacaagcataactgagagactacaatcacgaacagacacagccgcaagaatttggcaaaaaagaacagaccaaaaacagaacgcaaaaaagcaagtttagcacgatttaaaactacgacgaacacatgcagcaaacacgagacgagagacacagatcaaacggaacacgaccgcaaacgagagaagagtatgacacggatgtaagaacaaagctagggaccagagcgcacgagacacacagactcgcacgagccaccagagcaacacaagaaggattagaac

SEQ ID NO: 709195 - DNA, 108 bp, Homo sapiens
cgaagggaaacagggactatgggattgaaggggactactaatgaccagatatgaaacagaagacaaaattgtaagccagaggtcaaccaaattaactaaattaccccc

SEQ ID NO: 709196 - DNA, 592 bp, Homo sapiens
  misc_feature (14)..(14): n is a, c, g, or t
  misc_feature (68)..(68): n is a, c, g, or t
  misc_feature (90)..(90): n is a, c, g, or t
  misc_feature (122)..(122): n is a, c, g, or t
  misc_feature (124)..(124): n is a, c, g, or t
  misc_feature (163)..(163): n is a, c, g, or t
  misc_feature (202)..(202): n is a, c, g, or t
  misc_feature (256)..(256): n is a, c, g, or t
  misc_feature (290)..(290): n is a, c, g, or t
  misc_feature (424)..(424): n is a, c, g, or t
  misc_feature (426)..(426): n is a, c, g, or t
ttattccttgattnacccaacaaataccggatggtgagcacctgctggtggcactgttgttttagtgntgaccatagacagcataaatgnaaaagacaggaatttcccacctttgggggaantntccattttcctaaatgttaggttggtgcaaaaactaatngtggtttttgccatttttaatttttaatggcaaagccantattacttttgcaccaaccttaataggccgattcagaaacttgagtgcaatgtnttggatatgcaaaaaagaaaatcaaaacgcattnttcattctctataagagttctaggcggggcgtggtggctcacacttgtaatcccagcactttgggaggccaaggtgggcggatcatgaggtcaggagatcgagaccatcctgaccaacgtggtgaaaccccatntntactaaaaatagaaaaatcagctgggtgtggtgccgcgtgcctgtaatcccagctacttgggaggctgaggcataagaattgtttgagcctgggaggcagaggttgcagtgagccaagattgcgccactgtactccagcttgggcaacagagcaagactccatctc

SEQ ID NO: 709197 - DNA, 673 bp, Homo sapiens
gtgtagaaggtgcgatgtacacccgtcgcagtcggccacattatgtcagcatagggatcaactgaaagacgccgatgcctatcacatgctgattcaaataggccgccatcagacactcgccgggtgcatcaaagcggtttgccccggagtgccattcgttaatcagacgagtgaggaacctgaaaccctcgccaacggcttccttttccagcgccagtatctggcgcggaaggtgggtgatccgttgaacctcatatcgtttcattcatccctgcctccaatatgaaactcgttcaatgctaacaatttcgtttgaggtgacgaacactgcaaggtcactcctgtaggagcgagcttgctcgcgaaaaccccaaacgatcacgcagcgcctgaaggcaaaatccgattcccctgctgcaccttgctccattgcctacgcctgcgtcagaatccgccggcttgtgcgctgaggtggccgtctctaaggtggctcggtcgctgaatagttcagtgatcgggtttagtagcccaccttagacctaacaagtgcacacgcttcatccatcagacgctcccgtctgtgcttgatggtggctgtgcgtagggcgtcctcggacgcgccggttttgttaggtccaccggtctactaacctgcgtacagtaccgccttatt

SEQ ID NO: 709198 - DNA, 792 bp, Homo sapiens
ttgagatgaccggtcgggctgggcgacctgctgctgacaatgtatgccgggtaaaactccgtagtgagcgctggtttggaatcagacaccgactaattgagtaaaaggggagacactgcgaaaggacaacacctgaggtagacatagatgaaaaaagagaagccaataatctgatacagagctgaagagatagcagaagaggaagaaactgtttatccccatacagctaagacgaatgttaaacatagagaaagcagagcgcttctgaagttgagcatgaattctcctaaaatgccgagaaataggcaacaaaagaaagaggagccagtctcaagaatgacgattctctcctaaagaccaaaaagtttgagaaagaaaaaggatgccctaagttgaccatggaagacgtggtttcttctaaaaccaagaaaagtgacaaaattaatgatggtagccttctgaggaagaaatagatgctcctaagcccaagaagatgaagaaggagaaggaagatgagatggagaaactagagagaaaagccccaaaagctgagagaatggatttcctcatcctgaagccggactgtaaccccaggtgagatgctggcagtgaagagagtaacagtgagatagagcaggatgatacctgtggaacaaaaagaaggcgctttctctaattgcccatatgtgaagaaatattaacttctcaaagggcggggagtgagcttctatttcctatacaggcaagagattcctgtgttacaggggaggctattgcgcagggcggggacgg

SEQ ID NO: 709199 - DNA, 996 bp, Homo sapiens
ggctccttggagagacatagcctcttaagttggagcgggactgccggagcccagatgggacccctgggtctgctgccagccccgtaactgctcacttgcttgcctgtgtcactgtcaggatttgtctagctgagtgcacttccctagacagggggtgtgttggggggcagctcctcttttcgcaatcgtgtcgaaattggtctatcaaagtgttctgtatgcttgcatcttctgtgcgatccataggcgatatatgagaagaaacaggaccaagaagtagctggcgcttttttggaagcgaatacaaatcgacttttataggagattgagatattgctggagagtgatagacaacaaggaggtgggtctgagacgatgagatgtgcctggaggagaactcatcctcagcatgggtattccttttggcctccccagatcttgcaatgaggacgtcagctagctgtggggatcatgactctattcttctctgtccacaagaaagagaatattatttattccttccttgtgtttggctcctcctccatgactcaatagggatctggacgaaggctgacgcaaggtggagaagagctgaggcgcaaataagaggggcagtgaagatgtgggcaccgccctgaagccgacgagaagaatgaaagaagaagtgagagtcatccgcagaagagtcggctgcagattagcatgcaggctgccgcaggggaaggccgcggtaggaaggcaagaaactgcggaaaggagaagagcctgtgagaagacggaggatcccaggccctattaagcctcaatcctccacttgcccgaagtgggagtctgacgcatcttcaagttctccagcccatcaagagtcttgcttaaccggccccgggccgcgactgcgccgcggggacgcacgggccccgaacccacgggcactcacccagcacaggcaaccctggcacgccacaacacggcggcaatgctccgacataaagggtc

SEQ ID NO: 709200 - DNA, 364 bp, Homo sapiens
tgcaggaattggcacgaggaaaacgattaggatattccttagcgaactaaaagtaaatctaccattccatccagcaatctcactactaggtatccacccaaaggaaaagtgattatatgaaaaagacacatgcacatgcatgcttatagtagcacaattcacaattgtaaaggtacggaaccaacctaactgcccattgaccaatgagtggataaagaaaatgtggcatatatacacaatggaatactactcagtcataggaatgaaataatgtcttttgccgcaacttggatggagctggaggccattattctaagtgaagtaactcaagaatagctacatacagagtgatattgagctttgg

SEQ ID NO: 709201 - DNA, 438 bp, Homo sapiens
  misc_feature (4)..(4): n is a, c, g, or t
  misc_feature (51)..(51): n is a, c, g, or t
  misc_feature (67)..(68): n is a, c, g, or t
  misc_feature (271)..(271): n is a, c, g, or t
ccanaggggtttccattttgggggaacattagccaccacaggaacaacagngttttcagaagaattnntgggtgaacggagcaaatcaaggtgcatcagtattataggataccaaacagatcctttttattaggaaataagaaatcagttaagtgttggctgggcgcggtggcttatgcctgtaatcccagcattttgggatgccaaggtgggcagaccatttgaggccaggagttctaaaccagtttggccaacatggcaaaaccccatntttactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaac

SEQ ID NO: 709202 - DNA, 884 bp, Homo sapiens
agcggagaaccccgcggggtctgagcagaccagcgtgcccattccagcgcccgcgtacccgcagcatgccgcgacccccgcctgcttggaccgacagctgtgcggagacagctgtctgcagacccccagacactacctcgtacgaccatggatatctgttccaaaaaaccccatgccacaactggtggtttatgcgacggagataacccaaagaagtgcgagggagatgtctaacacccatacgtacacaacatagcacgtagacttaaggtgctacgcagagcaaacaactgtagaaacgaaaaagatggtacgacgccaactgagacgcatggacagacatggcgcaaccaaatgcacaagcaacaccaagaaatcagaccagcacatccaacatagagcaagtagtgaaaccataccaagagagaaaaagcaagaaatagagatccacagggacgcttgggaacagaacaagaaaccgacagacagagcaaatggacaaaaacccatggaacaccccaaagcagcaaaatagaacgagtaaaccacccgggaaaacccagagtggaaacaaagcataagaagagaaaaagataaaaaacaaggagagaacgaccgcaagaaatagaacacccagaaatgaacaaagcaaatcaataaccattgaagcgcataacaagagagaaacataaaagccaaaaaaaagaacacaaaaaacaatacaaaaaaacatacaaaaagaaaaaaaaaaaaaaacacacaaacacagaaaagaagaaacaaactggaaaacaaaaaaacaagagaacacaagacacaacaaagaaagagaacaccaaagatgagaaacaacaaaaaaaaagagaaaagaaaaacccaaagaa

SEQ ID NO: 709203 - DNA, 481 bp, Homo sapiens
cacacatacttcgccttcctgtatatgctgctcaccgtctacagcatgcgtagacacacctgcacgatgcgctacatggaggatgatccggtgaaccggaccctcttcatcaagggaatctccaaatatgcggagtcatataagaccatgatgcattttgaggaagcctaccccaactgcacagttctcgaagcccgcccgtgttacaacgcggctcgcctaatgttcctcgatgcagagaggaagaaggccgatcggtgaaagctgtactttacaaacctccagagcaaggagaacgtgcctaccatgatcaaccccaagccctgtggccacctctgctgctgtgtggagcgaggctgtgagcaggtggaggccattgagtactacacaaagctggagcagaagctgaaggaagactacaagcgggagaaggagaaggtgaatgagaagcctcttggcatggcctttgtcaccttccaca

SEQ ID NO: 709204 - DNA, 1450 bp, Homo sapiens
  misc_feature (299)..(299): n is a, c, g, or t
  misc_feature (308)..(308): n is a, c, g, or t
  misc_feature (322)..(323): n is a, c, g, or t
  misc_feature (332)..(333): n is a, c, g, or t
  misc_feature (336)..(336): n is a, c, g, or t
  misc_feature (357)..(357): n is a, c, g, or t
  misc_feature (363)..(363): n is a, c, g, or t
  misc_feature (368)..(368): n is a, c, g, or t
  misc_feature (487)..(487): n is a, c, g, or t
  misc_feature (500)..(500): n is a, c, g, or t
  misc_feature (749)..(752): n is a, c, g, or t
  misc_feature (754)..(754): n is a, c, g, or t
  misc_feature (756)..(756): n is a, c, g, or t
  misc_feature (759)..(759): n is a, c, g, or t
  misc_feature (765)..(765): n is a, c, g, or t
  misc_feature (778)..(779): n is a, c, g, or t
  misc_feature (781)..(781): n is a, c, g, or t
aacgagcagcaaacgcagcctcgtctcagtggccaaatgaagtagagatgatgaccactaggtctctgatcacaattgcacatgtacgtaaactgaggaacatcggcagtgggcaaagacgtcatagcagaccaagacaaagctgcggtcgagaagcaatcgtgatcagtcgagatgcgcaggctcgaccgccatgtggcatcaggtacctcagcgctatgacaccggacctccagacacactacagtgcaaacaggtggccacatggcagcagctggaactcaagaaggcctgtcctncagggctcnacgagatcgagtcnncgcgaggcnncancgcttcacctcagcgcactgncgatgntgcangagtccacggagcttggggcaagcagtgattgaatcaaaacacccaagacctcccgcatgccaatcatcaatgtggcccccttggacgtgggtgccccagaccaggaattgggcttagnagttggccctgtntgcttcctgtaaacttccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcacccttaccaaaaaaaaaannnnananaangattanttaattttttttnnanaaggaagctgggccccctggcttgaaaacccatgcgggggtaggtcccttttggcccgtggggtttttgaaaccccaatggcgtgccctttcgagctccttttctcaaaacccccctgggggccttcccctccactccttcccaaattctggtctccccagaagacacagggaaacattgtttggtctgcccagcaaatcaagggcaatgctcaaacacccatgggggccccaacccttcagcccgtccgtgcccgccaaagaaccccaaggccctgggggacatggggctcgcttcagagttgccaaaaaaagccttgtgccaaatcagggggcctcccaaggggctctgttgaaaacattgtcccctacggtgatatggaggggggtcaatgccggggggaagccaccaaggccccatcaacggggattccagaaggagcagccagcaaggggcccacggctacgaaataaccgccgagaaaccaccggttgggcggaaccgcgtgtcaaatacccttggttgcccgcaagggacggggaccggcgcagagcatggtgctgtacttggtgttactggtgtgcgcggaaaaaataccccggcctggtcctggaggtgccccgcgacaaattgactgcggcgggaatgaagacagatgaaggaccccat

SEQ ID NO: 709205 - DNA, 178 bp, Homo sapiens
gactgcaatctgtgcctgactgcaatctgtgcctcgactgcagcctcccaagtagctgggactacaggcatgagccactgcacctggcctcccctccaccctaccctttttttttttctttttgtttgataaattaaataccgagtctggcaatgtggccagggcgtgtcttgatata

SEQ ID NO: 709206 - DNA, 1504 bp, Homo sapiens
  misc_feature (299)..(299): n is a, c, g, or t
  misc_feature (308)..(308): n is a, c, g, or t
  misc_feature (322)..(323): n is a, c, g, or t
  misc_feature (332)..(333): n is a, c, g, or t
  misc_feature (336)..(336): n is a, c, g, or t
  misc_feature (357)..(357): n is a, c, g, or t
  misc_feature (363)..(363): n is a, c, g, or t
  misc_feature (368)..(368): n is a, c, g, or t
  misc_feature (487)..(487): n is a, c, g, or t
  misc_feature (500)..(500): n is a, c, g, or t
  misc_feature (803)..(806): n is a, c, g, or t
  misc_feature (808)..(808): n is a, c, g, or t
  misc_feature (810)..(810): n is a, c, g, or t
  misc_feature (813)..(813): n is a, c, g, or t
  misc_feature (819)..(819): n is a, c, g, or t
  misc_feature (832)..(833): n is a, c, g, or t
  misc_feature (835)..(835): n is a, c, g, or t
aacgagcagcaaacgcagcctcgtctcagtggccaaatgaagtagagatgatgaccactaggtctctgatcacaattgcacatgtacgtaaactgaggaacatcggcagtgggcaaagacgtcatagcagaccaagacaaagctgcggtcgagaagcaatcgtgatcagtcgagatgcgcaggctcgaccgccatgtggcatcaggtacctcagcgctatgacaccggacctccagacacactacagtgcaaacaggtggccacatggcagcagctggaactcaagaaggcctgtcctncagggctcnacgagatcgagtcnncgcgaggcnncancgcttcacctcagcgcactgncgatgntgcangagtccacggagcttggggcaagcagtgattgaatcaaaacacccaagacctcccgcatgccaatcatcaatgtggcccccttggacgtgggtgccccagaccaggaattgggcttagnagttggccctgtntgcttcctgtaaacttccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttggtcatgttcggttggtcaaagataaaaactaagtttgagagatgaatgcaaagatctttgaccaaccgaacatgaccaaaaaccaaaagtgcattcacccttaccaaaaaaaaaannnnananaangattanttaattttttttnnanaaggaagctgggccccctggcttgaaaacccatgcgggggtaggtcccttttggcccgtggggtttttgaaaccccaatggcgtgccctttcgagctccttttctcaaaacccccctgggggccttcccctccactccttcccaaattctggtctccccagaagacacagggaaacattgtttggtctgcccagcaaatcaagggcaatgctcaaacacccatgggggccccaacccttcagcccgtccgtgcccgccaaagaaccccaaggccctgggggacatggggctcgcttcagagttgccaaaaaaagccttgtgccaaatcagggggcctcccaaggggctctgttgaaaacattgtcccctacggtgatatggaggggggtcaatgccggggggaagccaccaaggccccatcaacggggattccagaaggagcagccagcaaggggcccacggctacgaaataaccgccgagaaaccaccggttgggcggaaccgcgtgtcaaatacccttggttgcccgcaagggacggggaccggcgcagagcatggtgctgtacttggtgttactggtgtgcgcggaaaaaataccccggcctggtcctggaggtgccccgcgacaaattgactgcggcgggaatgaagacagatgaaggaccccat

SEQ ID NO: 709207 - DNA, 403 bp, Homo sapiens
  misc_feature (393)..(393): n is a, c, g, or t
tgtcttctatgccccccaaccttactccaaattaatgaggcattattttatttatttatttttttgagacagagtcttgctctgtcgtccaggctggagtgcagtggcaaatcttggctcactgctacctccgcctccagggttcaagcaattattccgcctcagcctctcgagtagctgagactgcaggcgcgtgctaccacacccagctagtttttttttattttcaatagagaccgggtttcaccatattggccagggctggactcaaactcctgacttcgtaatccacctgcctcagcctcccaaagtgctagggattacaggcgtgcaaccttggcacccggccttaattgagggcatttatttgctttaaaaatttcacatccaagntggggcatgg

SEQ ID NO: 709208 - DNA, 422 bp, Homo sapiens
tctctgcggtcatacaagagctacgggacaacagaacaagagagatatcaataatgacgaggggcgtaagagcaaggaagacatagaacgtatggttccatgaagctgagaagtacaaagctgacgatgagaagcagtagggacgaggtgtcatccaagaagtcacttcagtcctagtgccttcaacatgaaagcaactgttgaagatgagaaacttcaaggcaagattaacgataaggacaaacagaagattctggacaagtgtaatgaaattatcaactggcttgataagaatcagactgcagagaaggaagaatttgaacatcaacagaaggagctggagaaagtttgccagcccatcatcaccaagctgtaccagagtgcaggaggcatgccaggaggaatgcccgggggtaggaggt

SEQ ID NO: 709209 - DNA, 152 bp, Homo sapiens
aaaaactctaatccagactacagttgtcgagattcaagtcgtgagtgcaggagcgtacacagtgccgtgctggcacatgcactgcacacgctctagagacgctgacctggctctcggaaacgcaggagtctttctgagccagctcagaaacc

SEQ ID NO: 709210 - DNA, 288 bp, Homo sapiens
aaacgaaagccgtattatttaatatggacaccaagctctcgtccataaaagcactgcaagacagcagcgccatgacagacatactatttaattaattggcacggatcattagtaattagaacatttatcgtatgccaatgctgctgctaactctgaaaagttactcttaagcagggtacacatatcacctgaaccccgttgtgctactaatatagttacagagctcccttttttcatgggtgcacacgggtcagttctccttccaacttagcccgaaattatttagaa

SEQ ID NO: 709211 - DNA, 567 bp, Homo sapiens
  misc_feature (99)..(99): n is a, c, g, or t
  misc_feature (125)..(125): n is a, c, g, or t
  misc_feature (172)..(172): n is a, c, g, or t
ctaggaggaccccgagtacacttaaggagctatttcagaagagctgtaataaagttagaagtaacagcaaggaaaggtcctctgtattagaggctctgncaggtgttttctgtattatttagtcncctctaacagccactgtgtgagagagtgctgttattgcagcattttncagcagtccaaaaggcttggagaggtcaagttattgcctgtagtcacacagtaattggcagaactagaactcaccaaaatctgagttcacactccctgttctagactccattataatgcacatttctcctgcttctaagtctgaagggagaaccggggacagctgggaaccgagctctcatctcaccagactgcccagtgcctgtcacctgggggcctcagaagggtttataatcatcattttacttataaagggccctcatcagcataaagccaggccttcttgacatgaagatgtcctggctccaagcagcttccagtttaggtaggggttgggggccaagaagatacttaacgggtcattaagccggtaagatttgagaaagttctcccgga

SEQ ID NO: 709212 - DNA, 172 bp, Homo sapiens
aactgcgaccggggttcagcgctctggtgaggagctcgtcgcgtcgacaggttcgaggcgattcgagctccagctaggatgatcgaggttggttgcacgacgtcttgggaagaaggtcgcgttaaatgcaacacgatgataccatcgggaccgtaagaagctgagtcagccc

SEQ ID NO: 709213 - DNA, 249 bp, Homo sapiens
gattccaggatcttaccagctactcaggaggctaacgtgggatatagctagaggctaaagtgggagacaatctcttgagccaaggagctcgaggctacagtaaagcatgatcacgccacttcaatcttaccttgtgtgaacttgaacaagaccttgtctcgagaaaaaaattaaaaattctttttttaaaaaaaggtacacctatattatggcactttaccatgaaatagagcttgcagcgatgagaag

SEQ ID NO: 709214 - DNA, 105 bp, Homo sapiens
  misc_feature (8)..(8): n is a, c, g, or t
tatatttnctgctggatgagattctagactttggctacccacagaattccgagacaggtgcgctgaaaaccttgcatcgaagcggtgggtgatgcagtagtcggt

SEQ ID NO: 709215 - DNA, 445 bp, Homo sapiens
ggcgagtctgaatgaaaggatactaattatacactcaacccagattccttggactgggccttatatgaccacctaatggatttccttgccgaccgaggggtggacaacacttttgcagatgagctggtggagctcagcacagccctggagccccaggagtacattacttttcttgaagccctcaagagttttgtcaagagccagtagagcagacagatgctgaaagccatagtttcatggcaggctttggccagtgaacaaatcctactctgaagctaaacatgtgctttgaaatgattatcatcctaatatcatgggggaaaaaataccaaatttaaattaaatgttttgggttctcatttattatcatttttttctggacaaatttattatttttagatttttgtaaaacatgatagacataaaattggtttatttcccccca

SEQ ID NO: 709216 - DNA, 152 bp, Homo sapiens
tggtcctctgctagttaggaacattctcccatatcttggaaactcacttctccttctgggaccacacaagagacatgggagaatgttcctaaattagtgcagagcacagccacacccgttcccacgtcagaggagggcaaggctgggtactc

SEQ ID NO: 709217 - DNA, 462 bp, Homo sapiens
acagcagaaaagatatatctttacttcaagaataaagagtggcagataaggaggatagcaccaggagatatcagctgtgatggcttggaaaaacagtgtacaccggcagtgtaaacaagagcagggcatgtatcagtagttgagaacagtgaatacgagtgtgactagacggaagatagtagggatgacaagttttttggggcacagatctaagattggtctggtgtctggaatgagactggggccaataaaaaggagcgtctttacaggagctcaaatgggctgctattttgtagcattctgaggacagctctgacttctgagaagggaaagtggtaaaagtgttagtacagacctttacaaagttggaggctgagcttggtgaggtgtgtctttcaaagaccatcagtctgttctacttttcctgaagactgaagacagtaaaggatataaacatccccc

SEQ ID NO: 709218 - DNA, 297 bp, Homo sapiens
ggagagggagagggagagggaagtccaggattttcttttgtggtgatgaaaatgttttggaactagatacaggtgggtataacattatgaattaactaaataccccgaattgtaaactttaaaataattaattttatatttggtgaatttcccctcaattaaaaaaaaaattagaaaaaagccaggcatggtggctcatgcctgtaattgcagcgctttggaaagccaaggtaggaggatcgctttgtgcccaggggtttgagaccagcctgggcaacatagcaaaaccctgtctca

SEQ ID NO: 709219 - DNA, 675 bp, Homo sapiens
  misc_feature (600)..(600): n is a, c, g, or t
gctataaaggctgtaccagtgagcttgtacctttagattatttctcatagctcattaacaaccctttctttctgactgaagtactccctttagcatttcttgtaagatagaactggtgtgatgaaatctctcagcttctgtttgtctaggaaagtttacttcttcatgtttgaagactatttttgccacaaacactattccagtgtaaaagttattttccttcagcactttaaatatgttatgccactgacatgtcatatctctcctggactgtaagatttccactgaaaagtctgctgccagatgtattggagcttcattgtatgttatttgtttcttttctctgctgctttcaggatcctttctttatccttgaccttggggagtttgattactaattgccttgaggtagtcttctttgggttaaatctgcttggtgttctgtaaccttcttgtgcttggatattgatatatttctctaggtttgggaagttctctgttattatctctttgaataagctttctacccctatttttctacttctccttatggccaataactcttagaatttgccttttgaggctattttctagatcttnagggtgtgcatcattggtttttattctttttttcttctgtgtctctgatattttttcaatagctgtttccaggcc

SEQ ID NO: 709220 - DNA, 216 bp, Homo sapiens
cgggtgatgcggttgtgggggcagcatgtctcagcaccagctccgcgtgccgcagcccgagggcctgggccgaaagagaaccagctcggaggacaacctgtacctggctgtgctcagggcctctgagggcaagaaagatgagcgggatcgtgtgcagaagaaaaccttcaccaagtgggtcaacaagcacctcatcaaggttggtggcgcatgctg

SEQ ID NO: 709221 - DNA, 1614 bp, Homo sapiens
  misc_feature (97)..(97): n is a, c, g, or t
  misc_feature (187)..(187): n is a, c, g, or t
  misc_feature (298)..(298): n is a, c, g, or t
  misc_feature (591)..(591): n is a, c, g, or t
  misc_feature (749)..(749): n is a, c, g, or t
taacaaagatagaacaaaggctgcattccccaagctcacaggtctgtaagagatgggtctcttagtctctcccgaattcttggtctccaggcgttcntctcctgatgcccatgaacgctaacataagagccgccaccatggcgacgcgtctcgatctcccgcgatcgcgagtctgcaggtcaaccgnatcataacagtggctggatcacacaagctggtaaccggttcaaaagaggccaacaaagcccacacactctgaagccctaatcgactcggctcacagcaacactatccagantcctagggacacggtaggctgtgacaagaagacatagaagggagaagaatggaaaggaccaacgaaacgactagaaaatggattaacgatatgcaaccaaggaaaagccacgagaatagacacattggtagatcgcgaagacaggcgttgctggcctgccatgcgtgccttggcacgcatagcatgctgaccctcctgctaaggcactatgctaagcatgcacgactagactcgacattatgcgagcacggtagaagaagtccctggtcggtcgaggctgccaagtatgcccnggacctggacatgtgtagaacgtggaactaggtagcaaatgccttggaaagcatgagactctttgggattgcattttcatgcaatacagctacccttgggcttttgcattgggggcccccgttgcagggaatacatatgtgggaagcggtaacagggncccgcaaaggttgtttcccccccagccagggtctattacaggggggaggcagaaactgggtcccgctcccattgactggttgaacattgttcaaagttaaagggtttttgcttaaacgcctagtttcccacagttcttcccagaagttgggcttagaaacattgtttggtttctcgcagggcttcttcaggaactgtataaggcatgtgttgttgtggtcacattaagtttgggcgtacggggttttggaaaacgtttcaaatccttttgtgtcaaccaagaacacggcggggggggccattggggaatatttcaaccactttgtggcctccaacaagcagggcgtggttcccacacaggaggtttatccacgtgctggcacacacttccgtttcgagttggcagacacggtttggtagcgattaaattcacaactttggagagttagtaagggtaattttttttgtggggcccagacaaaaaataaaaaatttccccgtgtgtgttataagacaaacagaggggggcgttgtacaacaaaccagtgggtgcgggggcattaccatactaaggggggctcccccttaaagaaaatgcgcccctacagataattttctccgcacaggagcggaggtagtctaaagcaacaggaggtaaccagacaagacttaggatcataccacacatgagagaaagatcatcaaacaacatacataactaatatatattacaggcagagagctctatatgaacccccacgtaagaaatagagtacttacacccaaattagtacttataatgtaagtcacgcacaaaacacacatcgttgatgagttcattacacacacaatagttaatatttagc

SEQ ID NO: 709222 - DNA, 427 bp, Homo sapiens
  misc_feature (168)..(168): n is a, c, g, or t
  misc_feature (217)..(217): n is a, c, g, or t
  misc_feature (219)..(219): n is a, c, g, or t
  misc_feature (246)..(246): n is a, c, g, or t
  misc_feature (263)..(263): n is a, c, g, or t
  misc_feature (297)..(297): n is a, c, g, or t
  misc_feature (310)..(310): n is a, c, g, or t
  misc_feature (321)..(321): n is a, c, g, or t
  misc_feature (339)..(339): n is a, c, g, or t
  misc_feature (345)..(345): n is a, c, g, or t
  misc_feature (368)..(368): n is a, c, g, or t
aaggagcttcaatgatttgtaactgaaatatcaggttctagaagaaactggcgcttaaaccaaatcgcatggattttttttcagtgacgttcaagtgtttctcacggatggaattctagtcagctgcaggcgggaagccaggcggtggagcccatgggagcaagggcnagtggcccggtccccgctgtgccaggtgggcaggcaggaacaaggcctncnagggaggaaccggccccttcccgcagncgcttcccagcagccgnagggggggcaggcactcacaaagcccgagggatnaactagcctgatnctgcgtgtccnaagacttacgtttaaggngatgtnagtaactgtgtgggtctaatgcngttctaattcatttacttgagatgttgtggcttatctatctccttggtctactccatat

SEQ ID NO: 709223 - DNA, 116 bp, Homo sapiens
cacatatgtatgagttgtatacatgactaccatgaccccacaactaggtgaaaatcacatggtgttttccaatgtgattccattgaaggtcccgagtcactctatgtaaagatgta

SEQ ID NO: 709224 - DNA, 967 bp, Homo sapiens
aacgtgggtaccgtcttctgtgtagaccttctaacacggacgagggcctccttcgaggcctctcttgggtggtttcgtagaagaacgcttgttggatttgggtgcgacccactttccacgactgtcgcttgtgttgtatttgatggaggaccacagccgcttgtggtgcccccccgtggtgaacaccccgttggctgtttttgtccccccccctccttggaggggggggtgcctcctccaccgactcatgcgcgtcgctcacctctgcgttgtgttgtcgccgagtgggtgaccgccgtcgtacgccccctgcttgctcctgcgctactgtgttgtgtgcgggtagtttttcttcccccctggttggtggagcccaccgccgccccgttgttttcccaacaggacccacccggcgggcgggcgcccctgcgtttttgtatggcacacccctccgcgtgcagtagtttggttggtcagggtcctctcccggtgggagaaggcacatcatcagcactccacccctcgcgggactcgtgttatcatcaccaccaccactatattccccccccgcggggggtgagagtctactatctagatattctcaacaacaatcgattaggggggcctgctgctggagggtgtcgttttttcttcgcccccccccgcccatgattgggtgatgttttttttggtgggtcgccgacaaactcccccccgccccgcgagggaagacactcctccccgacggggttttctttttttgtgggcgccttctttgcccctgctccgcgggggttaataacctggtcctgtggggtgctcccctctgctgccgggacccctctgggcctgcccgccagttttttttcccccctttgttttgggagagagaggcccccccctctcccccgcgggggggggcaaaaaaaaacggggggggtggtttttttcccccccccccccccca

SEQ ID NO: 709225 - DNA, 458 bp, Homo sapiens
  misc_feature (197)..(197): n is a, c, g, or t
  misc_feature (343)..(343): n is a, c, g, or t
  misc_feature (392)..(392): n is a, c, g, or t
  misc_feature (429)..(429): n is a, c, g, or t
  misc_feature (435)..(435): n is a, c, g, or t
aggggcacacatatgctaaacagaacagtgtgcaggagtacacatttcttcccagaaaccacatccagtgttttatgactggagggaaggggtgtagaggtacagaaagagatgaaggtggcatgagagaaaaaggcagaagcagaatgcgctgtaccaaaataaaagattaaagaagagcattaaagggtatgtcngtcaagtcctctgagatttatccagtactggatgggttgtaaagggaagtactttccatgaatgtgatctacaggtgacaaatgctttccccgctccttgctgcagtagttaccaagtcccttaagctcagtcagactattcacanggatagagggggcatttttaaggagaatcttttctgggcagcactgttngagggacaactatcagttcaatgtgaaaatgaagccncgatcnagggcctgggaagattgggcata

SEQ ID NO: 709226 - DNA, 876 bp, Homo sapiens
  misc_feature (566)..(566): n is a, c, g, or t
gtgcgccccggggtcgaggagggcggggtggggcggggcggggtccgcgggctccagttcgggcccacctgatgctgcccggctcccggctttgggctgagctgcgtggctgatggtggtgggccgccgccttgtcctccccagttgtggtgggtggcccaaggccctctccaccttggggtttggacccttaaggctggagccagagcttctctgtgcgcgacacctctcgggaagtttggggccccttcgtgccttggggggccccaaggtgttgtgggcggccccttgccgcacctttattttcacagccaatccccgggggaagtccacagcgtgggtctttgggccctgtgtgatcgcaggcaagccggcctgtggtgagaaacagaacaccatgcgtatgggctgtggaacaacaagctttaacgaagtgccatgcaacagggcggcctatactccgcgtggaaatagttacaccatttccccgccacaccggttttactggggcagcaaaatatacattttcaggcgcccaagctgcttgaatctgctctggaccgggngaaaacaccacccgctcccaacgttggggcgggccgtgtggcgaacacaaatagcgcgtggcctcccagcggactgtacctatcagcacacgcgcactgcaggacacaagacttctctctataacccccagcacaatcgcgtggacggcttcgttagccagggaacacaggggcaataccatccgtgcgttggagtgagagccccccggggaatcctccctttcgggagagacaacgtggttcgctggctccccaagagttgttgaatacccctgtgaagtgcttgggcggtcaccaccctgcgtggccc

SEQ ID NO: 709227 - DNA, 203 bp, Homo sapiens
tatatgaggaaagtagtgaaggaagatcagcacgttacatttaatgaaacttggctactatcccgacacagtagcatttgtgccaatttctggattggaatggtgacaacatgctggagccaagtgctatcatgccttggttcaaggtgatggaacgtcacccgtaaggatggcaatgtccagtcatatcccacgttttgctg

SEQ ID NO: 709228 - DNA, 293 bp, Homo sapiens
  misc_feature (6)..(6): n is a, c, g, or t
  misc_feature (43)..(43): n is a, c, g, or t
  misc_feature (48)..(48): n is a, c, g, or t
  misc_feature (101)..(101): n is a, c, g, or t
  misc_feature (103)..(103): n is a, c, g, or t
  misc_feature (138)..(138): n is a, c, g, or t
  misc_feature (160)..(160): n is a, c, g, or t
  misc_feature (205)..(205): n is a, c, g, or t
aggcanctgggggagggttcagggcagcaatgctgagttcaanaaaantacttcaggctgggcacagtggctcatgcctgaaatcctagcactttgggaananaatgtgggagaatggcttgagcccaggagttcaanaccggcctgagcaacatagtgnggatcccatctctacgcccaccctccccccggcaaaaaaaaaaanctgggtatggtgcttatgcctgtagtcgcagctactcagaaggctgaggtgggaggattgcttgttccccggaggttgaagctacagt

SEQ ID NO: 709229 - DNA, 448 bp, Homo sapiens
cagccgggtatggtggtacatacctggctatacgggaggctgaggcaagaggaccgcctgagcccaggaaattgaggctgcagtgagtcatgatcgcacctctgcactccatccggggcgacagcaagaccctgtctcaaaaaaaaaagttttggcagggcacagtggctctcgccactttgggagaaccaatcccagcactttgggaggccaaggcaggtggatcacttgaggtcaggagttcaggaccagcctggccaacatggtgaaaccccgtctgtacgaaaagtacaaaaattagccgggcatagtggggtgcgcctgtagtcccagctactcaggaggctaaggcaggagaatcacttgaacctgggaagtggaggttgcagtgaaccgagatcacgccactgcactccagcctaggtgacagcgagacttcgtctcaaaa

SEQ ID NO: 709230 - DNA, 1496 bp, Homo sapiens
  misc_feature (1460)..(1460): n is a, c, g, or t
tatatacgagcaagtttggtttattagggaccaaagtgggtaaaaaagagtggtcactaattatctccatgagaattaaggtccgttaagttcagtggtagaagaagaacgtggttatataaaagagtttgggcgtggtatattgcacatagtgtggaactcagagccactatagccatcaccagttgtacgaggtgcctttcatataaaccacaccgagtgtatgaggcatgtagggtcttttatctcacatataaacccaacatatacaataacaatatgaggagctcccagagatgggttgtgggctccacattcatagaagtgtggtctcgagggtgatctcgaggaacacctcgtataaattgtgtggtggtggtcttatagcacacttatagagactttacgtgggggtatatatatctctctccacaatatagcgcaacaagaggcgtgggagagcgtctcgcgtggtgtgtgccgcccccacaaagaggacacattctacaccgacgccacagaagagaagctctcacaaaatatattgtgtggggggaaataataacattttccaaccaccgagggtgtaaagtataaatcttcgaggagagaaacgccacaccaatatacacaacccgcgttggaataagccacaaaaactacacaaaacaagaagccgaagaacacagggaaagcccggtgggtggcccacaacaggaattaacaacaccagatgcgcgaggagacttccgggggggcccccaaataaatgagaagggacacaagacatacgccgaaggaagacacacaacagacacacacgaaaaccccccccacgaataatattaaaccacacataaccaagtggcggcgcgcgcgcgccccaaagaaataaaacaaacaaacaacacgctggggcgtactcctgtggagaggaaccacagtatggaggtggtgggtgcaaatggcggtttgtgggtgacacacaacaacgggccgtgcgcccatacaacaagatatcactccgacggagcggcagaacgaacattacaagaacggtcacccacaacacatataataaacagtaccagacagagggaaacgatcgcgcgatgagtggagacataaaggagtaagtaggccaccccgacaaagatagaccccgatctaggtacgacaacccctacgggaagcgggctactgagcaaaacatgcggactgcgaccgcgaaagagagtgagaaatctatgaatagtaatagacacaacccaggcgatggttatggtaaataaacatgttaggagcaatagatagataacaacgagcaaccccctgaggtgtgacggtaggtaaaaacacaataaggcggatgagtactactacgagacaacatagtaatacgcctatagcgcaacacgaaacgatacctcgagcgtgctatgcaagaactccaaccgagngagagaacccctactccgcgagaggtaatatcctat

SEQ ID NO: 709231 - DNA, 348 bp, Homo sapiens
  misc_feature (116)..(116): n is a, c, g, or t
  misc_feature (138)..(138): n is a, c, g, or t
  misc_feature (190)..(191): n is a, c, g, or t
  misc_feature (230)..(231): n is a, c, g, or t
agcggagcgtcacgttctcccgcaaaacgagccctgtgggtgccagtgccagtgggcggctcccagtgtgtggacgggggcaaggtacggtgcgtctgccagtcgctaagtgcccnccttccacttaatggcacaccnttcgcctcctgattcctgaaccgcgccgtggtgacatgaggactctgccacnncctccctcatgtgatgcctgaggtgcccctgagcgtgcnnacctgtgccatgccagtttagtgacatgaagtgcctgcagtgtgctgctgtgtgttctggctggcttgcgctgcgagaaaagtcctcttgtcatgcctgctaaccctgaaagtgtgc

SEQ ID NO: 709232 - DNA, 545 bp, Homo sapiens
  misc_feature (177)..(177): n is a, c, g, or t
  misc_feature (279)..(279): n is a, c, g, or t
ctcctttcctttaaaagaaaagatgggttgggtgcgaggcacagattcccttttcgggatttaggattcccaacccaggaagcttgggagagctttttgttaaggttatataattgttccggccctctttcaacggcttcaaacctttttcgcggggtttttgttgtggttaaaganaaagttgtggcccttgttccttcaattcaggccctttttaaacagtttccaagtttttttttgttttttttaaaagttttttttttcttttttcagtttttnggagccccccgggggggcaaggaggagttttcccccccaaaattgtttttacccccattctttaaattaaaattttttcaccccctttttcctttccgtttccggggaccccccctttccccttccttaattttttttttgcccgccctttttcgcccaattagttcccctttttggggttttttccccaattttttctttgttttttttccctgggtttttttttaaaccttttttttttttccttggaggggggattcctttta

SEQ ID NO: 709233 - DNA, 288 bp, Homo sapiens
  misc_feature (5)..(5): n is a, c, g, or t
  misc_feature (7)..(7): n is a, c, g, or t
  misc_feature (12)..(12): n is a, c, g, or t
  misc_feature (14)..(14): n is a, c, g, or t
  misc_feature (19)..(19): n is a, c, g, or t
  misc_feature (22)..(22): n is a, c, g, or t
  misc_feature (25)..(26): n is a, c, g, or t
  misc_feature (31)..(33): n is a, c, g, or t
  misc_feature (35)..(35): n is a, c, g, or t
  misc_feature (39)..(39): n is a, c, g, or t
  misc_feature (42)..(42): n is a, c, g, or t
  misc_feature (47)..(47): n is a, c, g, or t
  misc_feature (50)..(50): n is a, c, g, or t
  misc_feature (80)..(80): n is a, c, g, or t
  misc_feature (87)..(87): n is a, c, g, or t
  misc_feature (117)..(119): n is a, c, g, or t
  misc_feature (122)..(123): n is a, c, g, or t
  misc_feature (125)..(125): n is a, c, g, or t
  misc_feature (130)..(130): n is a, c, g, or t
  misc_feature (145)..(145): n is a, c, g, or t
  misc_feature (158)..(158): n is a, c, g, or t
  misc_feature (168)..(168): n is a, c, g, or t
  misc_feature (193)..(193): n is a, c, g, or t
  misc_feature (204)..(204): n is a, c, g, or t
  misc_feature (211)..(211): n is a, c, g, or t
  misc_feature (227)..(227): n is a, c, g, or t
  misc_feature (245)..(245): n is a, c, g, or t
  misc_feature (257)..(257): n is a, c, g, or t
  misc_feature (272)..(273): n is a, c, g, or t
  misc_feature (283)..(283): n is a, c, g, or t
tcttnantttanantgcanatnttnntgaannntnttantgntaagntcntcaccctctatttttagcccatttacaccntctaganttttaagtcaaatttccaatataagtaagnnntcnntncttancatcttatttttttnttttctggaaaanagctgttatnttttctctcccttttttatttctanatccatatatntttcacncttcacttttttctcnttttcattttttttattntaattttctttnttacacttactttcnntttcattttnctttt

SEQ ID NO: 709234 - DNA, 458 bp, Homo sapiens
cagagacccccttcaagaactgatgaaattagaaaaaacacctacagtttttattggttagcctggagcagaccattaaacaggtcgttattacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggtaagcagtccaaactgcaggatccccgccaatatcgtcaggctaatggaagtgctaagaaatctggtggggactttaagcctactttcccctccttacctgctttt

SEQ ID NO: 709235 - DNA, 591 bp, Homo sapiens
ggtgtcggcgtgtgcgcccggtccccgtctgccgcaccatggagagctaccacaagcctgatcagcagaagctgcaggccttgatacggagctacgggcagaccgtcctacgtatcagcctctcatcctatggtgcaccactgcaggcgggctctgtgcacatccctacgtcatgcttgcatgcgcgcgcagagatcatggctgtcctctttttccacaccatgcgctacaagtcccaggacccccggaatccgcacaatgaccgcgttgtgctctccaagggtccattgcagacgtcccgatcctctacgcgggtctgggctgaagctggtttcctggccgatggtcggagctgctgaaccgtgacggaagatcacgcctccgcactttggactgggcacccggtcccgaaacaaggctttcaccgacggtggccacgtggctccctgggccacgggcctcggggccagcttgtagggataggcctacaccggcaaatacttcgacaaggccagctaccgagtctattgcttgctgggagatggggagctgtcagagggctctgtatgggagggcatggtgcttcgccag

SEQ ID NO: 709236 - DNA, 413 bp, Homo sapiens
  misc_feature (26)..(26): n is a, c, g, or t
  misc_feature (186)..(186): n is a, c, g, or t
  misc_feature (225)..(225): n is a, c, g, or t
  misc_feature (250)..(250): n is a, c, g, or t
  misc_feature (261)..(261): n is a, c, g, or t
  misc_feature (284)..(284): n is a, c, g, or t
  misc_feature (349)..(349): n is a, c, g, or t
  misc_feature (370)..(370): n is a, c, g, or t
  misc_feature (397)..(397): n is a, c, g, or t
  misc_feature (404)..(404): n is a, c, g, or t
atcacccacccgggtgatgaccgtantccgagctgcgggcgccgcttcgagtacgacggaaatctgtctctgtccccaccgctgcttgccttgggaacgcggcccgaaacccaggatctgggtgatgggcacaggcgggcggtcggcggtgtcctcgccgtgggtcaccagcgcctcgcgcacggncgccaacccattgagcacgaccaccggcgtccaggccanctgcaggctgaacacgtccccgaancggcgccgcanctgcagagggagggtcagggccncttgtcaagccaggatcaccccagactacaggtatgaccttgcaagagtcaccaaaattgccganaggccccagttagcaacccantcccagatgatggtccatgccggtgancagtgangcccgagga

SEQ ID NO: 709237 - DNA, 449 bp, Homo sapiens
tggatgctggagaaaatgctcacgcctcatgctcagatggacacgactgagggtacacaggaggagtcaggacatgcccagactcgtgaaacacatcgtgtcaccagaggaacttgtgtaaaggaactaccccagcatcacaagtggctgatcgtatggagtctggaaacactctgtccttcctgtaattgggcccccgcaagcccccatgcaattagcactatccaggctgctggctgtagaaaaacttctctcttcctgagctaaagtgcttcatctcagactcccaactgaccagagatgcagcactgcacctcaggctggaagaccgggcgctgcgctgctccggttctggtggcctgtggcgggactccaccctggccaggagaaggggtgttaagagggtgacctgggctccagctctccagctctgaccgggaggctgttgt

SEQ ID NO: 709238 - DNA, 1808 bp, Homo sapiens
gctgcacgcgtacactggcgtatcctacagatgatgcaactatttccatggcagacatgtgcgctctcgacagtagagtccacactgcaatgtcctgacaagatgagaaggtatggcggcaaggcatgcagagcggtaggtaaccatggtccttgcgtatcaggacagctgtcgctgagatacactgggatggtctgagcagatgctcagcgtcggcaagcttgccacggtggaggcttgccgcatagggaaagatcataccagcgcatagataccgcgtcacaaactcctagcacaggaggcaattgtgggcagtcgaagacgtggataccataagattggggttcacagacttgagaccctattataaggacatatgacctcacaatgagcaataaaagattgatgatttctatggaacaaagacccaagcgagacgcagtagcaagacatgaactcggaacggggatgcgcacatagtgatgtaacgcctgtagtcctcgacggtcatcttcagggaattcgatgcacggagttaccaaagcgggaaggcagtagccgaagcaacgagagaggggtacccaaaaatcattttgccagcagacgaagaaccattcccagtatggtagtccatcaaaaaggaaacggaagaccgagacgataaccataaacatgaaatctgcaagaggatgaataacaccgcgtcaaatgaatcattaggttacacgatggacatagaacacgtttacccccgtagggacaccaagtagtagccaatgggacgaccccagcaaagggcgtaccgaagtacacggaactgacacaatcaccgcaagcacaagacaggaggaacaaccaccaaagggagagcacaaggaaaaccaaaattacagaaaagacacaggaaaagaaagagcggataacacagtagagaaagaaaaccgagcagcaagggaatgcaaacgaggagcgatgcatagatagaaaagaacagaatgacacaacaaccaaagcaggtaaaaacaacacaagatagcgagacacccaagaaagtgcagaacacgacacagggggattcgcacacccaattaaggataggagcgagccgaaacactaggagagagccccgcaagagacacaaccataacacatcgagaggacaatgtggacccccatatggcagcaaggtcgaaccgcaaagaacgcacacgacacgaatagcaagcacgcgcgacaacaagccagatgagcccaggacatcgagagacgaaacgcaccgcgatttgtacaagaacatatcaacgaccaaggtagcaaaacgagacggacacacaatgaaaaaacaaattgcatagataacaccatatccaatattttaggaacacgaaaatacaagggaacaatgaagacaacaccaaacgcgaggagaacccaacatcacgagagagacgacacggaacgacagagaggattaacacagtgggagaaaacacgaaacaaagatctaatacgaatgagcgacaaacgaacataaactggaaagggaagaaaaagtaacgtaccaaggacaagcaagtaccaccaaagtaggtcgccgacacagataccacaacgtctgaagacgaccacataagtggataacacacaaaaaatatcaatagcgacaaaaccaagagcgagagaccgcagaacagcaaaagaaatgcaccacataaaaagcacagaccaatcaaaaacgagagagacaccatagagtacgccatgtgaagccaaagacacccaacaatggaggaaaccacacaaaacca

SEQ ID NO: 709239 - DNA, 322 bp, Homo sapiens
gacttccgtgccagagcggaatccatcgatgtgtgcgctgtggctgagacacgtaggtcggcattgcctccgagcccactttagaccctcatctctgtgtcagaaagtgctgattcctttgaggaaccagcggaccaaagaaagagactggacgcggttctgagacactacggaatatacgcgttctaaacgcgtcctctgtctcccacaacttaactatctacggttgcgtctctatcccatgagtcgatgatctcgatctgcctgatgcggtggtcactgtatattcgctttgagctgcagggagtctctctctttttgg

SEQ ID NO: 709240 - DNA, 776 bp, Homo sapiens
  misc_feature (673)..(674): n is a, c, g, or t
gaacactccttactccagaagcctgaggtgacggatgaggagactctgctcctagcacttcgtgtcccgagggagagactacggctgaagcattcctgggcggcagacccaacatggtccatcttgcagtagggttcgccatattatgtcctcttgttcgctatttaccgagcccggaggattagagagcctatctctgggattcgctgtagacacgcccgcccacatgcatgcatttatatatatatatattatatatactatataatgggtgtctatataatatatatatagactatatgtatgatctttgtaaagaaacagagctaatgttgataggcggccatactgaactgttgtgactgctgtggactggaggacgtacgggaatgtttgcactcagatgctgacatggaagacgaggcgactagagactctgccatgatctgtttcatgttccacttgatgtggacagggcgctctcacatgcctcagcatgtgcattgacaagacatggcggcgcattcatccatgtgtgagcacacagacatactcagcgctggtgctgatgacatatacccccatcatactgacagaatgacaaagcacaggtacactgatgaagacactggctctcaccacagttagggagatacagagcttgtgtgctacnnggatgcccccaatgctgaatctcgtatcgccccatggggcttctgggtattcagactggggggctccctactctctagcgtatcgcataggggatgtggcat

SEQ ID NO: 709241 - DNA, 82 bp, Homo sapiens
aaaaccctcgacccgaaaccctcaccagataaactacagttttgtttaggaggccctgaccttcatggtgtctttgaagccc

SEQ ID NO: 709242 - DNA, 290 bp, Homo sapiens
aacaaaagttgaaaattttaaatggtctttttatggtttgcgtgacctaaaaagacaaagtttatccttgccttactgtatagaaatgcgtcgtatccacaatagcgtacagatttttccgcattaatccgtgtttatattaacagattcgttaagtatcgtttaaaaagggagagaggggataccctctctctagataaatgggtcatcatttaatcccaagaatgatgtcgataagtacttttctaaacgataacaagaaccccagtaggtagtatagcagtctttaa

SEQ ID NO: 709243 - DNA, 1120 bp, Homo sapiens
ggagagagagagagatctaggtctcgaggttctgtttctctatttttaacaaaacacagagctttataattctcaacaccaatggcaggggtcttcataggacaaaggagtgagtctctgtcaacagacaaggcggccccatatgttgccggcaatgagcgggtttccgcaaggaccacgaatgactgaggtccccgggcaggacacagtcgttggaaatgatagcggtctatggtggactggctgtggacttcgtgtctgtgcccgttgccactcttgtggggtcacctcagcgtccaacttcctcctgttcagcgttctctctccaggcaccccagtgttgtgcgcagtgtgccctattgcgcaaggggcccttctacagcgccgtgccgcagaaggagtttgctcgtaatagtgtgcgtgcgcacggcacgtgtggcactgaagcccgcgtgggcgactactgagggtcagcctgtgcacccgttgacctgtgtgtgtgtgaacgccccaacggcacgcacaggtgaggcccgcgggtgtgtatctacaaagagtctccctgtcctcttactctcagtgcgccctctctttggcgacgccctccccctctgtgagcagcgctccaagtcctctccaagcgtccttgtgagagcccatctgcgtcagacgagaagcgggctctcactcgtgagtgaggacaccaagccactaaacagcgcgctacactcggcggagctgatacaacaccactttatacagagacgggaagataacgaccaagaatggacacaaatggaaacctgttggcgacaaggatgagaagacgaagcttcagcattgacggacgaccagcacgtaattgcttggaactgaccaacagcgccacccgaccacaatacattccgcaggcggtagaatcttggcgtagcgacaagagacgagcccccaggcagccccccacagagtcaaagacaagtgattggcgcaaccaggcagctacgttgctaccgcccacaactggggaggcagcgacaccaaaacgcagttgaagaaacaacgagaccccgcccgcatctcatccacagcctgaacaaccaacacgtgtgcgccgccaaat

SEQ ID NO: 709244 - DNA, 890 bp, Homo sapiens
acaatgaacggatgagttgagatagactgtctaggtggcaagaacccatccacaccctctcaaactacttatgggatgtcctgttcactgaagacagcccatggtaaagatcatgcagcatacatgactctggcgggtaatgcacacaagaagtagtccatccatatctggaataggtggcaataaatccactcaactacatggagtggtcatcctcaccgaagtgacaggacaagggcagagacatcaatgaccaggacagtacgacaaaataatacaggcgagaagacggacaaagaggagcaagtgtaggaatcgcagtgagtaaaacccatgaaccacgaggatcacaccctacctagatcaaggcgacgaggcaacatcatggcagagagagaagaactactattcgcaaaccttacgcacccttcataacgtggcgaaagggcaagatgaactgacagacgcaacaacgaagcgaatagtacacacaggcacatacaagtcaaacggacatgagaatgatatcaacacactataacaggcaagcagctgagtgtaccactgacaacggagggagaagccaacgaactcaatcatatagagactggagagcgacatacgcaagtgatgcatgaaagaaagaggtacatgtgacacgcaagatgagcaaccatgtagggaaaagaaactgctatacctcaattgacacagtgctcactaactgagatcaggacccaccacagctatgactgaacagcgcacagcggaagaaaggaagaaagcaaaggccatgaagtataacataatcggaagaaggaaaacggcatacacagcagactaagaggacgatgagcaacaaggccaagtggcaagacacacaaacctaa

SEQ ID NO: 709245 - DNA, 290 bp, Homo sapiens
ctctagaggaccccgactgcatctgtgcctcatgctgttcatgtagtgagtgatttcttgctctcgcttttaagagatgggattcattctatcagtaatgaattgttcccatgagagtgagtgttaggaaaccagacccccctcagatttctccctcttggcctgggttcacttctcccttgagcttctctgccatgctatgatgcagcacaaaaggcctggccagaagctagggccatgccctagaacttctcagcctctagaaccatgagctaaataaacctcttctc

SEQ ID NO: 709246 - DNA, 727 bp, Homo sapiens
cattgagcccactcgcaaaccagagaattaaaagaaagtgccgaagtccttaagcgctacattgtcccttttcagtaattcaccagccgacataattttaaaattctgcgaaaattgggcgcaagaatccgtaaaccggctttgtctcattaccatgaaactgtggggatcaatagtcttctgtcctgtgaaatacacttggtatgagtcacatctgcaaagcgaataagaacgctatatgtccatgtgtcgctgcaatgtgcacagcacattgccatgtcgtatactctatgtgaacacaccgtgtcagatcatctcaaacagagtagtgtgtagtgcatatatcgggttgcttgtttgtgtaagtgttgtaacgagcgttacactgctgtgatataggcgttgccggcgtgcgaatgttctagtgtggctaggatgtagagtcagtcatatcggtctagcatgccacatgcagctaacagccgtacccgtctccgcatgtcactggcagagttatgttcgtaacatatacctccagttcactgcagtgaacggctccgctctccggagcttctcataccgccgccctctacaagcatcggtcatcagttgggttcagacttcacacagtcagttcacactcgcagccacatctcactctgactctggtccagtcagagggcacaggtcacagcaatgctgagcaatgtggcctggtcggcacaag

SEQ ID NO: 709247 - DNA, 427 bp, Homo sapiens
ttttttttttttggaaaaaaaggatcttgttttgttgcccaggtggccttgaaccctggtgtcaacgccacccctgggcaacattaacaaggactcgtgtctcccgaaaaaaaaaaaacacgaaaaaacacaaaaaacctttgtgggcgggcggctagggaccctagaaaaaggcttctaaagcacacatgtcgtggtggggccgggcggcccaagaatgggatctgcgagacgagcggcgctactgggggttcacaagaggaaccccgtggcagaagaagacgggcgcggatcctcacacaaaaaaaacaccgcgggggagacaccgagcggtcgtgtcaaaacacccagagacggaggttcaggaggcacagaggggactaaacaccgaggggcccaagcagcgcgtaaaacaaaattgcgccgg

SEQ ID NO: 709248 - DNA, 117 bp, Homo sapiens
tgccactttccaccatttattaaataaattcttccccaggccggtctgagtcgcacccagactttacatcatggctttgttccaggtgggtagggggtgccaaagggaatactgcgg

SEQ ID NO: 709249 - DNA, 369 bp, Homo sapiens
ctttacactatattaaaaaaaacaactcaagttggattaaagacttaaatgtggaacccaaaagtatgaaaaccctggaatataacctaggaaaaatcattctggatataggaactggcaaagatttcaaagatgccaaaagcaattccaacaaaagcaaaaattgacaaatgagacctaattaaaccaaagagttctgacagcaaaagaaactaccaacagagtaaacagacaacctacagaaaaggagaacgtatttgcaaactatgcttctgacaaagacctaatattcagaatctataaggaacttacattacaagcaaaatacatgcagccaacacacatatgaatgatcaacatcatttcatt

SEQ ID NO: 709250 - DNA, 356 bp, Homo sapiens
taagactggagctgtggtctgagctttgaggtaatgaattcccactcatgtgatcatttttaccataaccaaagtttctaaccatcaaaatcaagtgacaattaaaacaggcattaatggataaatccgtctttaaatattaatggggttaattttgttaacagctatgtgttggttgcaagtggaatgttctctgttcatttgacttttgaatataacttgttccagaatattgtaaaattaagtatgtgaatgtttctttgtattcagaattaaacatttggtgttaaaatcccaggattaggagacaactccatgtaaatttaatgtgtaataataagataataactttttaa

SEQ ID NO: 709251 - DNA, 150 bp, Homo sapiens
cagtagtgagtcaacagtgcgtgcaacaagtgagatgcttcagtacctccaccaaaccaggattctttcctcccttcctggagaccatgctccggaccacctcagctgtagagacaactccaaagatgttagccttgtgagacaaattga

SEQ ID NO: 709252 - DNA, 374 bp, Homo sapiens
cgtggtggctcacacctgtatattccagcactttgggaggccgaggtgggcagatcggttcaggtcaggagatcgagaccagcctggccaacatggtgaaaccccatctctactaaaaatacaaaaaattagccaggtgtggtggcacatgcctgtaatcccagctactcaggaggctgaggcaggagaatcacttgcctgggaggcggaggttgcagtgagcagagatcgtgccattacactccagcctgggctacagagtgagactctgtgtcacagcagctagctgtactgcatgatcacttcccattccccagctgacagtggcttgctctggaactcctaccacagtctttttggtaggccgccctgct

SEQ ID NO: 709253 - DNA, 453 bp, Homo sapiens
  misc_feature (44)..(44): n is a, c, g, or t
  misc_feature (55)..(55): n is a, c, g, or t
  misc_feature (69)..(69): n is a, c, g, or t
  misc_feature (73)..(73): n is a, c, g, or t
  misc_feature (107)..(107): n is a, c, g, or t
  misc_feature (266)..(266): n is a, c, g, or t
  misc_feature (273)..(273): n is a, c, g, or t
  misc_feature (300)..(300): n is a, c, g, or t
  misc_feature (308)..(308): n is a, c, g, or t
  misc_feature (392)..(392): n is a, c, g, or t
gaaagggaagaacaattttttctcctcattttgggaaggtttgngtcatagtagntgccatgtgccccntggncagattggagagaagagggacgactggagaatcngtccgagaaccagcaggagaaaagaaaaagcaacagtttaattctagaaggcctcctgtccctgcctgctctgggtgctcatcggaatcagctgctgccctgcacttctccccggccaagcctcccctcctcctcctccctccttcaagccttgttgtngcaactngggttcttcaggccccaggttttattngttccgtngggggggccccaacttggattccccaatcttttgggcccaacggggtttgggaagaaaaaacaactaaccggtttaaccggctnggcccaattcttggttcaacccccgaaggaaaaaaaaattggcttggaaggggaaccattg

SEQ ID NO: 709254 - DNA, 146 bp, Homo sapiens
tgggtagatgtgccaggaggttgttaaaacacacagattctgtgcataaccctaatccaggctcacaggatcagtctctcagtgcaggacctcagctcagattctgtacttttttttactagagactgggtctcagaccagcaaaa

SEQ ID NO: 709255 - DNA, 650 bp, Homo sapiens
  misc_feature (83)..(83): n is a, c, g, or t
  misc_feature (93)..(93): n is a, c, g, or t
cgggtcgctaatgtacattcctgactgatagagaccagataatgtgctccaagcaatatttttaacctgtaggagatatggangcttaaaagngttaagcttttctgctacttttggtgacactaggtgttaaattccctgctgacgtgaatagtattggatcctgggcattatcaacaaacaaacaacaacacaccaccttcccacttggaagtctctcttcttcttccattctttccttcccttgcatgtttctttttacttctctccctaattctattgctgtccccctatactatgccttgatcttcttccctctccctacttctccaaagtaaaatcttggtgagagatgggagaaaggaaaatccacaaatacaggaaagctgtcaaaagaggcaagccccacccacccacttcttctcagtcaagtctccgctgaggaatgtggaacttctgattccccaatgtaaagttggctggtaagtaagggctgtcagtggaagtaaaagagggtagttaggatggagagctagggcctatctgcgggggtaggtgagccagaagctgcggggcccctctgctgatacctgagctctgtgtgtgcgggcataaaggattccccatttctccacctccacagccacctg

SEQ ID NO: 709256 - DNA, 127 bp, Homo sapiens
tatacttctcagcttctacttctaacgcttatacttctcaacgcttatacttctcgacgctttatacttcacgcttatacttcgtgcgtcgcgaagtataaagcgttgagaagtataaagcgtagag

SEQ ID NO: 709257 - DNA, 149 bp, Homo sapiens
gaggatgatgcggaaattaaccccaaggtgtaatttttgtctgttaatcattcatacgtttctagaaggaacccagccagccggcggaatgcaagcagcagtaggaagcggaggcgggtgcctggcagaccggctgtcgggaccgaggc

SEQ ID NO: 709258 - DNA, 248 bp, Homo sapiens
atctagaggatcccgggattacaggcatcaccaccacgtctggctaatttttttagtatttttagtagagacgatgtttcaccatgttggccaggctggtctcaaattcctgaccttgagtgatctgcctgcctcggcctcccaaagtactgggattacaggcgtgagccaccacgcccagctcatttttagctacattttttatactgctggacaggaacaagattccaagggtaccgacgctcgaa

SEQ ID NO: 709259 - DNA, 391 bp, Homo sapiens
  misc_feature (355)..(355): n is a, c, g, or t
  misc_feature (375)..(375): n is a, c, g, or t
gagctcctacccccaccgcagttgtactgtgtagcattatacacacaagtcccttttaaacagaaagtctgttttaactttttgccctacctcagtctgaggaaggtcagttgaagtccttactgtacaagtccaaaattttaggaaaatgagtcccatgatgagtttcctcatgcttcagccatgcacggaccagtcagcttccaggtgtgactggagcagggcttgtcatcttcttcaaagtcatcttgcatgggttgtccaagcttggtctcacctcccaggtctcagatgctttaggttttacatggctgtggagaatccaggctgggattccttctacctttatggctgngggagtggacaagacgatgngtctgggtcctctcca

SEQ ID NO: 709260 - DNA, 267 bp, Homo sapiens
ggcggacattgaccttgatgtgatgaaatggctcccatatacccagtctaaccatgagaacatcagacaaatcccaactgagggacatcttacaaagcagtcggcacttattctcaaaactgtcacattgcaaactgtcaccgtcaagaggagcctagggaggcatgtcacctcgaatgtcacgtggggtcctgagtggaatcgtggaacaggaagaggacattagggaaaaactaagggaatgtgaataaggggtggacttaaggt

SEQ ID NO: 709261 - DNA, 109 bp, Homo sapiens
gcgtcgacggacaaggcttctctgtccgcccttcactcctccagcctcaggttcacttaggcacatcacacacacactggcacacgcaggcatccatccatccgtcatt

SEQ ID NO: 709262 - DNA, 144 bp, Homo sapiens
gactagaggatcccctgggttagctagctgcgttagctatggtctgctggagcaactggtctgtcttctggtccacacttgctgtggcctcatcgatacacaggatcttggcatctgtgaggagagccctggctagacccaggt

SEQ ID NO: 709263 - DNA, 217 bp, Homo sapiens
gtcaaggtgtagctcatgaggtggcaagaaatgggctacattttctacccaagaaaattacgccaccgccctgatgtttatacttagtgctttgcattatcagcactacaacatattgtttgaggtacatctgaggtgctcgctaacatccaagactcaattctgcgaccaacctgaatcaaatcaatagaactcaatcctgagtcaagaatcacac

SEQ ID NO: 709264 - DNA, 1140 bp, Homo sapiens
ccttttttttcttggtgcaagcgacgaagacgacgagagtacgacgacacgagagcagagagtatgaagcgctcacgtggtggtgggtgcactcacatacccaactggctcgtgacagccaatgccggtgtatgtcccctttgccgagtctttttctccagagctcgtttttagtttccgttctgccattcagctcctttgcccggcaggatgtgcgccacccaggccagatattggtgataagcggcgagcccacggggttgtgtccgcgcccggtcgccccccgggggatgactcttgtgttccaagcccgggtttctgtttctaagagatttcccgtctaccatgtgtgccgtgtgtaaaaccggcgtctctttgctcttttgaggacccccgtctgcctcgcccttccccttggaatattccctcccgccgtggaaattttggggtgggattaaccaggtccacatggatcttcctgcccaggaaggttccagctgtttcccatatccagctctaacccacgcccgcccagtcccatatttttaaggagactgcccgagcttaggactcgatagagagccatattatagcgtttggagcttttttgggggttattttacaccacaccaaaccacgtgcccattgggaaaagaaacaccagtgcccctgggagatttgccaccagataccagaatagtgtccaccacatcgcgttgaaatcattgttttgtggcaccacatagagccataggaaaggtgtacgccagaaaaactgcgtgtgtgtatccccagaataggtgtctttcttaacacccaacatgatttttcctagctgtctgcaccaagcgaggccgagaggttgcaacatggacaccaaaggcttgaggctatggcccatcttagccatatcccatcaccaaaaattgttgtctcctataagccattcccttttattccttcttattttatccctgggtcatgcctcccacccgtgagaataggagcagagatttctggtactagactgctgtagccgtgccccttcatcccgggccagttaatggagattctggaccccttttttttctgggaaccctgccccaccccccttcctatagagatgaccttttaaaggga

SEQ ID NO: 709265 - DNA, 277 bp, Homo sapiens
  misc_feature (99)..(99): n is a, c, g, or t
aggatccttacagcttctctctatgggcacagtgtgttacccgtaacggagtcatcacgatgcatgtgtacggccagaggcgtacagtgatagcacagnctagatagcaacgtacatggctgggtgttgaatggtctcaaaacatgatcttgtgtcattcttctcgcgggttgcgcttgggggttcagggggggcctcggtcagcagcacgggggttgctcctcggggagccaacacgccagctcattggaagaagggtgtggtgcccaggattttc

SEQ ID NO: 709266 - DNA, 1071 bp, Homo sapiens
gcctctcggaggctggaaatgcagctattgaggtcttcgaatgctgtggagcttggagtgcggaggcagcttgggtgaggctcccgagcgcatgctgaccaggccgcacatcgtctacgctctcttcctctctctctgcgcggctccttgtctcgaatacgtaactttttgagctctaactgaacgaaccgacaaagaggtagatctgtaccgtccacgtacacggtcactcctctatacttcttcaggcctgtgccggcgccggggcagcgccccagaaagagcctgtcccggcaatgtgcatccccccataatagccatgccgggtgagccgtacctaactcgagttgatacgagggcgaaaattcggggcagaaccgttccggagttacacatttgccaattaccttccaagagtgcttatgttcgtacacgtaacaagtacgggtagggcagagtctatccgacgagaaagtgctgcatgctcagagaaccaagaggctttatggcaatggaatcctttgttgcaaggcccccaaggtaaagttcaccttggacaattgtgacaccacacttggagcattgggactagatgcactcagcctcagtgctatcttcaacagctcagccaacccctttggtgtaattctgtggcaacgtacacacacaagaggcaactgggccgccaagtggcgtacttacagtgggagttgagccccggagttagttgaattgaccggagcaattacgacaaaacagccatagttagagaattcttggtgttgaacttccacttacttttggacaattgttggagtcaatcgacgcagtaacaggagatcaggacaaagcttgcagtaacatatggtgggatgctaagcgaagacgtcagggaacgcgagagcgaaacagcgaaagattgaagaatatgtaacagtatcatgtcgcttccaccactatatgcctggaggagaaatacttcacggttatgctctactgtgaaaggttttttgagcgattactcgggtgaagataggaagcaggttggttaacttttggatgtgagtgaaa

SEQ ID NO: 709267 - DNA, 571 bp, Homo sapiens
tcacacacgtggtttttccatgcttattaaaatgatccctcatacagccggaagaaggaagcccccccaccaaccaaacaagtaaggaagaactaccttctttgccccccccccacaggaatattgttcgtgagagaggagaaaaaaataatagaattatattagtgtgggtgagcagcaagagcctgtttataaaggccgcgagcaagtatatgtcctctcacactcaccgaatttattttatatacacattcttggggaagaataccactccacacagtgtcttattccccacacacacgcactgccgccacacacacctccctcactcttctctttatatataaatacaccactggcgcgccccacctctgtgtctacagaactttgtatgtttatagaacacacactagtcgctaataatttatcgttatatagggccctcactggatacatttttttcccgttgccaccacctatgtcacgctttttttacttcacaccaaacctcctatttccaatattttcaaataaaaaacgacacaccacactacaaatagtacaaacaaac

SEQ ID NO: 709268 - DNA, 560 bp, Homo sapiens
  misc_feature (42)..(42): n is a, c, g, or t
agggaaggggcggccccccatcggggtaagttttagatcccntacttcaccgttctgggatccaggtccgatacatgaagatcattgagaaaagtggttcccaggccctgccttgggttcgttacatcacccagaggggcgattaccaattttgtaccagctagaagggagaagagatgggggcttgaacacggggcttccttacagccccggatgcaaattttaaagggagggcaggtgcgggctgtgtgtgtttgtgtaagggcaggtcctggacttggcagttttttgttcccagcacccgccccttcctcaccttttccttattccatagggtgggagagaaactttttttgcttcccttggcccttgaagctttccccatccccctgattttatatgaagaaatagaagaggggcttgaagtccccctcgggagtgcctttttgcaattacctgccttagggggtgttgggggtccctccttcacagccgttgagcccaaaggtcccgctggcccctcctttgaattttaggatgtcattaaaaagatgaattta

SEQ ID NO: 709269 - DNA, 829 bp, Homo sapiens
gactatcttttctcttctgtcagccccacacgcctttggcacaactgaacgatgggtaaccttctattatcccttctttgtctctttaactcggcttattccagggtgctgtgtttcgtcgtagatgcatcacaacgagtgcaggttgcatcatcggtgttaaagattggggagaacgtaaaattgtcaaagccttggtgttgattgccttatgctcagctatcttacaggcaggtgtccacttctgaacgatcatgtacaaaacttagctgaactgcaagtagactgagatttcgcacacagaacatgctgttgcctgatgagtcacgcctgaaaaattgtgacaatactcactttcagtaccccttattcggaggacagaattacttgcacacgtttgcaatctcgttcgtgaacaccatactggtgaccactggctgcactgcgtgctgacaagcacgaagaacctgacagaacatgagatgcttcttgctgacacaagaggatgacaaagcgccagaaccgtcccccgaattgcggcagaccagaggttgatgtgatgtgctactgcttttcatgacaatgaacgagaccgtttttgacatcattacttatattgaaattgccagcaagaaactccgttactttttattgccccggaacttccttttctttgctaaaaaggtatcacagctggctttttacagaaatgtttgccaagccttgcttgattagagcttgcctgccctgttgccaaaagctcgatgaactttcggggattgaaccgggaaagggctcggctgccaaaacagagacctccaagtgttgc

SEQ ID NO: 709270 - DNA, 866 bp, Homo sapiens
cacaaagcaaacaaagagcaaagataatgacgggtgagtcggacgaggggcagggattatgacgtgagagaccagcggatggatcgaactctacgtactgtgtcagaggggaacattccttatgacgctactgaagagcagttgaaggacatcttttctgaggatggacctgttgttagatttcagatcggtatacgatagagagacaggaaagccaaagggtatggcttctgtgaataccaagaccaagagacagcacttagtgccaatgcggaacctgaatgggcgcgaatatcagagggagagcacttacgagtggacaagctgccagtgaaaagaacaaagaagagctgaagagcctggcacaggtgacacccatgtcaatatgagtcaccttatggagagaccatcagattcctgaggatgcccctgagatccaatatagacaaagcagtagcacagcacatacacaccagagcagaatgtatagagctgatgaaacaaaatgaagctctgtgtacagaactagtccccaggaggcacggaacatgttacttcagaacacctcaccaggcttatgcttgcatgcaagcacaggtagtgatgagaactgaggaatccggaaatagcctgcaaaattcagcatcgcccagaacaaaatatccacaacgcagatgcaaggaaaccctcagacagaaccatggagcgtgagcctggctcaggatcaaaagtgtcactgaaaacaacaaaacaacaaggaacacaagccaaaaagggtgaagtccaaacgagaaagcaagagaaaagacgagcagggctaaccagaagagatgagacagtgaagagaagacagctgacgggaacaa

SEQ ID NO: 709271 - DNA, 748 bp, Homo sapiens
gttgaacagaactgctctccatggagagagtaacctctgtaccttattatcggaccccgaggatcaggaaaaacctatgttaataaactcacctgcattgaaagaactctgatggtaattagaatgtaagtgaagtgtaagggaatgtcattaacgaagttcacttcaagatgggacgtgctgtcagagtcaagtgaccatacatatcgtcctcttaaaaggtaaaatctacaagtgcagttcaaatcttggtaaatatggtagtggggagataaaggttttggggcaagcttgtgcatggtaacaaaccctttgcaatatctcatttctgggtacacgcttttcataagacaatagtgcttgaccagacacgtaagcaagtgtgccccaagggtgaatctctgccatcatatacagcatggacatctttgaatctctgtatgagcctcatcacatcataatgatacacggaaataccacttttcctctattcatactcatgttgttcgcgacaaattttgtcattccataagtctcctggccacaacccaaaggcaaccacccaaatataaagtccaaagatttccaattgcgggtcctttcaccaatggttccaggcatcgtggcgcatcaatattgaaagggaaaaccttcttttcaagcaaaaggaagacacgaaggttggcaaatgttccaaaggaatttattccttccaccggggcggaagaattgacatttttcatagtga

SEQ ID NO: 709272 - DNA, 136 bp, Homo sapiens
ctgagggcgtgttacaaagcgaaaaagagaagacaaaaaaagatcacaaaacaaaacagacactccataaaaagaaaacaaaaaaacaacgctaacgcgatggccacaccacaagtcgccaaaaacaaaaaacctg

SEQ ID NO: 709273 - DNA, 801 bp, Homo sapiens
ctttggttacagggccagaattctgattttaaaaaaaattgtacccttttttaaaggctgggggagtaccacttcaagaggccgtaataagttgggaacccaaagaaaggctgcccaggggcacccccaacttggtgaagagtccttaaaagccccagaaaagtggaaaccatgtgtgtcttctgcataacccaaacaattgcccttgagcaaaggcgaatcacccgtggcccttccgcataaaggggcaaagatcaacaaattgtcagtaggtatcaaagagtcgaaaggctgcctagaatccatggtgacaaagagcctatgggttcaggaggtggaggaccaggaaactgtggttagcatcaagctacattttgagacactagccttcgacgcatatatatgcacactttgtcacatggagtagccagtcaggacacgattcgcacatgttgagcaggtgtacaactagccagagccattgtaacagctcctagtatttgtcatgtatggtttggcaccatacgcatacaactctgtcaaggcagacgatagcgatctgtccttgaccgaggaggggactgttcttgttggagctagacaggctgccttgtggcaacaaagtacgctgttagtagcctctcagctcctcatagtaataatatgttggcaatcaggatctcaagctgatggaccggtttcacatcagcgatggtgtgaagccttcccgctgtctgaacaggatacatgtcgtccatcatcctgcctccagttcgtgcgattccatcaatatgctctgca

SEQ ID NO: 709274 - DNA, 336 bp, Homo sapiens
tgatgtgcagctgtctgcctgttagtctgttgggccttggagacaggagaccaggtaagtggctcagcaccggccggtttcagctgtcttccagtgttctgtcgctcagcaagggtctgtcttcatccaaggtcgtcacaggggatcagagagctccagcctcagtgcagaggcaatagctcatactcaattggtgataaattgctcatgcgctgtcacggcctcattcagagtcatagatccatacctgtggaaagacttgggattgaaaccccggtcctgaggtaacaatgcacccaacaagcctacccgtgctcctgtgtctgccctctgtgt

SEQ ID NO: 709275 - DNA, 1955 bp, Homo sapiens
taaatacctgtgtatattaccgcactacaaatcagtccagatactctccaccccaatccaacatggtccagaaattacaatgagaagttgcggacatggattgcccttgggcagcccttgtcatgcattccgtcgcaatacataatcgtcgcatgcgtagtatgacgcttgagtcatagcgactagtacatcgaagaccgccgtcaaacactgctcttcttccatacggatgcagcccccacaatacgactacggcatgaacgcgtcaatattcactagtgctatggaatcacatacgcttgcttgcactcgtatccactgccggagatgggccgcgcatgctccacatcatttgtttgtcatcttgtgccaatgctatcccttgacaacacatcacgtgagcgtgcatgtgtagtaccaatatgtatactacgagcagtgcaccgtatgtcatgcatactcttttcacggacatattctcgtggacgaatacattacggaggcgatataactactcctacacatgaccatttgttctacacccgtgacgtagaactaaaaggacgcccatgtgtatacttacgttgcgcatacgttgtttccccatcgtcgcgatggtggaaagttcgaccccgataggaatgaactgtcggaattttatccttaggacagacagctgcatgtcaccgcaaccacaaggtgtacacagacgtcatgagaccataacacaccaccttttataacgttgaaatcaccaccggaacacccatttggcgcgcagaaggtacaccccaatgtgtttgaagagcaatcactacagacaacacgcctccaatggtttttccccacacttagggaagattatcattccgttaaagccgcccacggcgacgatacatccggacccatagtattacaaaaggtacactccaggtgtgtacccaccacaatctgcacaattatggaagacaaaccaggaaggtctacgttgtgtccaaggccgatgtgctccccaccacggggttatccccaacttacctttgttgaaaccagcgggtcaataacgacagtcttagaattatggacacccagcccgtgaccaattgacacagtgtagaaaacgcaaaggataacactcacatcatcatttacaccattaaaattatcccattattgctacacaatgtgttaacacacacctcagttgtggtcagttgtcaacagacacaacaataggcctcaacgcctgtaaggggagaataggtatcatcattgaccgtcacacacaagagtaatccgcgggtaggtacacaaaactcagttccatagacggcggtattaaggccagacgtgcacccggtcattaccacgtaacgtataaccgacataccaaaacacaggaacctgaaccaccctatcggatggtcgtataagcaatttacctttggtatcaccagggtactagatttcatttctgctatgtataagtgggacggacccgttttaaatacgacgattagatacatcatccacgcgcacaaggatcgcatacacctataggagcggagtggccgcaacaaccactcttgaaaaccccccgatcagggacgacaagcaccgacttagaaaacagaccccctgattacgcacaaaaagtgtacagtgcccccgcaaactgactaacctttcgccactattacgaagtgtgtaccatcaaaattaacaccggcaatctgaggacgcgttagtaacaacctaaaggacgaggagctcagggcgcacccagctaattagacgatgacagcatagccgatcagacgtagacgaaagcaaaacacccagttaaccggcacgaagaataatctagaacagaaggagcggaatagaatacgaaccacattatagagaccaactgagctcactctctgcccatcacaggaggatcacgtcgatgc

SEQ ID NO: 709276 - DNA, 244 bp, Homo sapiens
aattacaaaaaaaattttttttgagtccgcatcttactctgtcacctaggctggagtgcagtggcgtgggcccagctcactgcaacctccacctcccgggttcgagcgattctcatgcctgcgccctccgtgagtagctagggattagcgggtgcctcatcatcacgcccagcgtgatgtttgtagtttgtatgtagacgacagggatctcaccatgtctcctgggaacctcctgcctcccggg

SEQ ID NO: 709277 - DNA, 238 bp, Homo sapiens
ccaagaaaccacctttaaccatatttccgatttcctggccggtggtttaaaacaaggaaaaactttttacctttattccggtttccgggccggggcctttaaggggggaaaaactttttaccattaaaccgtgttcgaggccgggacctgacccctttgaaaataacttgtttaaataactttttgtaattcccggtccttcacccccggaaagcgccctgccccaaatccgtttttt

SEQ ID NO: 709278 - DNA, 751 bp, Homo sapiens
  misc_feature (102)..(102): n is a, c, g, or t
  misc_feature (709)..(709): n is a, c, g, or t
  misc_feature (735)..(735): n is a, c, g, or t
aatctgtgcctggccggagtccagggtaaattagtagcatggtgttagatgttagaaacagaactgttatttgcagtgttaggtctaggatcccagttctantaggacagccctgcaagacaatcaaccagagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacncatctccagagttcatgacagctcancctcgccccttgagaa

SEQ ID NO: 709279 - DNA, 690 bp, Homo sapiens
  misc_feature (648)..(648): n is a, c, g, or t
  misc_feature (674)..(674): n is a, c, g, or t
ccaggtagacctaacactgcaaataacagttctgtttctaacatctaacaccatgctactaatttaccctggactccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacncatctccagagttcatgacagctcancctcgccccttgagaa

SEQ ID NO: 709280 - DNA, 325 bp, Homo sapiens
ttcgattagggcacttagtgagactcatctctacaaaaatcaccaaaattagcagggatggtggtgcacacgtttagtcccagctacttgagtggggctgaggtaggtaggtcactggtgcccgggagatcaaggctgcagtgagctgtgattgtgccactcctcttaagcctggatgacagagtgagaccctgtctaacagaaaagaaggagaaggagaaggagaaggagaaggagaaggagaagaagaagaagaagaagaagaagaagaagaagaagcagaagagagaagcagtaaggtttaagttgccccgcaaatcgaagg

SEQ ID NO: 709281 - DNA, 343 bp, Homo sapiens
aatgggcagaaattcatggagtatgtggcagaacactgggagatgcatagattgtagaaagagagagccacgcaggaaagacaactgaagaacaccagacagagacagagatgctgtatggcagagcttctcgaacacactagcaagcggcgaggactggcttccaatacaccgggcgcacgtaagctgaacactatcaccatgtgcaatgctacgggcaatagtagcattcgggctatctttggagggacagtctaccacttccccgtgtctcgacttcctccttctggcagcaagccagtcgctggtttcacctgttcaggggggcagcatactgagtgcg

SEQ ID NO: 709282 - DNA, 383 bp, Homo sapiens
ttgaggttatgcacgatcgagcctatagagatccctccaacattgcaggacatgttagttataagaagtagttacagcccaattcactaaagttgaccaactgtttctcttttctacaaagatagcaagaagtttagaaattcctttcaattagcgcctggtgtgtcaggtgggagtgcagaggagggctgttagagcagtgtctagaggaccctagtgcgccagaggggttggacatcgttaataatcatagttggcttctaaatactggtagcaagatgacttctgatttgtaatcttaggtaaattatagataaatgaaaaaggccagtaatcatacactaagattaataaacagcacttcaaaattaaccgcataaggg

SEQ ID NO: 709283 - DNA, 90 bp, Homo sapiens
ctagaagattcagcaaagtacttttgtgctcttggggatgcgttattaccgtgggggatacttcctgggtcggatagcgataaactcact

SEQ ID NO: 709284 - DNA, 200 bp, Homo sapiens
  misc_feature (130)..(130): n is a, c, g, or t
gccaccgccgagctcacccctgcggtgcacgccttccttggacaagtttttggcttctgcgagccttttactgacctccaaacgctgttaagccggagcctcggtagccgttcctcctgcccactggacntcccaacgggccctcctcccctccttgaaccagcccttcctggcctttgaataaagtttaagcgagtagc

SEQ ID NO: 709285 - DNA, 1520 bp, Homo sapiens
gtatctagaatcgcgagcggcgccctttattttatatttttttattttatatatatttatatatttattttttattatttaatatattatttttatattatatatattatatatatatatttatatattatattatatatttttattttttttttttttttttttatctatcataatcacacaaaacagcaagacagaagaaaaaaacaaacaaaaacaaacaaacaaaaaacaaggagcgggcgcacccacaacatactcacacctcgacgggcgcccccccccactcacatcacaccacccccatcctaactctgctccagcagttgcgatagacgcgaagcggcgcgcccgcaacccagcacgcgaggaaaccactaatcacaaatcgaacagaccaacagacagcgagcgacagcacaatctaacacaacggagacggaggagcgaggtgacactcaccaaacaactctacacatcgcgtgtagacaacgagcaaacaggaaaccaaaagcatagttcctcacgagccgcgtgcgtgcgaaccacccacatccaacatcaacctcaccaccactcatcacacacacaaccacacaacgtcacaccacgacatcaaagacaacgagaagaatgacaaaaaaccactcgacacactctacacaccaacatccggcccacgagcaacacaaacaacaacccaaccccaaccatctcatcacgctggacgaaacagaaccgaatgtcaaaatacagcgcaagagcgagcgcccgtgcgaagcacaatcagccacgcgcgcccaaagtaatcacaataaagcacaagcgacgaggcaaccacacaacatataccaatccccgcggcaccacgacaacaacaggccccaccgatccgcacccgaacgcaccccacccgacaactacgaaccaggaggccgacgaacgacaccacacacacgagcacgaccacagatcacaagaagcaacacaaacagaaaccaacacgagaaagagaaacacagaacgatgacgcgaaagagagaagctcaacaccgaaactacccacaccgaacgacactcaacccacacaccgaacagaaccaacgacaaaaaaagcacaagggagcaaaagaacagaaccgcacgaaaagaaccacaagcaacaacccacacacactgcaagaacaaagaacgaacccaaccagcaacgcaaacacaacaggcacactcaaggcgagcaaggcgagagacaggaacacgaaaaccaaaagacacaagacacaccaaacaacagacaacctaccactcctacctacacccacccacccaatacaacacctcacgactcaacaccgactgctattaacaatctaatccacaaccacacacaaaactcacccaaaatcaaaccacacaacagaatctctgtcaaaccacaccctaacaaaacagacacccaacacaccgtaatactaccgacacgcactctaacctcacgtctacaaaaatagatatgaaca

SEQ ID NO: 709286 - DNA, 132 bp, Homo sapiens
acgccggtcgagggtgtccgggactcttgtatgccagagctcagtgacccagggagcacttcttgctgtcccttcccttgagttctccaaagcaggccatggccagtatcacaggctgaggagccaggccgc

SEQ ID NO: 709287 - DNA, 104 bp, Homo sapiens
caggagggcacttgaggccgggagttttgaaaccagccaggccaacatagcaaggctccatctctacataatgatcatcattatcttcaccaacaaaacattag

SEQ ID NO: 709288 - DNA, 385 bp, Homo sapiens
  misc_feature (60)..(60): n is a, c, g, or t
  misc_feature (63)..(63): n is a, c, g, or t
  misc_feature (74)..(74): n is a, c, g, or t
  misc_feature (81)..(81): n is a, c, g, or t
  misc_feature (121)..(121): n is a, c, g, or t
  misc_feature (124)..(124): n is a, c, g, or t
  misc_feature (133)..(133): n is a, c, g, or t
taggcggtcagcaccacgccgcccgagtcctccacctccatcgtcagccgcgcatgtttnggngccggccccanaacaaanaccgggaccagcatggaccggcgcgccgggaggctgtcancanctgggcggngcggcccgagccctcttccaactggaggcttatcctgtggctgggaacatttcctgcctggctgcgaggagtgagactaagaaaccatacctcaggctgaggagagaggccgggtttgatatgtgtgctctggggaagaaaaggagaaaatgtgatactctctcatttaaagcatccacatcaaaaattgaagaactggattacattgctgtttacttagtcaagttacaataaacttgatttccttttggg

SEQ ID NO: 709289 - DNA, 329 bp, Homo sapiens
  misc_feature (260)..(260): n is a, c, g, or t
  misc_feature (262)..(262): n is a, c, g, or t
gtctcgctcttgttgcccaggctggagtgcagtggcatgatctcagctcactgcaaccttcgcctcccaggctcaagcgattctcctgccccagcctcctgagtagctgggaccacaggtgcacaccaccacacccagccaatttttgtatttttagtagagatggggtttcaccatgttggccaggctggtcttgaactcctgacctcaggtgatccacccaccttggcctcccaaagtgctggaattacaggcgtgananccgcgcccggccaacatctatctttttaaaccaacagaattgccttgcttaatttaaggaaacagaa

SEQ ID NO: 709290 - DNA, 417 bp, Homo sapiens
  misc_feature (60)..(60): n is a, c, g, or t
  misc_feature (63)..(63): n is a, c, g, or t
  misc_feature (74)..(74): n is a, c, g, or t
  misc_feature (81)..(81): n is a, c, g, or t
  misc_feature (121)..(121): n is a, c, g, or t
  misc_feature (124)..(124): n is a, c, g, or t
  misc_feature (133)..(133): n is a, c, g, or t
taggcggtcagcaccacgccgcccgagtcctccacctccatcgtcagccgcgcatgtttnggngccggccccanaacaaanaccgggaccagcatggaccggcgcgccgggaggctgtcancanctgggcggngcggcccgagccctcttccaactggaggcttatcctgtggctgggaacatttcctgcctggctgcgaggagtgagactaagaaaccatacctcaggctgaggagagaggccgggtttgatatgtgtgctctggggaagaaaaggagaaaatgtgatactctctcatttaaagcatccacatcaaaaattgaagaactggattacattgctgtttacttagtcaagttacaataaacttgatttccttttgggaaaaaaaaaaaataatggcctggttggcctca

SEQ ID NO: 709291 - DNA, 357 bp, Homo sapiens
  misc_feature (95)..(96): n is a, c, g, or t
ttttgcattttacaagtcatattcaaaaaacacacacaaattagcattttgtacacgaatgtttatttctcaattaaacattccctttaaacacnnagggaatgaattctaaatcttcataaagatgaataaaaaatgatatccctccagtatagtgtgtataagcactgtccttggtcactactgccatttactgtttaacatcaaaaaaaacaaaagttatttaaaaatcatgctactggatttctatccctccactatgaccagctctacactgatcggcaatgttttacaagtttatatcatcagattgaagcaggtttaaggtgtgaaacagctgtattagacacaaagtta

SEQ ID NO: 709292 - DNA, 430 bp, Homo sapiens
tggtgaaaaggatcatgaccaacaggtgtgagacgtttatggaatgctgctggtgtggctctctgttactacagcagaagttgtagtcacagaaattcctaaagcaaacggagacaggaccctggaatgggtgcagggtggaatgggaggtgtatgggaaggctgcggcatgttctaactcctagactagtgctttactttattaatgaatctggtggtacaagcgtataagccccaaggcagatgttcctcaccaataacttcagaagaacgtccaaggtttttgggggaggacaaaatttgaaacgacaaaatgggctggccttgtgaaaaaaaatcaactatttaaccgatcagtctactgggtgttcagcttgacgaacaattattatttcactggttgttaactgctggttccatttggtcccaa

SEQ ID NO: 709293 - DNA, 221 bp, Homo sapiens
  misc_feature (3)..(3): n is a, c, g, or t
gcnccaatcagcaggatcccaaaagtagcccatcgcagggaggattgaaaaaagggccctttgataggacagaaacagaacatgggaggggccaaataagggaataaaagctggcccggtcttcagcccttagccagccagcagcagcaacctgtagggttcttttttatactttggaagcttatttttttgctcttcccaataaatcttttttctggtca

SEQ ID NO: 709294 - DNA, 423 bp, Homo sapiens
  misc_feature (17)..(17): n is a, c, g, or t
  misc_feature (24)..(24): n is a, c, g, or t
  misc_feature (61)..(61): n is a, c, g, or t
  misc_feature (260)..(260): n is a, c, g, or t
  misc_feature (276)..(276): n is a, c, g, or t
  misc_feature (309)..(309): n is a, c, g, or t
  misc_feature (336)..(336): n is a, c, g, or t
  misc_feature (346)..(346): n is a, c, g, or t
  misc_feature (368)..(368): n is a, c, g, or t
  misc_feature (373)..(373): n is a, c, g, or t
  misc_feature (413)..(413): n is a, c, g, or t
  misc_feature (420)..(420): n is a, c, g, or t
tttattcttggccaggnacactgngtcatgctgtaatcccagcactttggaggccaaggtnggtggatcacagggtcaggagttcgagaacagcctggtcaacatggtgaaatcccatctctactgaaaatataaaaattagccaggcatcgtggcaggtgccgtaatcccagctactcaggaggctgagacgggagaatcgcttgaacctggggaggcgggggcttgcagtgagccgagatcgcaccacttgcactttngcctgggggtgacttnaacaagacttccattttaaaaaaaaaaaaaaanaaaaaaacccaaaaattttccccatantaactggggnccatttttttaaacaccccccncttgntttttttttcagggggtttttggcattttttccagttttnaagtttntgg

SEQ ID NO: 709295 - DNA, 221 bp, Homo sapiens
tacccccaccggcagttgtactaggaggctatgttccaatccgtgatccatacccgatcacctggggagaaagggtgaactggggagaataagctgacagagcacctctcatttacccaggctgaaattgtttgtgtaattttgcctaaagcctgtagctgttgctgtaagtcaatttcacctagctctcgaggagtgcctggagtacaacctgccggtgg

SEQ ID NO: 709296 - DNA, 391 bp, Homo sapiens
acagttctggggattaggacatggacatcttcccactatgggggcagccaggagggaccacaggctgaccgctatctttctgcctgctttcactcatctccacacaattccttccttcctctcgctctcttctttcttttcttcttttcttttgtctctttctcttttctttttttctttctctttttctttctttctttctctttcttttctttcctttcttttcttctttccctcatcttcacacaatgctttctccctttctttctttccttctttctttctctttctttctttctctctctctctctctttctttctttctttctttctttttctctctctctctctatctttctttttcattttcttgagagactcttgtctcgga

SEQ ID NO: 709297 - DNA, 195 bp, Homo sapiens
ggctgatctagaggatcccgaaacctaataacgcagctcaactctgataagacctctagaacttccatatgccacaggtacgtctataacaaataaaacaaatctgtttggatgtataatttggaaaagtttcacttatgcttgtctatggtagtgttttaagtggctttatagactctatatagttaataggag

SEQ ID NO: 709298 - DNA, 168 bp, Homo sapiens
tacaaaaattaactggatgcggtggcacatgtctgtggtcccggctattaaggaggctgaggtaggtggatcgcttgagcccaagagggtgaggctgcagtgagctatgatcatgccactgcactcttcagcctgggcaacagagtgagggcctgtctctgaggaagg

SEQ ID NO: 709299 - DNA, 715 bp, Homo sapiens
gtttgttgtttcctgttctggtctggcttgaccgccgtgtccgttcgtatggtccctcggcggttgagtaccactctcgcttagttctgggcaatcgggttcttcgcgggcaaggcaggcaaacctctcttcgtctttccgtgtcccgcggctgtgcctgtggccgctcgcctgtcgtactcccgcgcgtctgttttctgtgcgcttgggtatgcccttggttacctccgcgtcttctatggttcgcctcctgtctggtctctcaatcccgcgggttcggggcctcgtggcgccaagccagggccccgggcctgtccttgggtacccgttcgtgccggattttcatcgctaaaagtgcccgcgtattctcggtccgcggcactgggtcccctgcgtggccccccgggtgtgatcccgcgtgtgagcccccctgtgtatatattacctccccaaactcgtgaactacagagacgtccccccccttaggtgttcaacacaattctatttcccgagcgtcttaaccccaccccctttcccccctacacccacgcggggttaaatcccggccacaactttcttaaatcttgcggaccaaaccacactcgtttaatgcccatctgttctcagaagtttattgtcccccctacatattattttaaaaggggcccctttttctcccctaccccccccttacccccctttaagcccacaaaaa

SEQ ID NO: 709300 - DNA, 213 bp, Homo sapiens
  misc_feature (189)..(189): n is a, c, g, or t
acaggatcttggacaatagcgacgcgacaccagcaatgcaccagtgcacagggagcaggaggcagcccagaacctccttgttcctatggcaagcaatgggctaggggagaaaccagaaagtgctgctttcctgagcaaagacgcattggggctgagcttggtttcccgaggagagtttcactctcgcanactgaagctgccagaacctagttt

SEQ ID NO: 709301 - DNA, 183 bp, Homo sapiens
ggtcgacctccttgcttccctaacaggaaggtgtcgagttcaagagaacccacccagagactgggagtggtggctcacgcctataatccctgcgctttggcagtccgaggcaggggaattgcttgaactcaggagttggagaccagcctgggcaacatggaggaggcaggcccactgcaggcc

SEQ ID NO: 709302 - DNA, 288 bp, Homo sapiens
  misc_feature (4)..(4): n is a, c, g, or t
  misc_feature (12)..(12): n is a, c, g, or t
  misc_feature (78)..(78): n is a, c, g, or t
  misc_feature (83)..(83): n is a, c, g, or t
cttnccccctgnaaaaatgccaccacaaaatatatgaggtgtttttttttggggggggggggtccttgcctctgtttnccccngcgaagtgcattggtaggatcttaagctcactgcagccctcccaccctcccgggttcaagcaattctcttgcctcagctatttgggaggccgaggcaggagaatcgcttgaacccgggagacggaggttgcagtgagccgagatcgctccactgcactccagcctgggcgacagagcgagactccatttcaaaaaataataaata

SEQ ID NO: 709303 - DNA, 790 bp, Homo sapiens
gtgcagcgtgttgctggtgtgatgtccagttctaaagtaaccacaggtcctgaggccgacctcagaggtgccaaatgcatggatactgtgtcagtgcagcagtagaggacatcattcaccaaccaatccaggtctcggccaactgtgaccaactccaatgaccatccctcctggctgtggatagcgaactgtcgtcagaccaccagagctcagtgctccagatcagtcacatacgatcagtgggcgcatgctactgtattctatgcacattagtaggccaactcttgtctatccaggatcctccatctgcagcgaatcagtattcagcgtcctgcccaggtcacgagatgtgcacaacaagaatcgagactagcatctcaccctgcattagggagcgccgaaaacagcagtttcagtacaatggctcagaaaacagatcgttcagtactgggcacgccagtggtctgcagcgcacagtagcgaccgtattttggcaaccaaaaccagttccttcaggcgaccacagctggatctgtgtcacaacacgacaagcgtccgcacaagtaccattgttaccatgacagtaccctcccattcctcccatgctactgcttgtgaccacctcaaatatcccagtcgatgcgatcttcagtggtcagatgggcattcctgttatcacctgcgaaagacttctccagctgcctcgcaaggagctggctggggcatcaaagtggccaaggtggtgcccagcagatcacgcacacttcttctcggatccagcagagtaccg

SEQ ID NO: 709304 - DNA, 652 bp, Homo sapiens
  misc_feature (39)..(39): n is a, c, g, or t
  misc_feature (84)..(84): n is a, c, g, or t
  misc_feature (92)..(92): n is a, c, g, or t
  misc_feature (103)..(103): n is a, c, g, or t
  misc_feature (109)..(111): n is a, c, g, or t
  misc_feature (123)..(124): n is a, c, g, or t
  misc_feature (151)..(151): n is a, c, g, or t
  misc_feature (153)..(154): n is a, c, g, or t
  misc_feature (156)..(157): n is a, c, g, or t
  misc_feature (160)..(160): n is a, c, g, or t
  misc_feature (172)..(172): n is a, c, g, or t
  misc_feature (176)..(176): n is a, c, g, or t
  misc_feature (189)..(189): n is a, c, g, or t
  misc_feature (193)..(193): n is a, c, g, or t
  misc_feature (203)..(203): n is a, c, g, or t
  misc_feature (206)..(206): n is a, c, g, or t
  misc_feature (236)..(236): n is a, c, g, or t
  misc_feature (276)..(276): n is a, c, g, or t
  misc_feature (331)..(332): n is a, c, g, or t
  misc_feature (334)..(334): n is a, c, g, or t
  misc_feature (340)..(340): n is a, c, g, or t
  misc_feature (361)..(361): n is a, c, g, or t
  misc_feature (373)..(373): n is a, c, g, or t
  misc_feature (405)..(405): n is a, c, g, or t
  misc_feature (421)..(422): n is a, c, g, or t
  misc_feature (437)..(437): n is a, c, g, or t
  misc_feature (532)..(532): n is a, c, g, or t
  misc_feature (558)..(558): n is a, c, g, or t
  misc_feature (561)..(561): n is a, c, g, or t
  misc_feature (619)..(619): n is a, c, g, or t
tactaacatacagaacaagatttaaggtaaattttttanacattatccagaaaaataacaagatttatagtatctacttctggnactaatanacacaaaaggncaaagnnntgcctatgcggnnggggtagcttcggggccctcctgtgcngnngnnggntcactgcccgcntctnttccttctttgcntctnttagatttcnccnctatgtctctcctgtcactatctccttctncactttcatggcgacgtctacaattacttcgagaagactnatgtctggctccccctttctccctgtgtcgtctttctctatgtcgtcctcctctnncncgactngctctgtgacgctcataaccnctttctgcatancccctgtatctgtatcgttcttcatcgctgtngaaaacacttggcgtnngactgtcatcacgcnccccctctctctctctggtgcgtcctctttctctgtcccgatcacggtctcgctctctgtttctgtttctctctctatctcggtctttctctctnctggcataatagtcccactgcttgcnggngtccacaagactaggccacgaaggagcagaaccaggaagagggggaaaggcaacaatnccataaggaaatgcacgttcagaacgactatta

SEQ ID NO: 709305 - DNA, 1640 bp, Homo sapiens
gtatacttagaaatagttacaactttaaaatagttacaaaacattcattaaagctacatatttaaagtagagcatctcagtttgcagcaacatcagcaacatccaattcattaacaatgatgtcttttatctcacccatttcaactcagttcaacacacccatgcacatgtcaaatgtcagcacagtagcaataatccatcagacattcccttcaccacatcattatctgttttactacacatatacttgacccaagtacactcaacgcaggacgagatcttcctatacatatctgtatactagtccaacatacattctaactttatgctcagtctgttatataagacgcatcattcctacaaccactacactttctttgtcttcccaaatacacatgtcttccatatataagtatagcaagatgcacatcacacaccatcaaccacaagttcatcaagcttagccatcacaagcaccaaacagcttcgacattgtatccaacacactccacattatcactcgagtgatacaggttatctcctcatatcaccaaggatcaattgtatcagccatatcatcatttggtagcgtggcatcacagacattcacgtgtttcttcctaaacacatttcgttcacttttgttcctggtcagactttcacaaacaagcaattaatggcaggtccatcagaacatgtgccacaggtggttactcccgcgcctctacgccccttaacctacttttgggcacactttgcgtctactctcgcatattccactacacgcacacagggtacttgaaacttaagccacgatcctttcaccaggcccttacacactacactctccgtacttggaaccttggggctcccattggggcacagctcacagattcccccttcattccaggaccctcagaactaaacactcattgcacactctgcccggtcataggacatggtgacacaaggatcacaacgacacccgcactacacccgttgttacaccccaacacaggccagcaagacgggttcagtattaaatcatctatcatggtcgaacatatataccaccccctatatcagaatgcatatatctcccgactgcacttacccactatgtcttacactaagctatctatggttggctctcaattacgcgtattgatactgtactaccatcacccaatcaccacgtgcgtcataacatgaaaaaggttacaacggtagtctcgtgcccactgaggaagaacgtacatactcgaatttgaaccaaacctaaatcacctaattcatatctacagtgtgcactactcactcacataaacaataatcagggacacacactgatagattcatcacccacgcacgcctcacctgttccccccacgctgccgtctcctctttctcacctcacacctccgctcaccaccagatcacgcttgataccaccctccacacccaccctacggctacgtctccttcacaccccacagcccctaccactactgcacgccacacaccagtcacctacgagacgtccacttttctccctctctcgcatccaccactactacccgccctccgtatccactcatcccattcacatatattcttagctgttcgctctgcttctcatg

SEQ ID NO: 709306 - DNA, 395 bp, Homo sapiens
ctcaaaaaacttacaatcaccacagaaggtgcaggggtagccggcacatcacatgacaaaagcaggagcaaatgagagagagtgggggtggaggtgccacacacttttaaatgaccagatctcatgtgaacttggcaagatctcacttaccacaaaggggatgtcccaagccatacatgaaggatcagtctatatcatccaaacacctttcaccaggccctagctccaacatgggggattatatttcagcatgagatttgggcagggacaaatatccagactatatcactcttcttcccaggacttctggttttattcttctctgttctgcagcctccgctgctgatacccaggcaaacagggtctggagttgacctccagcaaactccaacaga

SEQ ID NO: 709307 - DNA, 140 bp, Homo sapiens
aggtaggcggggatgaaggcgacagcgattgctaggatggtgcgtagaatgagaagtcgtgaagatgataagtgttgagcgaaggtgtatggttgatattgcgcgggtggcgcgccgaatgaggtgcatgagtgtctgga

SEQ ID NO: 709308 - DNA, 418 bp, Homo sapiens
aatcggaggtgtgagttgaagtccgtcccagtgagtgttgatggaccgtgaggacagtaagtccagcttgaatttacagttgtccataagccccatgttctcgctggtgtgactgctgacacttgtccttcagtgcccgacacctcctgtgctgtacttctcgttgtgcgctgctggagcttgtccacctcctgcctggtatgccttcagggccttctcgtatttatcccgcatgcaccccactctccctctggtgtaccttgctggcctgagagcagcctgctcccgtagcctgcaggatctcggcggcgtcttgggttggtcctggaggtgggggaacctgagtgcaacatggcactgctggagctcctcgatttcacctcggggcagggtgagctcctcctccagcttgagacac

SEQ ID NO: 709309 - DNA, 661 bp, Homo sapiens
  misc_feature (223)..(223): n is a, c, g, or t
  misc_feature (226)..(226): n is a, c, g, or t
  misc_feature (298)..(298): n is a, c, g, or t
  misc_feature (342)..(342): n is a, c, g, or t
  misc_feature (506)..(506): n is a, c, g, or t
  misc_feature (548)..(548): n is a, c, g, or t
  misc_feature (565)..(565): n is a, c, g, or t
  misc_feature (569)..(569): n is a, c, g, or t
  misc_feature (592)..(592): n is a, c, g, or t
gacatgcaccatcacgcccagctaatttttgtatgtttttcagtagaggtggggtttcaccaagttggccgggctggtctcaaactccccacctcaagtgctctgcccgcctcggcctcccaaagtgctgggattacaggcatgagccatggtgtctggccctaatgtgagtgatctttaacactgagcacttgaaaaagaaaaccctgaagaaacctaattnttngatgtctggacgacaaggaagaagatagaaatggcatcagataataaacagtgtaaatgtttatcagaaagnggctggtggtcgggacaagtaggaggatcgcttgagtccaggantgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctggntgacacagcaaaatccagtctcaaaaaaaaataataataatnttttacataaccaaccncttntaaagattaaaaaaaaacccctntgattaaaaacctcaggtccctcaggcaatcataccagatttcgaaacaaagaataaataaataattta

SEQ ID NO: 709310 - DNA, 283 bp, Homo sapiens
atctacaggatcttgatatgtgttcaatgagcacgatggtagctctgagagcacctcctggcagggactagggagacacatgcttggagacaggctgagagacagtggcattgcctctccggaggtcatctgcaatagctaccaaattaaaaccagcatccctcctacccaaggattctacttctaaggatccagtcacaagcaccctgatgtaccagcatcccaaaataagctcatgtcccacctacagggccttggtgaaatcagttatggaatctcgggc

SEQ ID NO: 709311 - DNA, 237 bp, Homo sapiens
cacgagtgctgtatagaaagggactacttgtttctcagtacggagatcatcacatttaaaggataaatgaaaagaccttaaatgtgagttaagtcatggcaaaataacaatcagaaaagaagttgcagttccagtggcatgtgcctgtagtcctagctactcaaaagtttaaggcagagggatcagttgagcctgggagttcaagtccagcctgggcaacagagcaagactgtctca

SEQ ID NO: 709312 - DNA, 1232 bp, Homo sapiens
cggctgttgccggtactggacccggcgggatgagcgaggtggagtgcggcagcgggggctacagcggtccccgcggcgacggtgcccgcgacggcggcagagtgtggtagcggtggtggtaccggtgcccgcaggggagccggcaagaaagtgcggctgtgtggcgtggctggctggtggtgtgctggagcctgcctcgtgtgccccgcatgctgggaccccctcggctgcctggtgctccctgcacccgctggcaatcctggcggactggcggtctcgtggaaccccccgccctcccccggccccgggagtcagtgcggacaagccggtgctgacaatccaagtcctggggcacgtgtcaaattggttcaaccgtccggacatggttacggattcatcaacaggaattgacaccaaggaagatgtctttgttcaccaggacagctattaaaagaaacaaccccaggaaggtatctgcgcaggcgtagggagattgggggagaactgttggaaaatttgatgttcggtggaagcggagagcaatgtggctgcagaaaggccaacataaaatgtaaactggggacctggaggagagcttacccgatgaaagggggcatgtccgtgatatgcaccacaaaacggaacggtaagatccgcggcgagaatttacaaattcatccaaggaagatcaatcaacgtcaaagaagattagcgcacaaaagcagagcaacaattaggggcagcggcaaagaagagagtcacagcaatacgaggagcaggagagacacaaagaggagcactatgagacaaaggataaatagaggggagaagcacagaggacgaaagaaaacagacatcataagagacaataggagtcaccacagatactacaattagggatagccagcactagagtacccagtattacgttataataaccatggacgatagagtcggcatttaatagattgcggacaggaggcgcccagaggagctagttcactagagggacagagacagtagcagagcacagactatagagaagaggagcaagagagcagcagacgggataagaaaggccacaaagaaagatagagtcatgagacacgagatatggaatcagaaaggtcctaaatactaactaatagaaataatataaagccaaagagatcagcacagaagagcacaaaataatacagaggacgaagaagattcggaggaagagtcgtttg

SEQ ID NO: 709313 - DNA, 439 bp, Homo sapiens
acccagatatgcagagaaccctagtatcttctttaacctgtttctctttactgttactttgcctgcatctttctgtaaatgccctgcggcagtgcttccaggtagcagtgctcagcaggtgtctgctgcctcctgccttgctttgcttgctgagcctcctggctgtctataaacctatgtctctgtcttaatgctcctaagcttagtgcgtcctcaccacttccttcttgttcttgtgtaatgcattttgccccttcttcctgaaactgtgcctgagatggtataccctgggggggagggctgtggaccacagagccttaagatccaccttccttttgtgtagaaaaaggaataatatccttataactggggcaccgacgttcactcttgtggcccacgctgtattgcgaatggtgcgatctgaactaattgcaacctt

SEQ ID NO: 709314 - DNA, 414 bp, Homo sapiens
agcgccctgtatgagaaggcgtgcagaccctacatgaggcttcggaaatgactcagatcatgtggcctgcaggtatgttgacctgctcggaagacactctgaccgtgggcactgctgaccattgcgacggattcacatttgcaggatacaccccgcgcgtcatctctatcggaggactggcccccatgctgagtgacacagacaagaagtccttcactgacatcctgtatggcactgggcctggctacaaggtggtggacagcgaacgagagaatgtctgcatggtggactatgctcacaccaactaccaggcgcagtctgctgagcccctgcgccacgagacccacggcgctgaggacgtgagacgctgctccggccccatggcgcacctgctgcacggcatgcacgagcgct

SEQ ID NO: 709315 - DNA, 467 bp, Homo sapiens
gccttaaagcctgaggagaaggttgaggattgtgggaggttcaaatcagcccggagttattggctcatgggcgccaaaaaaaactggatctgttgaacgaaggctcagcccgagatctcccaagttttcagcgcattggcccaaaaaaggcccaactaattgtgggctggggggagctccccggccccttcaaccaggtaacagccccctggattgggggagggcgggggcgggggaaaccgggtacccccaaaaccctgtcccctatcgatcctgtccccccaggtggaggacctggaacgcgtggagggcataacggggaaacaaatggagtccttcctgaaggcaaacattctgggttttccccccggccagcgctgtggggcctcctgaccgtggtttcccccctccgccttttcaaatttttgtataaccccgtgttgggtaaaaacagtttttgctccgga

SEQ ID NO: 709316 - DNA, 143 bp, Homo sapiens
gtcgacgactccaaccagcagcatgccgagactatgccaagtcgccacaaaggcgaggctgtcttcctggcacccaagtgcgtagaccgcggcggtggccgcacgtgccgtcaagcctgcgctcagtccagcgagccttagcc

SEQ ID NO: 709317 - DNA, 464 bp, Homo sapiens
  misc_feature (4)..(4): n is a, c, g, or t
  misc_feature (341)..(341): n is a, c, g, or t
  misc_feature (364)..(364): n is a, c, g, or t
  misc_feature (381)..(381): n is a, c, g, or t
  misc_feature (402)..(402): n is a, c, g, or t
  misc_feature (462)..(462): n is a, c, g, or t
gatntggacgaggctgattcttgtatattagcaattataatgtttgtatatggcaaaactgctagcttgatttaaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaanaaataacctatacggtagttggntttagggggtggggggntgctatctgttagtgcttaanagggggtaaatgcttgccgctttagaggtgggtggtgctcataaaggccccgtcggggtntt

SEQ ID NO: 709318 - DNA, 342 bp, Homo sapiens
tgatctagacgatgcttatgcggtgcctttccaccattttcagcccttccaggctggaggaccggtggcaactcttggagcctcggctgaagtggctgggcatgacgccgtttctctgacgtcccccaatagatctgggtcatggagccaaccccagcgccaccccggagggtacaggtgccgcgctgtggaagcaggctcgcgtgtagaaccagttctcatcgtaagggagcaagctctttgtgcttggccatgcttgacgggtatccaccccattcggggcactttcagccttcccgggaccttttggacggaacggctgccacgacgctcttgaccgaa

SEQ ID NO: 709319 - DNA, 958 bp, Homo sapiens
tgtctcgtccatcatcatgtttttccgttactggcatcacaacctaatcaatcgggatgatatctttgggcgaagaatattcgtaagatcgtcgtcaacgaggaagtaggtgacaccgggcgttataacttcggtcagaaatgcgttttctgggcggcgattattttcctggttctgctgctggtgagcggcgtgattatctggcgtccttattttgcgcctgctttctcaatcccggtgatccgattcgcgttaatgctgcattcatttgccgcagtggcgttaattgtggttatcatggtgcatatctacgccgccctttgggtgaaaggcacgattaccgccatggtggaaggatgggttaccagcgcctgggcgaagaaacatcacccgcgctggtaccgtgaggtccgcaagacaacggaaaagaaagctgaatgagtattcgcataatcccgcaagatgagctgggttcaagcgagaaacgtacggcggatatgattccgccgttatttgttccctcggctcaagaatttatacaacggcggccgaggcgtctgcgcgagctggagaaaataatcctctgggtgattacctgggcttgggtgggcttatcggccagcccaggaagtggtgctgtacgaaccatcccggtggagatggttctgggcttgcgcgcatgtagagaaggcagggaaaggaaggcccggtggattttaacgtctgcggtgataagactgggaaagtgtgattggcgcgttgtgagtgaaacttgaatgagggcccgggtggagtgattggaatggggagggttgccccggggggggaattgcagcggggtggccagatattcgcggggaaaaaagcggattggggcggggctcgggggaggaattccgccacggtttggagaattcgggggtttggtggagagacggctcccttgttagttattgag

SEQ ID NO: 709320 - DNA, 111 bp, Homo sapiens
taagctatggagtaatgagcaggctgctaaaaatcagctaggaatgatcgtttaaaagttacggttggggggcggggcgcggtggtcacataatggggtatcgggtaccga

SEQ ID NO: 709321 - DNA, 987 bp, Homo sapiens
ggacggacaggccccggccaccggcatcgggcctccgccagatcaatgcagggggaaaccgggggccccgttcccacacctggcccggagcggaacagcaaatgcccaggcagacggaggcaggacgcgacagggagcgggcaattcgcgcggactaacggctccagggagcttcctcccagccgggagctggagggagaccaccctctgggcactgcagggcccgccagacacgcaaggctcgcctggaggaggtctgcccggcaccctcctactctccagctttagtctcataaatgccagtgataggattccttgtttgcgtggtccccaatagccttgatactcgcttgcattggcatgttaacttgggttcagcagacgcctctctctgcccccctgcaggcaggccctagtaggactgctggagtctgtgctttgacagttgtaagacattctccgaaccaaaggcacgcttgggtttgcatgcttttacagactcccctggggcgagggtcagagctggctctaggggagctgggctaggaagaggaggatgcagcccagactcttcctagcctttctaaaccgaagttctttgccattcctacaagcccagccttgctgctggtgatgtttcctgttcctttgggtatttgcactattttgggagcaagttttctatgtgggagccactttttttgcctagcaggggctaagttgggggttttcagggagcctgcttaggcgcctccgtctctcttctttcctcaatctatgctaatcggctctggccgccatcatctcactgggatgcacagagggctcgcctctccagcggcttgggtccggggaggggacactccagttctctagcatggcccgagatatggggtatgtgcatgtggaggccagggtaaggtgaatggggaggctgggaggactggtgttgccctttggagcttggtgaaattgctggcctaggct

SEQ ID NO: 709322 - DNA, 786 bp, Homo sapiens
ctcacagatgacagactagtaataagagctatcccatgcgacttatgtggggctcgacatctacatgctctcggatataatgttcttgccatgcatcaggttattacttgcaagtccagccactttcagagcgtcggtgaaaatggaaagagtgcgtctgaacatgctgtagaggaatcagttaatggaatcagtaatgcctcatgagtcatttatcttcatatcaagaatttaaaactgccaagattgtcctcccaacctctctcacaaacattcatgagagtagtctctagaggggtgaaacagaatggtgtagatagacagatcagtgtagaccttgagcaaggcctctgaaaaacatccccagactaaaaggatctgtgatggcatttgtgtgtgtgtggccaaaacagagaacacattacttttcactatacttacagatcttacaaaatatatgtctcattaaataaaaatattgccaagtcatgatagcaattcaagaaatttcctttaagatagagttgccaaaagaacatgcatgttgacaattgcacctactaggcttcctgctacaacaaaaaaatccagtataacactacattctttttctgggtatttcgtgtcgggtgggaacaatatgtagggacaactatttagacagctcaaaataggaagacactgtgaagatagcaatcacttcaatgctgacgtacttttcatatcaacgacactagaacacggaacagctaaaactttatacagggagaaatatacacctggata

SEQ ID NO: 709323 - DNA, 298 bp, Homo sapiens
ggatccgaatatgctgtctcaaaaaaaaaaaaatcagaatgggagagaaaacgttacttctgaccttaaagaaataaaaggtattataagggaaataataaaaaccattgtatgccaaaaaattagataacctacttgaaatggcccccttctactgattctgcctcaggaaataaaaaatgggaatagtcctaaaacaagaaattaaggcccggcacagttggtttatgccaacaaaaattagccgagcgtggtggcccaggcctgtatcccagctaatggggaggctgaaacagca

SEQ ID NO: 709324 - DNA, 977 bp, Homo sapiens
ggagacacgcggaggtggtgacggagctgaactgctgcgggagaggcgggcgccagcctgcaggtggtgtcgctgctgcccagtctctagactgcccagcttggggggtaccgcggacccgtcctgctgggccccaggggggcttctaaggagccagagggagcatggttgcaatgatcccgggcatccactgtgggccagtccccggccctctcctcaactggagccgagaaggctccagcagggcaaggactggaggctgccccagtcctgtgccccagtagaatgccagctcctgcccgtcatccttgaagcacgccaggatggcgtgatgggccatggatcccgtgctacgcctcagccctggtctccagcgtggcagcaaagcagcgagcatgccctccccacccagatggacctccgggcgaaatgcctgtcccggcctcatgctgtatgtgctgcctcggtgcacctggccttgcccattataacgactgggtcagacgctgataattttagacatagaaatacaggggggagcgtcgcaacaaagaaagttatcaccttaggatgtggcgcccgaaaattgttttatggctttgcaaccaagtttttattggattccataggtttgttgccacctaagttaagggagctcgtgttattatgaagagttgaggctcagtgtgacccgtcattttaaaacagatgcggtcggtggactgtgtgggaaaagtgtctgactttgggacagatctctggtatgaacagcggaacccgtttgactattcgtgggggggggcgcacaaaattattgtggaaaaattacccgtcacagaaagaaataggaggttcccagtggttacattttcaaattcaaggtgctataaggtgtgtgtacacacacgatgaataatgacatcgatgtgactaaaagttagccaaaggacatttgcaatatgaaaacttgtacacgc

SEQ ID NO: 709325 - DNA, 600 bp, Homo sapiens
  misc_feature (41)..(41): n is a, c, g, or t
  misc_feature (61)..(61): n is a, c, g, or t
  misc_feature (78)..(79): n is a, c, g, or t
  misc_feature (81)..(82): n is a, c, g, or t
  misc_feature (86)..(87): n is a, c, g, or t
  misc_feature (90)..(90): n is a, c, g, or t
  misc_feature (92)..(92): n is a, c, g, or t
  misc_feature (94)..(95): n is a, c, g, or t
  misc_feature (97)..(97): n is a, c, g, or t
  misc_feature (99)..(99): n is a, c, g, or t
  misc_feature (103)..(103): n is a, c, g, or t
  misc_feature (106)..(107): n is a, c, g, or t
  misc_feature (144)..(144): n is a, c, g, or t
  misc_feature (156)..(156): n is a, c, g, or t
  misc_feature (278)..(278): n is a, c, g, or t
  misc_feature (311)..(311): n is a, c, g, or t
  misc_feature (316)..(316): n is a, c, g, or t
  misc_feature (370)..(371): n is a, c, g, or t
  misc_feature (380)..(380): n is a, c, g, or t
  misc_feature (405)..(405): n is a, c, g, or t
  misc_feature (461)..(461): n is a, c, g, or t
  misc_feature (481)..(481): n is a, c, g, or t
  misc_feature (489)..(489): n is a, c, g, or t
  misc_feature (497)..(497): n is a, c, g, or t
  misc_feature (512)..(512): n is a, c, g, or t
  misc_feature (567)..(567): n is a, c, g, or t
ccgcccacccctcagccccaaatccaagatttcagagcccnaacacccacccaagcagcgncccgcacacaggcccgnngnnttcnnccncncnncnangggnccnnagggaaaggagccgtctttagggaggaaaagcgaacnacagcccaggcnggccgccagcagcccaggggcagcgcagccgccacgggaggcgagggaggagggcaaagggcaggggagagggagggcggcccgccaggagccttccccttccctaggagccaggcaggagnggggaggaaggcagagggggccgagggagcggncacanagaggaaaaggggcggggaggggggaggacaagaaggacaaagaaagagaaagnntggggaganggataacaagctcagctgtgtcagngatgtggaggggaggtatggtgggggaccagccatggccctatccaaccccaggcnccacaggccccaaattggcnttgcaaanccaaacantttaaggaagggggngagggagggaagagaaacacgggagagggctgtgctgtggattttcatctagggnggtgggaacaccagagatgtctcctctgccatt

SEQ ID NO: 709326 - DNA, 399 bp, Homo sapiens
gactatagaggatcgccaaacaccgcaatcttgtgtggctagccaatacaaggcttgtagtgggctaacgcagtggctcatgcctgtaatcccagcactttcggaggctaagtgcaagcggatcacctgaggtcaggagttcgagaccagcctgaccaacatggagaaaacccacgtctactaaaaatacaaaattagctgggtgtgggggcgcatgcctgtaatcccagctaatttatgtatttatagtaaagacggggtttctccatgatggtctcggaagtacctgacctcaggtgatcaaagaaccgcaaactcaagcacttgataagtccggagagcactttgtagctgtcttagaagtacagctctttgtagcctacagaaatggaagaagtg

SEQ ID NO: 709327 - DNA, 798 bp, Homo sapiens
ctgtagaatatctcatttatttttttcatatgactacatgctgaaataatatttggatatatgagttaaataaaatatataattaacattaattttatctgtttctttttcttttttaaaaaaagatatgactattagaaatttagaattacatatgtgtttgcattgtggctcatgtattatttctgtgggacagtcctgaattagagatgtgatcagatttaggttctatatttttggcaaaaacaattcataggtagttcttagattttctgtagcaatacattaggagatagagaatgtctagtgtctctcttgtgattttaagatgaaaagagattcaagtgtgtcagcctaatttctctattataaagtttcctttcagcctttattttttattttattttatttatttttacttttctttccccttagtctctgttaaggacatgccattcagccgtttttaacctaagaattttatcagccatttgaagaatctcatctatatctattattttattaagagttccagaatggtgatattctaattctaatattccttctgtatgtattagtggaaagaataattttcctcaactatctgattttcctgacatacagttggaggtggagcagatgattcttaatttattcacactttccgatgggtggggttcatgtccttaacatatatgggttggttatgggggtgacttttcactattataacgggaccctttttgcgggaacctttgccaggcgtaaaggcggttttggcacaacgttgaacgggta

SEQ ID NO: 709328 - DNA, 115 bp, Homo sapiens
cttggctaagccttttggaagttttccatcctccttccttccttatccttatgccttcgcattcccatcgatcaaactcttctaaaaatttacgaattatttgtggtcctccata

SEQ ID NO: 709329 - DNA, 193 bp, Homo sapiens
  misc_feature (94)..(94): n is a, c, g, or t
  misc_feature (181)..(181): n is a, c, g, or t
tgtgtgtggaagctatacaaggaaagctgaatccatatgtagacttcatgtttactagtactgctccaaatgtgcacaagccatgtgatatggnttgcctctgtgtccccacccaaatctcatgttgaaatgtaatccccaatgctggaggtgggacctggtgggaagattggatcatggnggagttttctca

SEQ ID NO: 709330 - DNA, 992 bp, Homo sapiens
  misc_feature (269)..(269): n is a, c, g, or t
agcggacgctctacatcctgtaacggaaacatggtcgcggcttgtgtggctgccgggcagcgcgtgccggagaatgaagccgcctaggcagcccccagcgtaccacaagcgggccgtcgcgtctactgtggggcggacactccaaccctcgacgctagaggtgacgcgccgatgctcgtacagaggaacgttcagacccggtgagggcaccaatcctcctaccataccgcgaatctagtggatgggacttggagtccatcgcatgcagngttctctcacgaaacttatcgtcggttaatgctggaatctatccagtgaataccgcaagtggaacgccgcgaagacattgctctgcgtgagcacctcactggaacttcttcgaatgattcactaatacgtgggcaaagagccaagatacgacatcactgtggtgtctcagaacggtgagtccattcgacttcgaccactagagttggcacggttgggctaatcaatagttcgttgatagacatatctggagatacacgtccatgtagactaatgaaatgccaactgtaagtagactatcaagtttatctgggcattataagggtagagcatccttgtacgatggtaacagtgggtttgtgatggataagataggtatcgcaaaggtgttgatgcgcattgtggtaccacttctcgatgatctacatcgataggtcagcttgaacatgaagctcattcagagaacaatgcatacggatactgactcctagaatgagtcgcaaagctatgtgttgtgaccaattttagaccgctcgttcgtaaacgaaagcgaagcaaggcttgaaacttgggatgacctatgggtcctagaaggaagttcccccaaatgtttctacattgcccgaaaattattgtgagagacgacagtggttcttggatgcagccggcctataggggagtcttcctttgggcgagcttcgggggtccggtctgtaggtgttgca

SEQ ID NO: 709331 - DNA, 600 bp, Homo sapiens
ggggaggcgcgtggggcttgaggccgagaacggccttgctgacatcatacatggagactttgtaccgtgtcccgttcttagtcgctcgaatgtcccaacctgtaagctcgaagaagccgtcctggttgcactatgccgtcggcaatgactgtggtagtgcttctggtaggtggtgtcttacttcctcatcaccaggaggaatagtttatggatggttattgtggaacctccaaagtgtcggttctatgactggatgaacatgggcatcagaggccagtagctttcttggcctacagagtatcatggacgtatatatgtctggaaggacttgcatccagcattcctattcaccagatgggaggtctaggtctcataattcctgaagcgatcgattgcaccaaatatcccatgaattcaatagattccttcttctggttcattgggattcgtctgtgttcctatggagttctgatcaatggctagagtattctatgagcaatgtaaatctgccgggctgatctgatgggttagagtgccttctgagaagaagtccaggggctacgtggattggctcctgtcaatgaagttccaaaggctgtc

SEQ ID NO: 709332 - DNA, 291 bp, Homo sapiens
actgtggtgtactgtgccatgtagttttagtgggttcagaatcagtagtgatctgcattatgccatagcctccgagttttagcagtaacggctgcagtactattgaacctgcactgggggcttctacattggcttttggaagtcaaagatggaggtcgtacagaggtatttttactatgaaggctataatgcatgctaatcatataaaacttgtttgatcaagagttggataaatgggtgggatcagtactggctacttcagcaagttagtgagcctgtggtgttttggct

SEQ ID NO: 709333 - DNA, 429 bp, Homo sapiens
  misc_feature (375)..(375): n is a, c, g, or t
gcaaggagatgtgcagtttctggagactgtgcattgaactaagtgttgctctgtcacagtgaaaagcaaaaccaggtggaactcagtcaatgccaccacagaaggagaatttagaccagccctagctagaagggaattccccatcctagtggttggaacttaagttcctgcaaatgctctggagacgatgaacatggggggcacgtgacctagtgagacaccaggtgggacagttaaaggagtgattgcaccacccttcattcaaccccagtctgggcagctcacataaacgaaagtgactccttccttctgcttgaggaaaaaagagggaagagtaaagaggactttgtcttgcatcctggatatcagctcagncacaacaggacagggcagagtcatgaggtctccgttcctgaccctagctccctg

SEQ ID NO: 709334 - DNA, 222 bp, Homo sapiens
agaatagtcttcaaatcattgaagtacttcttcgatcaccctctacgacgatgaagcaggtagaaaatcataggatgcagattgattatgtgttcatcactctgacgatgtaattcgtaggtcgtggctaacacttcccgttggccagcgtgaactcgccgggctggcaacctggaacaaaagtcctgatccagtagtcacacttctttttcctaaacagga

SEQ ID NO: 709335 - DNA, 152 bp, Homo sapiens
aagacgtctacctgcggaccagtaacctccaagaggcagatgtgattttccttgacacatgctctatcagggagaaggctgagcagaccatctggaaccgtttacatcagcttaaagccttgacaaattgaaggaggtgaaggagaaatctt

SEQ ID NO: 709336 - DNA, 403 bp, Homo sapiens
gccccgggatatgatgctgaggttctgatgcctgcacctttgcatccttttcccaaacagttcaattcatctcattacactgatctgagctggtttaacgtatctcttttctctaagaaaggctgttacaaagcgatagaggcaccttaatttagagtggtctatgttcaaaagccactacgtttccgtgtgtccacatttaagctcactgagctagagaaggcagctctccgtgtcagataaacataagaacgaggcattggggacagtctgggtgacttacatctaactgggccagaatcggggagaagattggagaactcgctgtcctctgcgggtgaggaggtcaaaggcggggtcttctttcatttctgtccctatgctgtaactccgtgttggggac

SEQ ID NO: 709337 - DNA, 258 bp, Homo sapiens
ccattgtctggtaccctctctatacaccaacccattacgtttacatcaatatgtttctttttatgtctacagaggtctggactcctgaaaaattatcccgtcaacaacacaaccaccgtgtaacctataaagattgtacatgtttcgatacataaaataaatgaaagtaaagaacgatacatatacatgaaaagaattttacggttcttgaaagagaacgatagtaacgaggaaaactttgttaagttaaaagtacag

SEQ ID NO: 709338 - DNA, 1234 bp, Homo sapiens
actatagcatggggatgttatatcagaagctgtaacaccaactggaaacacaccgggcaagggtctcccctgagggggcgacacatttcttgtacaaaagataataagcgggttacctcacctgtggggagaaagtggttgtgcccagagtgtgaccccccgggcgatgatggggtaaccgtttccccatggtgtcgcaaaagtgtgggggggcaacggcggggccctgaagttggtttacccgggcacgacgggggagttggtggtcccaccttcggggtgcgcccggggtggtgtggccaacccactcgcctccgcggatgtttccgcgagtagacatccccgtcacgcttttttgtaggaagatcccgggtggggcctctcttgaataggggctccttatgtggccccctcggggggagttaaaaccccggggcaaaccccgatcagcgccaaagggggtcccgcctcgtgggcaggataccaagtttggacaccacatgtcacagagctgttcccatatgggataccccaagttttcattacggcgatatgtgttgggaggcattttatagaataggggcccccggccaaatttcccctcaacggggctttggaaagagcgtgggccacacacaagaccccgtgcctcgaatatgaaggggattttctcgaaagttccctgggctcgcgagagtggaggggaaaagagctcttcacagcggtggtcccctcttcggtgggggaaaccctctgtttgcggggtttctttcacgaacacaggtggggaaaagggtaccaggagagtaatcacccaagtggcgcaaagcgcaccccttgggaggacccaacgtgtctcccggagttgaggccactctgagcccagtgtctctgcgccacttctcgaccttgtcaacagtgttgcggtcagaagaccagaggtcttgacattctaaggccacaggacatctactgagagttctcccatacacgtggacgagcccagttacccagcccagtggtccagtttccagagtccctcccccccacgatggcccccagtccgttgccagttgtggccccccttccccggtccctgtattttgttggcgtcttgatgaccccagttagtcctgccccgaagtccctgtagcacagcccccagacacccccccaagttcccccgtttgtgcaggccccaatatttccctgaaaaaaaagttttggccataga

SEQ ID NO: 709339 - DNA, 134 bp, Homo sapiens
gatcttggttctggagtcagcacctggccctggactgcagcaccatgaacagtggctggtgggcggcccttgtttgatgtcactgcagagccagaggaggctgtcgccggaaatccacctcccccacttcatct

SEQ ID NO: 709340 - DNA, 156 bp, Homo sapiens
  misc_feature (54)..(54): n is a, c, g, or t
ctctcggcttggactcgatcttccctggccccagcgttactgggactggattanttccctagttcggggtgaccttggcacctcaatggtttccgccgaacccatcggcccgcagattgcttctcgtcttgcggtgaccggctggttggttgggtt

SEQ ID NO: 709341 - DNA, 122 bp, Homo sapiens
cagtatgaaaagataaataggccaggcatggtggctcacgcctgtgatcccagcactttggcgaggccgaggtgggtggaccaccttgagatcatcgtgttcaatgaccacgcctgtaccaa

SEQ ID NO: 709342 - DNA, 112 bp, Homo sapiens
gctcggtaccctatgcattggtatcaaaacactggggcatgccagccacagtgctcattgcaaacatctaatgtgctggggactctctatgagtctgacctgcagtgcatgc

SEQ ID NO: 709343 - DNA, 608 bp, Homo sapiens
tggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaaaggattggctttggaggtctaagggggagggttgtccctccaggaattttcttttcaaaccggagatcatggtgcccacttacccggggcgggagagtgggttccaggtccctacaggagatagctttctttcccttactccctattctaacattttggctcgggggacggcctggccaattctctaagctgggtttaaaaggcacgggaatgtcctgtagagagagacctagatgaggtcatgcagtgtgaagaagactctgcggaaactgggaccgacctaggcagacaggaggagcccaaagacaggctgggtcagaccataaacactccaaagctgtcattcatggccctgcactgtggctatcg

SEQ ID NO: 709344 - DNA, 801 bp, Homo sapiens
ggtgtctgtgttcttcggctggtctctccatcgaggaaggaatggaggaagatgtctgaaggaagagactgtgcccagtgtcgtggctgggagatcccgggaccggatcctgtgtgctcgtgcggactgtaggagcttcaatccgtaaagaatgtgaagcagttgtagcgtggacgagtgatgcagcaatcactgcactggcaacgcgcagctggaacattgcctggcagggcagtgtgacatggcaaaatacttcacgcctggaacacccaacagcgtagtgaatgtcggtgacgagtgacatgctttcaagggcgagcgcaaccactgcgagtgcaatggaagcactcgcgggccgtgatgtggcagagtaaggtacagtgccatggagtgcccattggaagagatggtagtgtcggagccggatgtagaacgcagaagcgtcacgcctgctacgggcgctggcccgtcagtgtacctcagcgtctctcaatgcatgcgagagagcacgaggtgcagaagacaacccgactaaagtcgtcttctctgactcctctgtgtggaatgctgcttggcaggcttgtaacctgagggtgtcctaaatctatcgctcaagtcagctgcatgcgcttgctattggtcccctggcgccaaggctccgtcggtggagacagaacttcccggatcatcgccatccaccggggcatggcccaggaggagcgcctgtcaacgctatcagcagttcaaggatttccagcggcggatccgtggtggcaccaatctgtttgtgccgggggatgg

SEQ ID NO: 709345 - DNA, 877 bp, Homo sapiens
gggtggcctggggcacccagcgcaatgtgcttagaatttggtcaccactccgtcatcctgaagcttccctctactggtgtcttgttgacaagagtctctagccagatccaccagaactctctcgtccttcctttcccacacatgtgagcttcgtcatgcattctggcagtatgatatggaaccatttctgttgtaaccacccgaactagtttaattctccaggagataggacgtcgcgattatcgttgggtgtatatccacagagccggattgctttcagattgaatcttacgtacgatcttcccatagtggcatgagcattataggatgaatgacacaattgcgattcttaaaacgtggctaggtggcaaattctcatgtttgaactttctatgaagattgtaataggaactggtaatttctcatagagcactggaatcagcatttcaggttatattgatcagacaaagtgaaatctgatggagtatggatatattcgtggaatggatcttttatgactaaaagaataccttacgctaatatccatataccttcttctgtatcaatttgagaattccgatctgtgttgtcctaatctggacgttgggctccattgaacatagcaggtattcaattggcagaattgaggacttgccgggctactctgattggggttacgacgctgccgtttcgcaagcaagacaactccagtgggaataactcggggcttttgctcccctgtcgactgaacgttttaaccacggcttgtacccaatcctcttagtatgcacaatgttcttacagcagaccttgaccgagcaagggagttaacagaggacgcctatctagctggaacaccacacccaggggaaagcgg

SEQ ID NO: 709346 - DNA, 494 bp, Homo sapiens
  misc_feature (116)..(116): n is a, c, g, or t
  misc_feature (148)..(148): n is a, c, g, or t
aggaaatggggcgcccgcattccccccgggcccttttttttttccccccttgggccccccaggggcaaggggggggttttccttaacccgccgggaggggggtttttatttggggngggcccttgggtccccaatggggttcctttangaagaacccccccgaattttgtttttgccccttccccccaaatgggattcggcaggggtaaaatccccaaccttttttttggtggttttttccaaaaagaaaaaggtgggggggcccccccccccggggggggggttttttccccccaaaaaaaagaaattttggttttgggggcggggccagtttgttccgaaaggggggggctcccaatttttccccaaaatcaaaggttttcctcgggtccgggggcccccggggttggggtttgttttgggggaggggttttttcccccccaatgggggtttttaatttttttaggccccttttttaaaaggggggccccca

SEQ ID NO: 709347 - DNA, 161 bp, Homo sapiens
gcaccagttccgtgccgacaagaggaaaagggccgctgccatggcattagtgacctagcaactggagaacgctggaggtgcagacaatgggcaggagaacgtggtatcagcggaaggctgaggacaggacctgggactcaaaggccaggttcacagtgtgg

SEQ ID NO: 709348 - DNA, 1430 bp, Homo sapiens
cccgctccaagcgccgaatctagggcaccgcgcacaccagcatggcacgctcgccgcgtgccgcagaaagcatctccagcagtaacagcaagcaacttcaacagcaacattccagcatcatgtgcacagtagcatttcccatggcacacaccgtcggtcatccctctgcatgaccacgttgtgcacagcattggccttctagcatacatattattgcacacacaccaccgcaggctagccagtaccagttccgtggcaagcgctagtcaggcaccccgccagccacgtcgccaggccacctcttgcggcaccctctaccagggctgtgctgcatcgcacagttctcccagcagccggcagctcaacccagggcgcagcccaaccagaaccagacaacacagccagcagtacccgcacagcccctcacagcagcacatatctacgtggcacctgcatatcccacacctcccgcatatccagcacagcatgcacacagtcggcacatcgcacatctctcgtcttgggccacgcacactatgtgggctttctacacacatcccatcacacaggccacaccacaccagacaagccccaatgcgtatggcccagaaaaaataccatggtcctcgcacattctcagcacacacgctataccccttggcctacaggtatacccgctgcgcacaagcaacatcccccacgtcaccccaaggggccttcctgaacgtcacacgacagtgcaacgcgaaggaaccctcgcagcgaacagcggccgtgtcaccatcacccccgggaatcggcacggcgtacccaagcggcacgcacacacgcccctacgcacaccggcgccagctcagcctccggtacgctcactataccccacggtcccaacggggctcccaccgggaactacaccctccgcgacgtatccccattcggcaacaggccttccgtaacccccactcagagcaacgcgcacgcgacagcgaacggaggaacagcacgcggcactacagggataccccatcgctacgcccgacgacagggaacgaccggccgcggaaaggaccagcgcaggcaaatcgccaccacacaccgccacccggcaacgcactggcaccctggccaccgccacacgcaccgcaccacactcacaagaaacagcaactccccgacggaaccacttcaccgcgacgaaatatacaaatacgggcaccacgcgacgcacagcccaacaatcaccgcacgcggcagggcgagcgcacccaacgcgacctgaagcacacaaacgacggaaaaaagaacacacaaacaggatccgtccagcaaacacaaccagcacacccactaccccccgacaaaatatatggacaaccagaacacaccggcacaaaccaccacacccgcgcggaggcacgaaggcaagaact

SEQ ID NO: 709349 - DNA, 291 bp, Homo sapiens
ccgagtagctgggattacagatgtctaccacacgccggctaatttttctatttttagtagagacaggtttcgccatgtggccagactggtcttgaactcctgacctcaggtgatccacccgcctcggcttcctaaagtgctgggattacaggcatgagccactgtgcctggccaaagggaaggtttgcactagtgtagtatggggtattctaaccaaaatggtagagtggccaaatagggaatttcatatccaaatgtgacatgactgcacatgggtggtcttgcactctg

SEQ ID NO: 709350 - DNA, 1006 bp, Homo sapiens
acgaggattcaggggttaactggaatcacagaaatgatattctgcaagaatttcttttaaataaaaagtttgggggtgcaatataagaagtttatataatatgcagtacattatccaaaagagacaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatatcctaacagaggtattaaaggctagcctaccagttgtctgaacaagatagaatcagtaatgtaatggcactgggcactttaacacgtcttagcatttccagtcgtccatgtggcattaaacgatacaaaagaccctggcaatttatttcacatacttgaatccctaaatgcacctgtctttcactttttgagacagactgaatatatctaaacatttccagcaataacaaaaaaagcatttaactttgcaccaagcaagaaactatacatacagttaactgcattcagatactcacgttaaacatggttactatgcagcacagaacttcatcgctatagtatactggggtcacccttttgaatccatatcaaccactgattcacatacactgcactcacagaccctctgcaaggccattcccgctcgcgctcgaacggctctacacctcacctaccacctggccaaccgtgacacgccaacatccaccccgcactcgacgcaaggcagtggaacaccacacgcggcaccacctcataatttccaccaacactcaaacacgacaaaacaccccccccccctacacctccacacccgtcagctacaaacaacgtactgaaacgaggaagcaaaagaccaccaccacgacatgacaaacccacgcacccaaggctacagacacaagcactcccacgcacaccacaaaccacacacgcccactcc

SEQ ID NO: 709351 - DNA, 311 bp, Homo sapiens
gatagtatacgtctttctgtagtttcagcatcagcatcctgaaatcactttatgtgaagttagggagcttggaatactgtaagtgattccatgagtaaatgtgatgagcttgtcactaaaattattagtggtaattccatgtcattgattatgggtcattaggtttaaggttgattaaattcagttctgagcctactccagatgctggctcaagtcaaattcttcccctgtttgaaagttgatctaacccacctgattaagcaagatggtatatacccttttaattatattctattaagcattctttagct

SEQ ID NO: 709352 - DNA, 286 bp, Homo sapiens
gcggagtacccaccactcctatagatcagtttcactttatttctttattattgagacggagtttcgctcttattgcccaggctggagcgcaatggcatgatctcagctcaccgcaacctctgccttccgggttcaagtaattctcccgactcagcctcccgagtagctgggattacaggtgtgcaaccaccccctggctaattttttttttttttatcgtagcacatggagtctcacacctgcatccactgatctcataggcagtggttgggggcatccgtctacc

SEQ ID NO: 709353 - DNA, 170 bp, Homo sapiens
ttcggcgtttgtgatggagctgtcgcatcattcctgcccccactgtgagatgagcattagcagaaggagctcgatttgctggaaccacaggtggtggaggccctggctgggggctgggtgcttagtaggcggcatgtgttcttggcgctggagtctgaaggcagtctgga

SEQ ID NO: 709354 - DNA, 1102 bp, Homo sapiens
cgcagcgaaaatggcggcttccaggtgggcgcgcaaggaccagtggtcctgctttgtgcctctgacctgctgctagctgctgctactgctaccaccagcctgggtccatgcgcaggccagaaggactcgcccggcgacgcccgcacgagtcataccaccacactccaccggaagcaagaacgaaggatattcagcgcacttacaagtgatgcacgacatggccgacagtccttcactggcacgcaaagtagggcacgacaagaatgactgacccacttgacaccacacggacgaatcgtctcacagcgacgcacacaagcacgacccatctcaggacaccacatgcatcgaagccttgtcaatcgacaacagcacctagcagcccccacaagaccacaggccccgctgccacaacgcccctacgttgcgcagaacaacctgcacctgcagacgaacacacgagcgcacacgccccatccatccgcctggcaacatggtctacacgatccgaaccacatggcgtcagttccacccgcggcacactgcctccccgatacagcagatgcaccgcaaccaggcggccagcagcaaagcaaggcggacacaaccaccgcaccccgcgaacggacccagtccactgggccaccacggcggggacgacagtccccgatcagcgccctccctcgacacgattgccagccccacaaacagctaagtttggcaataccagggttcatcccacatcgcacacggacgccctcgtccacaactctgtgggccctggaccagcgaaacacttccacacgtccactcccctggcgctaggccccgtatagcgtccgcagcctccaaggctgcgcgcctcacctgtccaggctcgatgaacagcatgtgcacgcgaaacgcacgattagacaccgagacccgtccccaggggagacaccctagcaactccccggactatgggcaacacgacctctcatgctgagcacaccggcgggactaccgagcggatctccccccacaatggcaaccctccccgtcgatccatcggtctaggcccccaaggaacacattcgactttccacgctcctcctccttg

SEQ ID NO: 709355 - DNA, 156 bp, Homo sapiens
  misc_feature (11)..(11): n is a, c, g, or t
  misc_feature (54)..(54): n is a, c, g, or t
  misc_feature (63)..(63): n is a, c, g, or t
  misc_feature (105)..(105): n is a, c, g, or t
gggaaacagancccaaaaaagagaatacaggtggggaggagggtgtggcaaatntgtcaaaantaggaagcaatagaaaaggagctcagtgggtagaaggctaanagatacaggtggcaagcagtctgtttcagactactttagcacacattaggc

SEQ ID NO: 709356 - DNA, 115 bp, Homo sapiens
acagagcatgccgatgtagcggtgcgctcgacaccttgtaatccccgcaactttgggatgccaacgacggcgtcagattatctgacgctcgggatattcgaggacctagcctgca

SEQ ID NO: 709357 - DNA, 226 bp, Homo sapiens
gaccggttgacgtggcttccaaggggctagccaatccctcaatgggaccagtccagaagtggaatattatgatggcttcccctaccaagttgtgccacatgtctctgatttcaaagccaatctgtctcctcatatctccgtacttagtttaaggatatttgggctactacttgcgctacttgaaaaattctccagttgcagggactcttgagtaaggaaagcaaca

SEQ ID NO: 709358 - DNA, 595 bp, Homo sapiens
  misc_feature (30)..(30): n is a, c, g, or t
  misc_feature (98)..(98): n is a, c, g, or t
  misc_feature (145)..(145): n is a, c, g, or t
  misc_feature (178)..(178): n is a, c, g, or t
  misc_feature (201)..(201): n is a, c, g, or t
  misc_feature (207)..(207): n is a, c, g, or t
  misc_feature (229)..(229): n is a, c, g, or t
  misc_feature (267)..(267): n is a, c, g, or t
  misc_feature (298)..(298): n is a, c, g, or t
  misc_feature (303)..(303): n is a, c, g, or t
  misc_feature (312)..(312): n is a, c, g, or t
  misc_feature (315)..(315): n is a, c, g, or t
  misc_feature (328)..(328): n is a, c, g, or t
  misc_feature (339)..(339): n is a, c, g, or t
  misc_feature (341)..(341): n is a, c, g, or t
  misc_feature (352)..(352): n is a, c, g, or t
  misc_feature (360)..(360): n is a, c, g, or t
  misc_feature (379)..(379): n is a, c, g, or t
  misc_feature (387)..(387): n is a, c, g, or t
  misc_feature (391)..(392): n is a, c, g, or t
  misc_feature (405)..(405): n is a, c, g, or t
  misc_feature (407)..(408): n is a, c, g, or t
  misc_feature (420)..(422): n is a, c, g, or t
  misc_feature (432)..(433): n is a, c, g, or t
  misc_feature (466)..(466): n is a, c, g, or t
  misc_feature (522)..(522): n is a, c, g, or t
  misc_feature (525)..(525): n is a, c, g, or t
  misc_feature (534)..(535): n is a, c, g, or t
  misc_feature (590)..(590): n is a, c, g, or t
tttcctgcatcccagtccaaaacattgtanaagtttccttttttctccttggggttgacctaatacttttttgtttttttcagaatctgtttcccccngcgctggtcaatgtactagtagctttccccagggtttttttttactnttcctagggggttttatcatgaataaaaaagcncccaactcttttcagccattgcngattcncatttttcttaatattcctgtncaagatgctctggggaactgttaagaactacaaaatcnccttgggcggggttttgaatgggttattttntttcncgttggccnagntctcccttttgtnggccttgccangnccctgcccttntctggggntggaaaaaatgtggtcttngtggcccncttnntgggtggcggggngnntttccctttccnnnaatgtcccgnntatcatagtggttagtttttcgttaagcggtgngtgttggaactccccttttgggggggaatagcgacagggggcgcactaggtgctanatntaccaaagnnaaacaagtttacaaattttccacctgtctgttttctctccctctcaaatggtttnacccc

SEQ ID NO: 709359 - DNA, 5144 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709360 - DNA, 5199 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709361 - DNA, 197 bp, Homo sapiens
  misc_feature (8)..(8): n is a, c, g, or t
  misc_feature (97)..(97): n is a, c, g, or t
  misc_feature (114)..(114): n is a, c, g, or t
  misc_feature (136)..(136): n is a, c, g, or t
  misc_feature (148)..(148): n is a, c, g, or t
  misc_feature (166)..(166): n is a, c, g, or t
ttcggcanaggttcaagctgagaaaaaaagaacatggttctatttacaatagctacaaacaaaaaaatatgtacctagtaatacattaaatcaaggnggtaaaatatctctacnatgcttgctacaaaactgctgncagaaaactagnagacaacgcaaataagtnaaaagggcactcccatggctcatgaatttta

SEQ ID NO: 709362 - DNA, 159 bp, Homo sapiens
ttaaaggggaccagatctttaaacatgcatagccgtacagttccgagaatggtgctcctcgctcttcttccaatgccgtggactagataggtgcccacgttcactaaaaaatctacatcaatgtccccggagccaggagaacgcgtctaaaatcggggc

SEQ ID NO: 709363 - DNA, 5427 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcgtgtgtgaggggtgaccttggccggggcgggcatgctgggcaggcaggcttgtccctcaacaccactgtgctgtcatctccagttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709364 - DNA, 4699 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709365 - DNA, 5106 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtccttcctctcaatttgttgtcagtgaaattccaataaatgggatttgctctctgca

SEQ ID NO: 709366 - DNA, 473 bp, Homo sapiens
tcccctttcggattcccgacgctgtggttgctgtaaggggtcctccctgcgccacacggccgtcgccatggtgaagctgagcaaagaggccaagcaaaaactacagcagctcttcaaggggagccagtttgccattcgctggggctttactcccttctgttgtgattacacctgggatttaagaggggtgcagacttcccggaaatgcctgaaccaactgttttgagcctacttgggggataaaggattattgggtcttctggatttggaggcaatcagcggacagcatgtggaagatgtgtgcctctggcctcggaataagagagtgggacactcattcagctcactagtttggattggcccaaggctcttcacagacgcattctgtagcagaggtggactcttgtactacccttatgatagaattgttctcagaattaaagtgtttattaccagctgtttacaaaaaacaa

SEQ ID NO: 709367 - DNA, 3721 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709368 - DNA, 1855 bp, Homo sapiens
  misc_feature (8)..(8): n is a, c, g, or t
gccccgcngcggtcttccgagccgcaggcgcaggcccagctgagcggccgccgagcgggtgcgggtgcgggcgcatcggccatcaccgcgcggccgcgcagcggacaccgtgcgtaccggcctgcggcgcccggccaccggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709369 - DNA, 1967 bp, Homo sapiens
  misc_feature (8)..(8): n is a, c, g, or t
gccccgcngcggtcttccgagccgcaggcgcaggcccagctgagcggccgccgagcgggtgcgggtgcgggcgcatcggccatcaccgcgcggccgcgcagcggacaccgtgcgtaccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709370 - DNA, 381 bp, Homo sapiens
  misc_feature (210)..(210): n is a, c, g, or t
tgctgttctatgagtgatctcctctggatgcaaaatgtcataacgacaatggctgcggggagggcagtgactcaaaggcccgctaaagggctaagccttcacccttgcaggtctatagtatagtcatggatgggctttaagtggatcatcatggacatgagctggatccgtggtggtttggatggagggacttggtagtgaggagtggancatgtggtgatgtgtgttggtgtgctccatccataagaaactctcccattcatctccttcacatccatgtggaccaatctatggttagcctggaagactgattgaagactactggcacactttgaagcattctagatagtacacgcccaatgaagacattgatgctggaaa

SEQ ID NO: 709371 - DNA, 1977 bp, Homo sapiens
ccaccccggagccaggggccgttgggccctgttgttgggctcgcgggggtgggggggctcgggcctttgttggtcacagatggcccggggatttcctgggatagaaatagccgccggctccggccccttaaagctgcttaaggggcgggatgcggaggggagggtccgggcacaccccacacgtccccggccgagaccccagcctccgcgctgagctcccacccgggagacgccggcagcggcgcaggcctccggttgcttggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709372 - DNA, 1653 bp, Homo sapiens
  misc_feature (8)..(8): n is a, c, g, or t
gccccgcngcggtcttccgagccgcaggcgcaggcccagctgagcggccgccgagcgggtgcgggtgcgggcgcatcggccatcaccgcgcggccgcgcagcggacaccgtgcgtaccggcctgcggcgcccggccaccggggcggaccgcggaacccgaggccatgtcccatgaaaagagttttttggtgtctggggacaactatcctccccccaaccctggatatccgggggggccccagccacccatgcccccctatgctcagcctccctaccctggggccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709373 - DNA, 1073 bp, Homo sapiens
gcgcccgaagccgtcgcggtcggggaccatgttgcttccgaacgatcctgctcaccggtacatccgaggggttggaaagaacgcacattaggcaaagaacttgcgtcaaaatcaggtactgaatatacacttaactgtgggtgattttagctcgagaagtctgatcagtcggatatcatggatgttctggcaagcacggcttctcccaagaagcagtgtcctgaaaggatgcagcagatgatggcacaaatcctgaaggatatggggattacagaatatgagccaatgagttatagatagtcagatgttggagtttgccgttcgcgatatgtgagcgacaattctggatgatgcggaaatagtttattcgagagctcgagtgcataagaaagctacgtggttgatgcaggatgatgtgcgattgggaatccagtgccgggctgatctagtcttttaccatctcctcccccaagagattcttgattagatattgcaaggcatagtgaaatcaaatcgcgctttgccagttgatcgaagccagtattcacggtccgtaggttggcagctgatagatactggcttaacgagctccaaacgtataggctgaaagtctttacagaaagaaggcatccaggcttctgcgggcagaattaacagtgcccggcgggttacgtgttgggttcagttactagcagaccaggtactcccacagtaggcacggccaatcccacagaccatgtctgggttgcactacaagttgggactccccatggtcctcaaagggtcaacgggttcgagttaaggatggctactgtccacctccagtgttaaaggttcattctggcactccaggattccaagggcgataaccacctatggggccagcatttttgccccatgtgtgttgacaaagtgggggaaattaaggtgtagaaaagggggtaaattaaagcaggagtgaaaaaaggtataccgagagaaattagagaaatagaaaaaaagtggaagtgataaaaggaacaacagggatgaatgaaaaaagaagagggagaggaggtggatgttgtttgatt

SEQ ID NO: 709374 - DNA, 947 bp, Homo sapiens
ccgtcctccagccccgccggcacgcccgagcccggcttatcgccaacgggcccctggccgactcgcaccgcggcgcgccgctaccggtgccctggcagggtcaagacgcaagggctctagaagacccgtggaacaagcacacgcaacggagaacaagatccggccccgagcgctacaacatcgccggtgcgctagaggccgcggacaaggccaagatgcgcaacctggagacgcagcacaaggtcctaggagctgcacgggctcgaggactgagcggcctgcagaagaaggtgggacgcatcgcgtcgcgactgagcgtcacgcaccctgcggaacagtgctcaagcagctgcccgagcccctgctcgccgtccatccggccactgctagcgcggcccccgagcgcgtcccccgtgccggccggggcagagactccggggagcgcccgcgcccgcgccctcgcgccccgcgccccaggccggcgccggcaaaacgtttggcaactggggcacttggcagcgcggggagcccgtgcggtaattgtaatatgtcttatctagacatgatacatcgacaaggtgcgtccaaaccaaccgcacatgcagatggggctcccgcccgtggtcgttattctacaagaagaaacgtctatgtgtacagatgacatgatacaactctctggctgtgctccctcagcccctctccaggcgaccggcgggcgggaccggtttacgaagttgatgcaatcacggtattaaacatggcggaacgcgtgtgtacatcgggactaacgcaacccacgtgtaactgtcagccggggccactgagtaatcgcttaaaagatgttcctacggggcttgtagctgtagatgttttgtatttagttttagttttttagtctttttctgcgtacttagataaaatgatctagtttctatgagaaaaga

SEQ ID NO: 709375 - DNA, 920 bp, Homo sapiens
gcctttctccgtgcaagggccgtccccgtcctcctccccagccatgggtcacgtcgcggcttctgctacatggtggggctgtgtcatgccgcgctcatcttcttcgccattgtggccacattatacgcattgatgagctgaagactgattacaagaatcttatagaccagtgtaatacccctgaatcccgtatatgagtagaccagtgatgagtggccaggactctagtgaccctaaaaccatcatgaatgcaggatatctaggcatgttgtcagacggaccggctggtgcaaatagcttaaatcttctagcaattttttactaacctatatgggatgactctattgtcgggaggagcctcttaagacacaacacacagaagaatgtgtccagttaattgcttgcaaaaaagccaccaaatgaggggatcttatccagcaagatctgtcaagagttagctgtgcaatctgctcagttcttacaaaatgatccttatttttacatgttccacattttggctggtgcacagacttgttcatattgttatactcagataaggtttaaagtgctataacgtataactcactatcacagtgattccctctggtgttgcacacggtttggaacgtgggcccttttaagtgaacagccaataagtcctctggaatgatgcattaataccgggcggtctagtacctggagctgtggttctagcacctgtgagcgccatcggtcgatggaaccggtcttattataaccaagcggaaatacgggcccgtgggacgcaaagtttgcctgggcacacacgggcccactagggcgagtattggtctaccacaacaggcgcccgtggatatccgatggtaggcgcctcaccacaatgtgtttctagtagcacatatggagactatgtatcgagg

SEQ ID NO: 709376 - DNA, 1302 bp, Homo sapiens
cctgccgccgccatcctgccgccgcagccagcttcctgccgccgcaggacctggcccctgccccagcctccgcagcctgcggcgcgtccacgccctgccctgctgcccatgggctgatgtctggggtctgcctgccttgcactgcttctcatgtgttcccctgctgcccctgcattgtaaccctggccattggcccccggcaacatgtgtcctcctgcagctcgcaggcacgggcatagacaacatataactacacagaatcacacgaagagacccacaacatcctccaagcacatgaaaacagtacacaaatgacttggtacttaatagacataaagaagcgaaaaaatagaaagacaatgatgaaaccactaccatgacaaaaactcaaacaagaagcgaggcacatccggataaatcactaaaaacaataaaacgagaagacaacccaacccaataggccacaaaaataacacacataaaaaactggcaagagaaaaacaaacatagacagggcaatgaagacaaaacagagagggcatacaccgaaagaaaaaccaaacgggacagaaacaacacagagagcagaccctctaaacagagcgaaaaagaaacagacacaaaaaaaacgagaccacagcaggaccaaacaaaaaaaacagaacagagcaaaaaccaccccgtgaaagagaaaaaaacaacaaaaaaaacacaaaacaataacaaacaacaaagaaaagaacaacaaaaaaaaacaaaagatgcaaaaacccacaacaaggaaagagaaaaaaaaaagagaaagaaaaacgagagaacagaaacacacaagacgaaaaaacagacaacacagaagaaacaagactacaagaaagcacataggaaggagaaatccacagaagaaaaaacaaggcgacaaagacgagacgcgatgacacagagaagaaaacaccaaataaacaaaccaaagcagcacacaaacaaaacaccagaaaccagagacaacaaaaaaagaaaacaaacataagaacacaagacaacgaaaaccaaacgacaccagagaaaagaaaaaaagcaaaccacaaagacacaagagcaagacaaaaaacaccaccaatgatagtaacacacagaaaaccaacaaaaccaaagaaacacaaaaagaaaacacaaaagagacaacacaacaaagaaacgacaaataaaacaaaaaaaaaccaaccaagaaaaacaaaaaacgaaaaaaaaagagagaacaacaacaataacaaaaggggaaaaaacaatagacaacacaagagc

SEQ ID NO: 709377 - DNA, 366 bp, Homo sapiens
cccacttggttgacaggctggtctcatgctcctgggctcagaaatctcctgctcagcctccaaagtgctgagatcacaggcatgagccactgcagccaggctcagtaaatttttatattaaatcgggcaccagaacaaattttggagtaaaatacaaaattcataccatttcctatataagataggagcctacagacatgttgatccctggacatactgtgttcttcatctaacattagaagtctggcgtcaaagtgtattaagtacaccaacctcaaggaagaaagatcgggatccttgcaaaaaatccctttgtaacagcttcagtgacactaggactaccttctctgcttacaggccactgga

SEQ ID NO: 709378 - DNA, 124 bp, Homo sapiens
  misc_feature (66)..(66): n is a, c, g, or t
ggaacacaggtgtcgtgaaaactacccctaaaagccaaatgggaaggaagactcatatcaccatgnccgtcattggccacgtagattcggccaatgcccacctctctctggccaatctatctct

SEQ ID NO: 709379 - DNA, 172 bp, Homo sapiens
catcaagcacatggaggtggatgtttaccgcgtgttatataacttgctggctccttcactgaacatgcctagtccaacatttttgccagagtattatataggtggaatcgtttactacatgagagttgggtataacttcttttcatttatcatgatgattgtgagacttatg

SEQ ID NO: 709380 - DNA, 175 bp, Homo sapiens
cccccccccccccccccccccttgggggtttcccccttggggcccacgggggggggggtttttccccctttttgccccccgggggggaagggggggggtttttttgggggggggggggccccccccccccttttttgggggggggattcccccaaaggggggtttttttttttta

SEQ ID NO: 709381 - DNA, 205 bp, Homo sapiens
  misc_feature (147)..(147): n is a, c, g, or t
agcaagcggctgctgtgaaccgctcgctgcatggtgctgcctcatctctgcggcacattcgcctgcttccttccccacgcgccggtcttctctccgtcagaagcagcctggtcactccatcgcccggggtgctaccagagctctacnttcagtaatcatccgtcactagcttgtttccctgtggtgacataacccgttcgctatc

SEQ ID NO: 709382 - DNA, 196 bp, Homo sapiens
gttgcgaatacctcctcctcctaccagtggaatcctgactgtttaattaaacaaagcatcgcgaaggccgtgtgggtgttgacgcgatgtgatttcttgcccagtgctctggaatggtcaacggtgaagaaattcaatgaagcggcgggtaaacggcgggagtaacttattgactctcttaaaggtagccaaaatt

SEQ ID NO: 709383 - DNA, 124 bp, Homo sapiens
gccccccccccccctgggcccctggggggttgggttccccctttcctttttggtccgggccaagggggggggttttttaggggggggggggttttttcctttaaaaaaccccggggcccgttga

SEQ ID NO: 709384 - DNA, 223 bp, Homo sapiens
aggcctgttctgctaagccacaaaggttggaagggaaagttctagggaccgcagcgtcactacactctggacaggtgctgatacaggcgaagcacgccgatccagacaaaaggggggaggtttccatggaacacccaggggtggcatgggctcgggaacctaggctcgacttagatgtttgtggccattgtgatcagaggttttaaatgcttagccttccgag

SEQ ID NO: 709385 - DNA, 131 bp, Homo sapiens
gggagttggaggttgcagtgagccgagatcgcgccactgcattccagcctgggcaacagagcaagactccatctcaattaaaaaaaaccaacaaaaaaacacgtttccgtgagctgtgtagacagatgagg

SEQ ID NO: 709386 - DNA, 902 bp, Homo sapiens
gcggcgccgggagcgctcttcgcttccctcgggtcttgctcgtacctcgtccagcgtctggatccccaggactcgtgcgtgcagcatgggctggcgtcggggagccgtggaccgcgtggagggacccgtgcagccgggggcaccgctgcccaccttctgctggtgagcagatccgacgcgcacgaccagcccggcgacaagtggctgtcatcgagcgccgcgtctacgacatcagccgctgggcacatgcggcacccagggggcagccgcctcatcggccaccaggggctgagggacgccacgggattgccttccgtgccttccatcaagatctcaattttgtagcgcaagttcctacagggccctgtagattggagagctggctccggaagaacccaggccaggatggagcccgtgaatgcgcaggcttggtcgaaggacttaccgagcccttgcaccaggcacaggccgaggacattgaaggctgtttgatgccagttcgcaccttctatgctttcctactggggccacgatcctggccatgggcggtgctggcctggctccttatctaggctcctgggtccttggctgggtgcccagtgccctgggcggcttcatacctggccatcgtctcagggctccagtaccttggttgtctgcaggcatgacctgggccagtggctccatcttcaagaagtccttggttgaaagcgacggtggggccagaagggttcgggtggactgggggggcagcttagaagggtggcgttaagaccggacgccagtagggatgggaaagttccaggcaagtttacagaggcaaccaggccgagggcccaaaggagtcgtaccaggcaaaggggacccaggatgataaggatgggcggccggcgttcgttctg

SEQ ID NO: 709387 - DNA, 473 bp, Homo sapiens
gacactagagggacaggaagaggctttccaagagtaggggaacagcatagtacaaaaggcagggaggcctctacaacagtaagtagtaacagtaagactagagtatggattatatatagaaaagtatactaaaatcaagatcaaaaaggaaagttgacagcagagaatgaagggcctagaatatcaggcagagaaatatggaaatggacaggccactaagggaacaacaccgtaactatctcagcagggcgccagatattcctaggagtagtatgatataccctgcagagtgtcacaagggatgaaagtaacacaacaggcctattgaggaaggcaatgagacccaggcttaagaacgaatggctttgaggcataatctaggggtcggagaggaacagagagtggagaacaagacgttactagacttccaggaatattacaagccttctaatatacctgctaccaatgtctcc

SEQ ID NO: 709388 - DNA, 109 bp, Homo sapiens
gaacattgagtgctttgctctcctggtgtcaccttcataataataattcaactttggtcaataaataaacactcttctgggtacaggtggcacattaagagtattagct

SEQ ID NO: 709389 - DNA, 956 bp, Homo sapiens
gacgagcacatgagcgcgatggttcatcagattgccactgcgtcgagtgtcgtgtacagtgctcgtggcagacgacgatggatcaatgtgaggaacgatgcatcctgccttggaaggtatgcggtgccgaagtcatgtcgcgaaggatagacccgggctatgctaactgggagaactgagcatctgctcgggactgactgttgtggcacgttgtgcatttacctgtaaccttttcccaccatccgagtcacacagacgaggttctgtcctggctgaattaccatatgaaacatagtatggccattatttgctggtgcgactcacacattgatggatcgaacaaagtacttctatggaccccttaaatgattgtttgtgcttagggaaacattgttgccctgctgagtgcttgaaggccttcggaatgagaggtggtataatcagaggtgtgatgggatgatactcgaaagggtctccaaggattgggctgtgaacaaagtcgttggtcggtaattctaacaggtatcaatacctagctatagtttctctggggaggggtctgggcctaaattcggagtttgtggcatcatttcgggtgtaaggcaggttgtggttgggggactttacttctcaacttgctgttcctgttagtgcgcaatgatttaaatgttataagttccaaaggtgtaccaagagataatggtgtaaggtagacaacatacctattaatgtttttttgccatcctggataattgagaagaagtaacttccaggtaactattaggtttttaaaacttggcggaaataaggtttaattaaaaaaaggattattgtatgtatgacccttgggctttactgaggttataggatagaggaaggacttcattttgtgaagaacccttaaagttggagaaattttgggttggttcgttggcgtggttttcggtggcccacaa

SEQ ID NO: 709390 - DNA, 370 bp, Homo sapiens
gggcctggtccggcgccccccgcagcccatggctctccgcaacgacctaggctccaacatcaacgtactgaagaccctgaacctccggtttcgctgcttcctagccaaggtgcacgagctagaaagtcgaaatcggctgctggagaaacagctgcagcaggctctagaggagggtaagcagggcaggcggggcctggcccgccgtgaccaggcggtacagaccggcttcatcagcccgatccggcccctggggctgcccctgagctcccggccggccgccgtgtgccccccatcagcgcgggtgctgggctcgccctcccgctcgccagctggacccttagcatcctctgccgcctgccacacatcatcc

SEQ ID NO: 709391 - DNA, 176 bp, Homo sapiens
  misc_feature (133)..(133): n is a, c, g, or t
agccggtaataaataagaacagcaaataatgaaaacttatgtaggcaaatgttactgaatcagaaagaaaagtggctctttagcatagaactgttatttataatgctgataggcaaggctcatgggtaaatcncatgggtaatagagaaacatggagagaagccacacaaaactct

SEQ ID NO: 709392 - DNA, 417 bp, Homo sapiens
  misc_feature (17)..(17): n is a, c, g, or t
  misc_feature (97)..(97): n is a, c, g, or t
  misc_feature (147)..(147): n is a, c, g, or t
  misc_feature (228)..(228): n is a, c, g, or t
  misc_feature (383)..(383): n is a, c, g, or t
  misc_feature (407)..(407): n is a, c, g, or t
  misc_feature (411)..(411): n is a, c, g, or t
ccctgagggtgcccccnagtgatataacatatgagggaaaagcagaaacaacctaagaaatagactcctgaatgtgggcagattcctagaactgagnaatgcaagaacagccctaataagctgtgtgactaatcactgcatgaaacnggagggagagagttgtgcagcttcccaagaaccttccttaagagattatgtcagttcaccccttgccttcttcttcttcantccttcctccatcctgctgactagaatgaagagatgttgtcatcttggaccatgaggtcaaggccatgagttgaccaacaggatgtaaatgtcatgagggcagggattttgtctgttccccattccccagctgctgtgaccccaatgcctagtcnggtgctaaataaatatttgctaanttantgaatg

SEQ ID NO: 709393 - DNA, 900 bp, Homo sapiens
  misc_feature (329)..(329): n is a, c, g, or t
  misc_feature (349)..(349): n is a, c, g, or t
ggggcgcggaggcgggcggatcacgaggtcaggagatcgagaccatctggctaacacgttgaaaccctgtctgtactaaaagtacaaaaaattagccgggcatggtggcgggcgcctatagtcccagctactctggaggctgaggcaggagtatggcgtgagcccgggaggtggagcttgcggtgagccaagatggcaccactgcactccagcctgggcaacacagcgagactccgtctcaaaaaaaaaacatgaatgatttcacagtgatgaccatgttattgatcataaatagagaaaaatacaggcaggatgagcaaggggtttgnttggagattttaaaaggaanacagagctgttcttataattgtgaacaaaatgtggtctatatctggaaaagttattctctttgactagcagtttcttttcctggtaagctaacagtctcttcaattctgtcaccatcctttccaggagtctgtagataaccttgcctctttttacaagaaatctttctaatgccatcaagcttggtttcctggattctctatcttaattgttggtaccaccatccaccaacccggaaatagaggattgaccctctaccccttgtttacatgaatccctccctgatccccagacagagtctgtcactcttgcctctgtaccactgtgcttcttcttggtgtgtgcttacagtgtttgccaattagttgtaaactaggatataaactctttgagatagaggtccatattttttctttacctaacagcacctggcagaaatgtctggttatgttatgttctcagtaagtgttgctttttaatatgtctaagcccaggccaataaatgcacagttgaaaatttgactccaataaaaaaaaatacaaaactcgagg

SEQ ID NO: 709394 - DNA, 139 bp, Homo sapiens
cttgatgggagacctctggggaaaacataatcaccattttgatagttaattttactgacagttacctccctgcttttccaatgtatttgatatctaaatttttaagtgtcttgattttaagagtaaaaatttttttata

SEQ ID NO: 709395 - DNA, 237 bp, Homo sapiens
tgactagaggatcgtcgacgagcagagatacagcaccactgtcagctcagaccaatgcatctcacttctgacatacacgcgatgacacacattagagaccctgtcgagtgtggcgtggtctttacagcctatgaacctccagggtcttgactcagcttgtcattagtacagccagaataccaagtccgtggtgcgctagatgatatttttaaaaatcagcaaaagggcttaagcacg

SEQ ID NO: 709396 - DNA, 262 bp, Homo sapiens
agcactttacagacagagagtaccatacctcttcattacaagaataaccatgagcacacctcctaactcctcattgtacccaatactaatcgcaagtggcaatcctaaatgcttaccgaacgaaaaatactaggctatatacaactacgcaaaggccccaacgttgtaagcccctacgagactacatacaaccacttcgctgacgccataaaaatctacaacaaaagagccacataaaaccgaaaaatcaaacaacaccctc

SEQ ID NO: 709397 - DNA, 957 bp, Homo sapiens
cagaactagctcagcccatctctaattataaaacatggtttagtgtgttgtttttccttttttctggattaggtctggaacagctctagaatgaacacataaaatttagcaatttaaaatcttcctttactgcaagtttaaatagtgtgtacagatagttctataagcacaatattttaagaaaacaacaagtggctggtctactaggcagccttggtgccacttcagggctcagaacagttcaaagaaacaacaaaactttaggtcgattaaataatactatttctggggaataattatcaacagtatgaccttttaaaatcaaccttatatgggatgcatctgaaccagcagaagctgctagtaatagtgcgctatcttggctagaacttcgccatgtgacaggacaatctcattcaaacgtggttacaatccataatgcagacagtttcctccaaaaacaaaaaccaaagaacgatcaccagacacaacgcgctttcccagtcacacaaccccgtgaatgtgggaaccaagtttatgggaccttcgtgtcccaaaaaccttatggcaggtacaatcttggctctcaggaaagtggtcccaatcccacgctttgcaagttcaacgtgggacactataaaggcggcgcttttcacttccgtatgtggctataccagagttatacccactacactgaacatcgcatgaggcttcacctcttagaactagatttccaagacacggggcttactaccagggttgggacccgtgtttgcaagagcttgcccccaatattgacaagcaaagattgtacgacacggggtgattggggccactaagattggggctttcccaattaggtgtaacaccggcaaaacatacccggtgacgtcaaatacattgggcatggaacgttacacgtggcctcacaggctgcaatatacccggttgcgccag

SEQ ID NO: 709398 - DNA, 212 bp, Homo sapiens
attgttgcaactcaagctcgaagttcacgcgcagatacgccggagggaacatcatcctcgacgtgtgcatcaacaaggacagccgggcgagaccacgcgtgcggattcggatcaacaccaagcacgtaaagacccaggtactgttcgagaacggcggcacggtgttaatcggcggcatcttcgagcaggtcgaccggaataaggtgtcgcaa

SEQ ID NO: 709399 - DNA, 641 bp, Homo sapiens
tgcgccgtcccccagggtgcccccttggctctcctgcacacgtaccgaggggatgtcccctcccactctggacaggttccttaaccctctctttcgtaaatataaaaatagttcctgcctcatgagacggctctaaaaattaaatagtaaagccctcagcatactgcctgcttaagagccatctctcagaaaataagtttgttcttgtaataataaacaacaacttgagtccatactgagcttcctgcttcaaacgccactggggcggaccagccccacgtctcctccctggttgcacacgggcagggctgcagcttccccatggggcctgcaccatggtgggacggcctgtgcgccccaggccccggatgccccggccttgctccagacacgtggccgtcagcctccaagggccctgtgttcacaaagtcccttccattttccaccccaagctgacaaagacgcagctgggtgaccccgaagtgaggggtgagatgtgggttaccagcccctccaccaccctctcctcccggccagcgagaggcaaagaaggaagccagggcctgtggggtgcccacgctggtgagaggcagaggcctctgggagagacgggctccgtgctcagccccgggcacgctccc

SEQ ID NO: 709400 - DNA, 800 bp, Homo sapiens
tttttcccccccccgtcccccttccccccacacacacccaaacctttctcctgcctctctgacggaacatccgtcccccagcgctctcaatcttaatgaagaattgcgagatattcctcaagctgcgaaagtaaacatgactgagctggacaaagaaataagtaccttgagaagtggcttgaaagcattagagacagagctggaatatcagaagtctcagcccccacagaccggagataagtttgcgtctgttgacagccacttcatcacactttccaccttcatccttctctgatgatgaagaccttttagcagaagctaacgacctgtttactaaagtccccgaaatactcttggggaagaggctgccctacctcaccccgtccgagatctctggcattaatgatcaatcaaccacacccgggatataaatccaccgggatgtcctctctctgagaccaaattatgacgaagaatacctttgccgctcttctggcccctatctcctcccctcctccttttcctgtcacccattcttctgtctcgttcccgtcccaccctctcctccgcgcatatgtttcttcccccacgacctttatctccccttcactcaccatgtttttcacatccacctatttcgccttccccccttcttaatcttccatccccctatattctattctctcaccatacctctccacttatacccccttgccttcccctatcccacacatcctcacctcccgctatccccacatcgaactttacctataatccgccccccaaccccctctccccat

SEQ ID NO: 709401 - DNA, 139 bp, Homo sapiens
gccacgctgcacctgccgtcacaaaggccttcgatacgggataatcctatttattacctcagaagtatttttcttcgcaggaatttttctagagccttttaccactcgagcctagcccctaccccccaactaggagggc

SEQ ID NO: 709402 - DNA, 1944 bp, Homo sapiens
  misc_feature (8)..(8): n is a, c, g, or t
gccccgcngcggtcttccgagccgcaggcgcaggcccagctgagcggccgccgagcgggtgcgggtgcgggcgcatcggccatcaccgcgcggccgcgcagcggacaccgtgcgtaccggcctgcggcgcccggccaccggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactgtgagtctcaggaagggaggggtggggtggccgggagggcagggggaggtgcttgtgagtggcgctgacccagcctgtctgcttctcagcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709403 - DNA, 1393 bp, Homo sapiens
ctcggtacccccccgactagcccgacagccctccccgactagcccgacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709404 - DNA, 625 bp, Homo sapiens
  misc_feature (398)..(399): n is a, c, g, or t
tcaagtttacccatttttattttttataaaacaagctacaaatactttttcttgctcccgcctccccaagggaaaaccacacagcacagccgtacgcccatctgtgagagagaagttggctggtcagattctaaactcctacataaaggtggcttctctgtgcacatttccttctggccaggaaatgggactggagtctgctgggagggccatccagctccagcctgctgcgtgcggtgtttctgttcaaggctccaagagaaggtgttcttcccaccttaccatgcaggacagggttactggtcatcatgggacagcatgtgtgacttccaccaggacagcgggaaccttctggagctgagacttcatcgaatcaagctccgagaaggctatgttcnncacatgtgggcagcattatgtggtccatgccttccagacccaaaatagagcagggtttaccagggtggatgcatttacaggatactgagatggaaacccagggaaggcaggttgaggagagcaagccagcaaaagaaccagtcctggcctccctcactgccatcatggctgaccatggaagagctgctaagtatcacttgctgctctgactgaaggacctctgaat

SEQ ID NO: 709405 - DNA, 2011 bp, Homo sapiens
  misc_feature (158)..(158): n is a, c, g, or t
  misc_feature (216)..(216): n is a, c, g, or t
  misc_feature (784)..(784): n is a, c, g, or t
  misc_feature (816)..(816): n is a, c, g, or t
  misc_feature (884)..(884): n is a, c, g, or t
  misc_feature (923)..(923): n is a, c, g, or t
  misc_feature (928)..(929): n is a, c, g, or t
  misc_feature (932)..(932): n is a, c, g, or t
  misc_feature (967)..(967): n is a, c, g, or t
  misc_feature (975)..(975): n is a, c, g, or t
  misc_feature (993)..(993): n is a, c, g, or t
  misc_feature (997)..(997): n is a, c, g, or t
  misc_feature (1055)..(1055): n is a, c, g, or t
  misc_feature (1224)..(1224): n is a, c, g, or t
  misc_feature (1345)..(1345): n is a, c, g, or t
  misc_feature (1352)..(1352): n is a, c, g, or t
  misc_feature (1426)..(1426): n is a, c, g, or t
  misc_feature (1444)..(1444): n is a, c, g, or t
  misc_feature (1479)..(1479): n is a, c, g, or t
  misc_feature (1504)..(1504): n is a, c, g, or t
  misc_feature (1519)..(1519): n is a, c, g, or t
  misc_feature (1628)..(1628): n is a, c, g, or t
  misc_feature (1631)..(1631): n is a, c, g, or t
  misc_feature (1677)..(1677): n is a, c, g, or t
  misc_feature (1684)..(1684): n is a, c, g, or t
  misc_feature (1691)..(1691): n is a, c, g, or t
  misc_feature (1701)..(1701): n is a, c, g, or t
  misc_feature (1753)..(1753): n is a, c, g, or t
  misc_feature (1792)..(1792): n is a, c, g, or t
  misc_feature (1847)..(1847): n is a, c, g, or t
  misc_feature (1866)..(1866): n is a, c, g, or t
  misc_feature (1877)..(1877): n is a, c, g, or t
  misc_feature (1954)..(1954): n is a, c, g, or t
  misc_feature (1972)..(1972): n is a, c, g, or t
  misc_feature (1987)..(1987): n is a, c, g, or t
aggatgcgcgtacagatagatggcgctcgaggtcgagaagctgcacggacgctacaacaggacgacgacgacgcagacacgtcatcacgccgagggacagaagactcagctgagcgacggagcacggacgcgcagcagcaggcacggacgcagagagngcgcgacggcgtagacgacacaagcgaggaaccacgcaagacacacacacatgccagngctctacgacgtcagcagcgtcgggaatgaacgggacggagaaagcgtctgaggaccgaacaagagagcaactagacacgcacagcagcgacacccagagccgacaaccacaccaacaccacaagacacagacacgcccaaccaccgctaccgcacacgtctgatacatcgcactcagcagtcgcgtacacccaccgactagccaccacagcgcacaaccacactacacgccaccgagctagcagcgagccgcagcgtcgctcgccgaccagaaccccaccgcagctaggacgattccaacaagcgcagcgccacgtgctacacactgccacacgccaaccctcgcgcctccatcacagtacagtcactacgcggacacgacaagcgcacacacaatcacacacacacgcactacgacagcactacaccataacagcacactcatcacctcacaacgacaccaccacacacgcacaaccaacaaatgcgtctgtgggggatgaaaggactcaccccctctaaaaacaccacgggggccccctgagcgcaggctcatgcgagtggggcnccacgaggtagtggcccgccgtggagcgacgnccttccatatttaagtcggacaaacaaacctagcatttaatagagcgacgttgggtgtgtcgaaacancttcttccctcctaccagccgtgggagagtggatgggtngcccnntcntggcgtcgctgaacaggggcagggctaaccacaanctatcttntctccgccgggggagggncgcngacacccgcaggtgcataatatgagtgagaaaatccacccatcccgacagagcccagnagttcctcgtccaaaaagaccccccgtcgtgttgatttaactcccgtggtaaatatcccccccaaccggggtgaaagaaccaaactaaactaccgcccctcagttttaattaaaccgaggtaggctcctcccaaatctagacaacaagtctcctccacccaccagcagngtcttcatctgccgcttaagcatctaccacgccacgcccaagacatgtgggatgaacaacacacgttttaatcaccacacgaccacgagaggtgcgtatttaaacacacatttataaatcnagccagnagggtggagccccctacgggcaacagacctcccatttaataacgtggtggaacaagcatacaggcaaacctcgntcttctccttgtggtggnagaacaccaattagttaataatcccatcccccccntcctctgtggtggctgctggtactnccactctaggaggantgcctcctaacacacacacaagcaagccttatactaaccagcgcgcacaaaccactgacttttttacactgccttcttataacactcgcgggcgagcgtgtttagatanaanaccaccaccccctcctggatggtgctgcccgtaataagacaaaccncggggcngcggggncgcgcggcgngacaaaaccacaactcatcattcctggcgtgcagacaatcctctttgtgggntgaacactcattcttacgtacagaaacgattataaaacntacgtttctgtcttctaaatcgtggactttttaatctcaataccagatagccctncgcgcacgaaagataaacnatggtgagcgnctccgcctacaatcatccttttttaattgcctcaacactcgtcttttaataatacacatttttatctcagtggggcngcgtcccgatacatccanaataacaggtgggtncggtggagctgacacacacgtcct

SEQ ID NO: 709406 - DNA, 4479 bp, Homo sapiens
  misc_feature (4473)..(4473): n is a, c, g, or t
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccaggagcacgcccatgcagncgacgc

SEQ ID NO: 709407 - DNA, 154 bp, Homo sapiens
gcgcacctatttttggctaaacctgaggcggcactgccccagaatgtgctgggcacctctgtggcccacgtccttcaccggcacctgtggtgagggcctcatagctgctgacgtgtgttgtgcataaagacctatgtgtgtggagatacttatc

SEQ ID NO: 709408 - DNA, 354 bp, Homo sapiens
ttgcttcctcctggatacgcgcagcagcgaaatgctcttcatgacgtcggctgccaggataaagtacttgacgctgatcatctggtgtatgtagagctgcgtgtcaataaaggccatgcccgtcagttcactggcccgcaggaacctgcctcatgcagggggaggaggtcacgtgccggagggcggctcttgatcatggctgtgattgaggtggtgcccgagcctggccagcccttgagcacgtaaccagttccctgtcctttacgagccggcgccgaagtgcgcccgtgaccgccttgtgccactgcaatggccacctgatgtcggccatcgaccaaaacggttctgggtacc

SEQ ID NO: 709409 - DNA, 1376 bp, Homo sapiens
cttaggctagtagaggctgggtttaatcggccgaggaaggtccttcccagttacagacctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709410 - DNA, 812 bp, Homo sapiens
  misc_feature (337)..(338): n is a, c, g, or t
  misc_feature (350)..(350): n is a, c, g, or t
  misc_feature (352)..(352): n is a, c, g, or t
  misc_feature (383)..(383): n is a, c, g, or t
  misc_feature (386)..(386): n is a, c, g, or t
  misc_feature (399)..(399): n is a, c, g, or t
  misc_feature (402)..(402): n is a, c, g, or t
  misc_feature (423)..(423): n is a, c, g, or t
atttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattctttttttttttttttttggaaagagagtctactcggccgcccaaatggggtgtgcnnggcgccaatctngngctcactggcaacctctacctccggggtccnggngatctcttgcctnagnctcccgagtggcggggatacnggcttgtgccaccatgcccagttaatttgggattttagtaaaaaccctgtctcggtgtaaaattccggaatttacggtgggcatgggggtgtaaccctgtagtcctagctactcgggaggctgaggcaggaaaatagctgaaccggggagtcggaggttgcaaccaagatcgccccatgtgcggccccagggtggagattagaccggaaaattccgcgtctcccaaaaaatacaacaaatatcacacttctatatctcctctgaactttttaaagaaccggtaagggttttatcaacaaggggtttgggggacacaagaatatctctggagatccgggggatcttcagcgccaaagttttcccgtgtagcaccaaatatgtgtggcacc

SEQ ID NO: 709411 - DNA, 397 bp, Homo sapiens
  misc_feature (26)..(26): n is a, c, g, or t
  misc_feature (57)..(57): n is a, c, g, or t
  misc_feature (148)..(148): n is a, c, g, or t
tgtggcaccgtttctccctccacagngccaaagccatagtgtccggtcccaaggacnaggctcttcctagtgctaggagaggtatgacagcctctcacctgtgatccccacagctcacaggtgagaggctgctcatacctgtgagctntggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcggaca

SEQ ID NO: 709412 - DNA, 129 bp, Homo sapiens
ttcgatctagaggatcccttatgttgggacggcgcagacagactggcaggagcacacaccgcagtctgtgcgctgagtcggagccagaggccgcggggacacccggtgcatgtcacgcccccaacttga

SEQ ID NO: 709413 - DNA, 123 bp, Homo sapiens
  misc_feature (60)..(60): n is a, c, g, or t
  misc_feature (103)..(103): n is a, c, g, or t
gcgaggtggctcagacatggaccgcggcgagcaaggtcatgctgaagacagagccggtgncgaggaaggagaggatgctgttaccatgctcagtgctccagangcgctgacggaagaggagca

SEQ ID NO: 709414 - DNA, 3859 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggggcggaccgcggaacccgaggccatgtcccatgaaaagagttttttggtgtctggggacaactatcctccccccaaccctggatatcctccccctacggtcagccagggtacccccatggcccacagacccctaaccacaccaaagggcggatacagccgaacagcggatacaccagcagcgccacaagggaggactacaccaagaggggacccccagaagcacagaagaaggagcctaacacagaaaggacgacataaacacaacaaagaaggaaatagaaaacgagaggaaaaagagaccacaagacgaacgaaaaagccaaaaagacaaacagagaca

SEQ ID NO: 709415 - DNA, 1185 bp, Homo sapiens
  misc_feature (67)..(67): n is a, c, g, or t
  misc_feature (71)..(73): n is a, c, g, or t
  misc_feature (77)..(77): n is a, c, g, or t
  misc_feature (88)..(88): n is a, c, g, or t
tcggcacgaggaagctggcgatcatccccaccatgtacgacaggctggcggtcaggaccgacagtgnaacnnngttncaggggtgctntcgccggaagtccccacaacagctgaggacgatgagagagatgaagaagacagcataggagacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709416 - DNA, 1062 bp, Homo sapiens
  misc_feature (67)..(67): n is a, c, g, or t
  misc_feature (71)..(73): n is a, c, g, or t
  misc_feature (77)..(77): n is a, c, g, or t
  misc_feature (88)..(88): n is a, c, g, or t
tcggcacgaggaagctggcgatcatccccaccatgtacgacaggctggcggtcaggaccgacagtgnaacnnngttncaggggtgctntcgccggaagtccccacaacagctgaggacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709417 - DNA, 2189 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctctggagaaggtccaggtatgccgg

SEQ ID NO: 709418 - DNA, 559 bp, Homo sapiens
cgtcatgggttgtgggatcagaggatctggcgtggcatcccgtagccagtcatgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 709419 - DNA, 159 bp, Homo sapiens
  misc_feature (31)..(31): n is a, c, g, or t
  misc_feature (33)..(33): n is a, c, g, or t
tggacccgcggttatgtcttacgactgtacnancttatgtttggattcacattacacagtgaagtgattgcttgtcaaattaattaacctatccatcccctcccataattagcactttcttgttctctagaacgtcatcatcgtaagacataaccgcgg

SEQ ID NO: 709420 - DNA, 1354 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacctgcggggaaggcccgggccaggattaaacaccctccctacgccctggggccgacgcagggcagagctgagcctggcaaccaggagccctctgttggaggagtccagggtttgagggagcccttgcagcccccatcatgctctgtccagcagcagacagtaacacctccgtgaagcaagtgacttcagagggccgctggggaggcctgacccctccccctcccgtggaggtctgcgggcgggcaaaccccacccactcaagcgaggcctctgcagagaaaagctgagccagggccctatgctgcctacaggacttgactccaacacgaggagatgccacagacctctcagtgctgaaagacccaggtgggagagaaagcctcaagtgaccaacctgacagccctgggaaacacttttaaagaaattttaaatagctttcttaagagagttgcaaaagaacaccatgtctattaaacaaaactagctggtatga

SEQ ID NO: 709421 - DNA, 720 bp, Homo sapiens
gatacgaagcaggcgggcttcagagtgggttggaaaaatggaggtgccgcgcctggatcatgtccctcaacagccccactcagcccctgtgatggaggtgatcaaaaacctcagcctggaggccatttcagctgtgcgaccgggagcgggaacgaacatcacaagacagtggcatagcagagatggaagaacttcctgtaccacataacatcaaaataagcaatataagcgtgtgactctattcaagatttcatgggaacatggattcaagatcaaaggatcgcattacacactattttatgacctcaacaagaacgagaacaagaagcctcctagataagattgtaaacacaacggatgttcccactaaaatcggtggcataaagctgttcccttgcctatgactgtccgtggacacttggtttcttaagcccaatgaactgaatatacagtaggcagtgccagactgtctcaaaaacaagtcgagtggtgactcatgtagtgtctgagatggccgtgaaaattcatcgaattctgcaccgcaggactatgtcaaaaaggttcattctaacacaattggtggcagaaggctggagtgattgccggaccgcatgtcttaggtttcctggtccagtatcgggaatccagccaccaagcgaatatttcgactatggttcgagcaacctcatggggaattggctatgcagcccatcccgctcg

SEQ ID NO: 709422 - DNA, 241 bp, Homo sapiens
cagaggccaaacagtgccaacgatgacatctgcccatttagatcacctactatggggtagacactgtgcagccataaaaaagatgagttcatgtcctttgtagggacatggatgagctggaaaccatcattctcagcaaactatcccaaggacagaaaaccaaacactgcatgttctcactcataggtgagaattgaataatgagaacacctggacacaggaaggggaacatcacacaccg

SEQ ID NO: 709423 - DNA, 755 bp, Homo sapiens
ttcagcctccgctggatgcgattggtggagcaagggctgctggagaaacccgtcttctccttttacctcaacagggattctgaagggtctgatgggggagagctggtcctagggggctcagaccccgcctcactacgtacctcccctcaccttcataccagtcaccatccctgcctactcgaagtcccacatggagagtgtgaaggtcggcacagggctgagctctgtgccagggctgcagtgccatcctagacacaggcacatccctcatcacaggacctagtgaggagatccgggccttgaataaagccattgggggatatcccttcctgaatgggcagtacttcattcagtgttccaagacgccaacgcttccccctgtctcctttccaccttggtggagtctggtttaacctcacaggccaggactatgtcatcaagattcttcagagcgatgttggcctctgcctgttgggcttccaagccttggatatccccaagcctgcgggacccctctggatccttggggacgtctttttggggccctatgtggctgtctttgaccgtggggacaaaaacgtcggcccgcgcgtgggactggcgcgtgctcagtctcgttcaacagaccgggcagaaagaaggactacgcaggcgcagttcttcaaaagacgccctggttagggtacaagctcaccgggccacagcagctatgcttctttccaattaaacaaattaaaaaaaaaaatcaactttca

SEQ ID NO: 709424 - DNA, 991 bp, Homo sapiens
  misc_feature (196)..(196): n is a, c, g, or t
  misc_feature (244)..(244): n is a, c, g, or t
  misc_feature (268)..(268): n is a, c, g, or t
  misc_feature (278)..(278): n is a, c, g, or t
  misc_feature (281)..(281): n is a, c, g, or t
cttatagtgatgatgcaactttcgaggaatggttcccccaagggacggcccccaaaagtccctgttcgtgaggtctgtccagtgacccatcgtcctaggaaccttataccggggacccgtgtatacagacataccctattgccgactagctcagagcgcttcgagagaatccatatcggttgatggcttctacacnaagagcgtaccgattcacatcgctcgctatgcgagctgcactgctccnagctgtcctctgagctcacgtagnggtccacacnggngcgcgctcaactctaccttggagcacccatcccatggactctggggcgccctgagctctttgtgccatgaaaattgtcattaaatgaagagatgtcgtattcctcagaagcttctttcctgccctgattgggggctctggctgtgccgtttcttgctcgccggcttctctcgccttttgtcatctgcgtgatctttggcctaatctagtttctgtgttccctgtttccctcgtagtttcttagcagggtttgcgtctgtggtttattcaactcgtaactaaacatacgaaagattccaaatagagatagaaaaagaagacaacagagaagaaggagactgaagggcggggagggtgacaacaagaagtacctccccccgaggagaggcccacagtgtgacacggggcaaaccgccggtggtcatgggggccacccaggggcgtgcgccaaaaagggatcggtacctcgaaaaagtcaacactgacggctcacaggcggaacgcagaactacagacacctggtggtacctgccgggaaaagacacggccgcgcactcgtggggaaacaccctagggcaagaaccaacacatcgcaaaaccacacgcgcagggcggagacacagacatggcccaccgacacccaaccttccacggggaaaaaccaacccccctagacggccaatccaagaaccttaccgggacaaacgggga

SEQ ID NO: 709425 - DNA, 201 bp, Homo sapiens
cctggctgctcaggtctggtctcgaactcctgacctcaggtgatccgcccacctcagcctcctaaagtgctgggattacaggcgtgagccatggcacccaggcctgaatgcagcctcttgccttggccaggttattcttcagagaagtagcaggagttggggaaggaagtctcggcactcctgacagaggcctggggcgtc

SEQ ID NO: 709426 - DNA, 196 bp, Homo sapiens
  misc_feature (18)..(19): n is a, c, g, or t
  misc_feature (21)..(21): n is a, c, g, or t
  misc_feature (89)..(89): n is a, c, g, or t
agcccaacatggtgaccnncnggccatgctgttcccatcaagtataccccagaggagattgccatggaactgtcactgccctgcgtcgnactgtgcccccagctgtcccaggagtgaccttcctgtctgggggtcagagcgaagaagaggcatcattcaacctcaatgccatcaaccgctgcccccttccccgacc

SEQ ID NO: 709427 - DNA, 1039 bp, Homo sapiens
tgaccagaccggatatgagtgcctctagtgaactcatcttcttgccgcgtcctcgtgacttgggcttccggcgcgtcggctcttggcttgtgcagtgccgttggtcgtaggtgcctgcttgagtcagcccggtgctccataaggcccgcatgtgcatcatcttgtcctgaggcctgtgtccttgcaccgtcgggtccctgcgtaggcctgggtctctgccaggccttggcatgacagtcttgaccgcaccggagtatgcctttgtacgcgacagcagttatacacttctatgcctacgttagccctaatcccttgcaagttacatagttcatccgcataaccagcgccatttcccgaagggtcacacataatgcacaaaaccaacgggaacgacataacgatgcgcttgccaaaccacaagggaacctggtgagccccgaggacagagcacccctcaaagcactcattggacacctctttgtccagatcaacagccccctacaaggggcaagattcgccgtccaacagcggtcgtggagacccaggcacccaatagttccgcgaaagcgtgggcccccccacgctggagcacaccgaacccagaacacgttcacaaggcaatggtaaacacacaacgtcaagtccaaacccatatcacccttacgaccccacttccagtcacagcacaaatttgtccctgttgcacaattcaccacttatgtcacccacatttcttcttccactacttcataaagcatacttctttcctacaaactttccaaatcgttgcgcacttcctccaaccccattcatactgcgccacgaaatcacacttgcccccgttagaagatgcccaccgtgggcacaaaccctttggcaaatgccatcaacctcgctccacgcggtacccctattgggcgaatgtgggaacgaccccgtcgaggaccaccagccggacttaacagatcggcaccgcgtccgaccaccgcttgttcgcaaccctggagacgatcactccccaacccctcacgctaagccg

SEQ ID NO: 709428 - DNA, 443 bp, Homo sapiens
cctatgcatgcagtgcattagacagcttgtgtgcagtcaacagtgctaagataataccgacattcctggcaatgggctctcctcccatggtctgtctgtaggagcacggtatccaagccatcgtctgcaccctgtcagcccatgctatccattccatcgacatgtgcacagtcgagggtcatatcttcaaagaagtactcagtcgagtcaaaagcagaatgtggctcatcgtgatcgcagcatggttcaggcacgacgtgcctttagtgcctgagtctgacattctccgtcaggtcctcatggcatccagcatttagcgcacagccaatctccccgaagcttgtcagcgagcggtcattctcatatcatgagtatccatctgtctagtctagtgcgtcagagtgatctacagtcgcccaataaacctgaagcgcccacagacg

SEQ ID NO: 709429 - DNA, 1684 bp, Homo sapiens
gctcgcttcccccagcccgtgagctcggtccgaacgagaggttccggagcctcctgtgctgcgggcggggttcgtgggagtgctagacgctgctggtccagcgcgacctccagccgaagggttcgtcggcctagcctgcgcattgcagcagctatcaggctgctccgcgaggcattagaaactcctcgaacgaaataatcacaactgagtcaatccggcggactttcgtgcatcgctctggagaaggtggcatggtaaagtaacttgtacaaccatagtggtgcatgcaataccacctcatctcctccttgttatacctgagtaaacgatggaccctgtatacatggaatcacaataccttcagtatcaggctgtctctatccatgaactctctctctaccagccactgctggcactgaccacgtggccttacggccgtctacctcttagcaaatacggcagcaggggctcatggcattggcagaggaaagctccagacctgtcacttaaatgaacacgccaattggctttggcagcggtcctgcaccactacttgtaacaccaacgtagctcactctccagccgaacgtcttgacctttggccgcgcacatcagcctaaatgcctgacaccgcaactacaaatggaacataccaacatctgcttaacctctccttcgaccgcacgcacacacacgtcatactccaatggaagcgactccccgtttgcaacgaccagccggggcctggccttctgcttcaaaccctgcacagaccacggtagttgcgcaggccaccccgtgtaaagggtacccctcacggccacaacacgaacagcaacggtgcaaggatctaagcccattcacccacatgtaatgggcttagcgccctggcgtactgccacagccgggaacacccttacatgcgcaccattagactgcccaagagatcgcatcacacacagcgcactatatatcgccatgaatgagtccacctcctaccgccgcacccgtcgcctatgccccgacagtatgcaacgctctcgacccacacgaccactccatcccctacctcggaacacctggccccgcaagccatcttgcatctccgcatggcacatactcacgcatgcctactcctgtatatcatcagcgacactgcgcacttgacaccgatcgcacatccacgccggctgcgacacgacggcaccgtccaagcacgactgctactaaacacatctactcctaaaatactcttagtaactgcacatgcaacaatcattctacctactaccatatgaaattacaaatcaactagcccaacaacctatacaataccaccatgattaccatctcctatcatcaaaccactaaccttatacttattctccaatctaagataataaacacataaccataaactcgcagataacacactagtcgactaacccagcgacaaacaaccccacacaccccacaccacaccaccgccaacaacaaacaccactcagccctacccatacagcacctaatactcaaacaccaactgcactacaccacttacaatacagcaaccataacacagaatcatcaacaattagtcagcctcccatcacccactccattacaccaccacacccagcatctacacaatcagaactatttatcctaaaaacaccacaaccac

SEQ ID NO: 709430 - DNA, 868 bp, Homo sapiens
gtgctctacccccggcacggatcgccgggctagtatggactgcgcggctccaggctgagggtcggtccggaggcgggtgggcgcgggtctcacccggcattgtcccgggtggcaccgtgtccgcgcggcccacctgggcagccagcgagggagtcactgtctacaagccatctgccagccatccgtcctccctcctcgatcttctcggccgcgtcgagcatcgatccgaaagccccttccccagagtcctcaacatttgataggagagtcggatcgtacaacgtgcacgatcagacggttggaagaaggatagttcgcgaaatgcacgtgcacgctccttttaggcacgtttgctttctagccatacatgcctcacacgtaggcacgaagcccagagagacgtacttgtttgcctaatttcaagacgaaaagtaaacaacaaaattgaaacactccagaacccacgtgaaaaggccgctttcactctgggtagaggccctctcgggccaccgtgtaattcccccggtgttgaaacccactctcgtaaatacttagctaacaagctttttaatagtgaagccctggcattttgacacttccaagttgttgctccataggtggaattgcggagagtactgctttggacatgggggagctacctattagtacttaaagtggttgcctaagccattaggtttgcgtagaaacccaatttgtgccgaatactctaataaccattgcttggcccaaaagcacacaggaatgagaggagtgaacacaaatgtagttaccccaaaaagaaggttggctttaatcttccacaatgcacgttgcaaatcccaaaaagcccctaattccacatgggacg

SEQ ID NO: 709431 - DNA, 1729 bp, Homo sapiens
gctgcattggctacacggccaccaatcaggacttcatccagcgcctgagcacactgatccggcaggccatcgagcggacagctgcctgacctggatctgaggctgccaaccagcgggcaggagggccacgggtgaacaagggctgcaggaggaggcatgcaggcaggcaggcaagcacagcaggaggaacgtggcatgagcaacctgctaactttgcaaatgtgggccccctagcacgttggacggacggacggacgggaaggagggccacggggcgagagaaagacggacggcaggacacgagcgacggacctcacaagacacgccaacaggaaggaaagacgccatggacctccacggcaatcgagccaacacatgacagcccgaccgagaaagcaccggcaacaatcacccattgacactcggaagaaaaccaaattcacgaacaaatcgacaaaccaaaaaagaaagagcaaggaacggaaagacaacacacaggagtacccaaaaagaaacaaagagagaaataaacataccaagacacacaagaagacagaaaacgaccataggcacacacgggcacgcctatcagaaaccgaagagctcagaccggaggacaaagttagagaacagaaaccacaaaacaggaaagaaagatgacgacagaaagaaacgcaagagcaagcaaccgatcgcaaggagagaacaaagacgaacgaacccaaggaaaaggaaagataagatatcactacaaatcaccaaaagggacaggacaccaacggcaagcatacggcgaggacatatacccaccctacgaaacattcgagacaaagaacgacccaatctaagacaagcaggaaacgcatataataagcgagacagtatacgacgagtaaataacatagacaaacgtgagagaacagcacattaggatcagaatcatcttaggacatatgcaaactcacagacaacagggagataacacccgggagaaacataaaaaaaagcttgacaacaaaacatccacgaagagcacaaagataatcaagatgataaaaatacagtcaacagtagaagacaagcgccaccgacgacaaaaaaaacagcagtagagcaccaaagagaaacagacaagaccacacgaacaacaggagaagcgaaaagacaagggaacgaacaacgacaaacaggagagaacgcagaagcgaacaacgcacgaaggagagaaaacacaatgggaggacgaaacatagcacaccgaagaagcagaaacagagaacgaacacacaaacagacacgagtcacgacagagaggacaacggggagagacaacgagaaacaggccacagtaacagacgagagacagccgccaccagaagcaaaacaccaagaacaagaggagcaacgccagaaactttctcaataacgcacgagcggcgagcagaacatacgaccaggagacatatagaccacaatcgacaaaccacaacacaaaagcaaagagaccagtagaacagaccagcccagaagacagacaaacacgggaacactagaaaccagaagtaagccaaacagcgacgacactagacaaagaacacgaagcacacatgacgcgcgaacagacggcgacacagacacacatcaaacagacacagcaacagagcaaagaatgacgcgccacacacacgaagacgcacaacacataacgaatactcggcacccaagtacg

SEQ ID NO: 709432 - DNA, 358 bp, Homo sapiens
  misc_feature (7)..(7): n is a, c, g, or t
  misc_feature (68)..(68): n is a, c, g, or t
  misc_feature (131)..(131): n is a, c, g, or t
  misc_feature (203)..(203): n is a, c, g, or t
  misc_feature (229)..(229): n is a, c, g, or t
  misc_feature (261)..(261): n is a, c, g, or t
  misc_feature (315)..(315): n is a, c, g, or t
  misc_feature (321)..(321): n is a, c, g, or t
caactgncttccaacacaaccctgccaactccctctgcaaatacagtctctggtaggctgcccctganaaggatctgaaggaggccctgcatagcaccggtgagccttaccctacctgctggctcacagtnctgtggcaaggttcaaagccaagcccaggccagagctgagctgctaactgggttctttgcttccctatgganaaagccttctgccaaggtttcttgtnggggggggggaacccatggattccaaaactanagggaaacagagactggcccaatagataagggagcagcctgggagagtaggganctgggngcaggcattccaccgggccaggaaatggagccctcag

SEQ ID NO: 709433 - DNA, 968 bp, Homo sapiens
ggacgcgtgggtcgaccacgcgtccgggataactgttcaggaggagatgatgactggagaccatctgtcttcaagatgaagtggacccgtctacaggtgaactccagtgccctacagatgtcagaatccgagagggccaagctctctggacccctcccaggagggacccacagggctgaaggaagctgccttgtaccaccacatctcccggctcagaggctggagccgcggttgattgagtccctctcccagattgctgtccattgggcttctctgatgaaggctgggtggctcaccaggctcctgcacgaccaatgaactatgagatcgggagcggtctggacaccatccagtattcaaagcatcccccgtcgttgtgaccacttttgcccacctcttctgcgttgcccctcttctgtctcatagtcgtgttaagcttgtcgtagaacttgcaggtctctgtacgggccagatttcgtctgccttcttccaggatcatggggttacgggtgcaatgaagccatatagggccagtgacaacaggtgacatgaagggagggtccctggtgtgtgtgtgtgtgcttgagtgtctcctggtgtgccctggcttccttgcaggccgtgctgtgccctgcgcatcacccagggctcactgctgccgggctccctgaacgctccctgcaggggggctacgttcatgcaggcctagcacatagtgggcctagtggtttgccactttcgctcttgttctaactgactccttggtgcctgacttggggttgaccagttgcctgcatagacccggtaacccctgatttagatagacattagccaacggttggcagccgcaagctgggaggccacgttggggcccccgctggggtgagagcgcccacgggctcgccacggtggtcaatcagagggccctggttaccacagtgtcttcgttaaccacaaacgctaaaaac

SEQ ID NO: 709434 - DNA, 1062 bp, Homo sapiens
cgacgtggaaacaccgcgggtgatttattggctccggggtgcgcgaagcgtcttgtccggagccctgcctacggatgagaggcgccgactgctgggacccatcggtgtccacttatgtctgtgacggctgcgacatcccgcacgtagtacccgcgttctctaagcatgcgaaccacgggtgtcttggcgcgcgttgtggccccctggtcgggtggcgcggggaccgatcaatcgcttgcgcggaaccctttggcttgcaatgtaacatgctatatgactgcgctagaattctgagctcgagattgtcgcgaagtggctttcattctcgacatagctaccactgcactgggttgctagttatgctactctctacctactatggcaagaatcaacagagatatctggagtcaaactatcccttgaattgcccctacaaagggagtgacctccctgtgcgttgggctccaggctgtacttcgctgtcccagaagtgtcgtgtgcgttcttagccttatgcatctgtttcaaaaacggtttatctactttcacgggatgttttgggactggatagtaaactatgactcgagcactgcgagtcatgaaacgtcgatcggtaattaacgtagtacggtcgtgcagagaagttggctggctaatgcctaattaaactggcgggtaccgatgcgtgagagttgaccaagcatgctgcattagttactgcctgaagaagttctgctttgtgacttaactcctataccagcttttctgtggatatgttcccgacggtgccgtcaggtcctcaacgttgttagaatacatatgtgctctgtcacccgtattacaccagacgcagggtagagacacggtaaacgtcggcggagaggaacgtatatacattaaaggttgaacaacactagcgaacacagacgccgtgtgcctaatgtggccaatagacaccgccacaccctttcgcatattgatactagacagtcagaacagtccagacgtcacagtcgcacgcatcaagcagggcgagatagcagaacgacttgcgcgtacaca

SEQ ID NO: 709435 - DNA, 386 bp, Homo sapiens
cacgaggagaacgacagaaactgggattacctccacttacatctaccacactaagtgtatgtagtactactctctgggttgggcaagtgggcaaaaagggaacacagcaagacttaaccaacctgtttgaaaagtttggacatattgaatccattaatataattcctccccggggctgtgcttatgtctgcatggttcatcgataagatgcatttcgagctcttcaaaaacgtcagttctgtgcatcatataccattgggtccaaggtcattaagatcgcttggcctttagacattggtgttaaaacagaatatttgcaattctgggatgtggatcttggagttacatggattccacgggaaacagttaaggtggatgacttggaa

SEQ ID NO: 709436 - DNA, 123 bp, Homo sapiens
gtgcatccctcctcctaactcagcatggggctgcggcattacggtagctcgtggttggatctgtcatctgggacctattccatcccctaccccatgtcttttctgctcatagttctgcgtctg

SEQ ID NO: 709437 - DNA, 227 bp, Homo sapiens
ctgacggtgtatggaagggactgtctgcccggtatcatcatgattgttaccctgactgccctacagtggttatctatactccgtgaaggtctacttcagacttcctcgcgctcctccaccccagatgccagagtctctgaagaagaagcttggttaactcagtagttagatcattgcaaatgtggactgaatctgcttgttgatcagtcttgcaagaactactcgga

SEQ ID NO: 709438 - DNA, 201 bp, Homo sapiens
tcgcgaatacaaaggggtatatgagcatcagtagactttagttactactgacttcatggtgtcgacgtgcattcgatcctaagatatgagcagcatgatttctggtctagtatcgtagcaacacatgtatgcagtgccacacatggctatcctctcgaaaacctatttgtgaacgttttcttactttctgactaacggaca

SEQ ID NO: 709439 - DNA, 214 bp, Homo sapiens
cctggttatcctgcaagattacacgaacagtgctcctctagaggggtatgaagcacctgccaagctctttgagtttaaagctgtggttcgtagtgtcctgtgcgagcagttttgtggattaaacttgttgaggttaacgggctaagcataggtggggatatctatatcccagtttggggctctacaagctattgtggtgtgtcccagattatgt

SEQ ID NO: 709440 - DNA, 144 bp, Homo sapiens
ggtcggacatcctcctcttcttcttcctctaactcaccttcttcttcctcaaattcttcctcaaactctccttcctcctcttcttcctcttcaaaatattcctcttcatcctcttcctctatggcagaggtgggaggagaggaa

SEQ ID NO: 709441 - DNA, 265 bp, Homo sapiens
ttgcgcccaatagattttttatagcagacagtgatctcaggaatcctcctcggttcccagggcttggtctcaaattcctggactcaaatgatccttccaactcgggctcccaaagggctgggattacaggcatgagccaatgggcccgggagggagggggtaaagtgagaggcataagggtcccgggcaggtgttagcagggggcttcagaggtgaagagagagcagggcagggaggctggtaaggccgatgggagcaagaacgg

SEQ ID NO: 709442 - DNA, 1111 bp, Homo sapiens
  misc_feature (1059)..(1059): n is a, c, g, or t
  misc_feature (1098)..(1098): n is a, c, g, or t
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccactgatgcatggggaaaagcggggggtcagagccatgcctggggcactagcccctgctaaccagnccaccccaccgtccctcagtccaggaggtagactcacangtagggcctgaag

SEQ ID NO: 709443 - DNA, 232 bp, Homo sapiens
  misc_feature (40)..(41): n is a, c, g, or t
  misc_feature (61)..(61): n is a, c, g, or t
  misc_feature (95)..(95): n is a, c, g, or t
  misc_feature (205)..(205): n is a, c, g, or t
ctgcagctttcccagtgtctgtcctgtggcatgctgggcnntgctgcccacatcgtccttnctgtgctgcgtgtgtggcctctgcagtcccacgnacctgctggcggcattgggcccactggcaggagctgggtactgttgccaggaggcctggggtcggtcactctgtaacactgtgggccctcaccccaggagctggcctatncctccccagcagaggcgattttacctc

SEQ ID NO: 709444 - DNA, 373 bp, Homo sapiens
atcccccgggctgcaggattcggcacgagcagcatattccctgacggtcaccttagggcgggtggcgtgcgcgtgcagacacagcatactgagaccttcggggcccggagcagcctccctttggtctgcttctcgaagggtcaattcacagagcacttcatatctaccaggatatgttccttgaggagaccagacaccatgcacaggtcgtgaagaaggtgaatgagaagatcgtcacggggcagtatggcaggctctttgccgcggtgcactttgccagccgccagtggaaggtgacctctgaagacctgatcttaattggtgaactagaccttgcgtgtggagagagaattcgactgggggtgctgctggt

SEQ ID NO: 709445 - DNA, 367 bp, Homo sapiens
  misc_feature (32)..(32): n is a, c, g, or t
gggagccggggaaggaggccgtccatcccgtngacgtagaacctcgaggtttctcaaagaaatttccactcaggtttgttttccaaggcggccccggccggggtggattggatttgtttttggtgaacattgcaatagaaatccaattggatacgccaacttgcccgtattttaaaagcgtcataactagaactgaattttgtctttatgatttttaaaaaaaagttttgtaaatttctctccggtcccggtttcccttttggatattgggatttaaatgaaagtgagcctttgagggggtatattttttgggcagcccctgttaagccatgtgttccaaggcattttagcggggagggggttatca

SEQ ID NO: 709446 - DNA, 377 bp, Homo sapiens
  misc_feature (268)..(268): n is a, c, g, or t
gcggcgcgggaccggcgtgggcggcggcaacggggcactgacctgggtgaacaatgctgcaaaaaagaagagtcagaactgccaacaaaatgattcttcaaagagttgtccaagatagaatcttagttcactttaaatttgcccacagaaccctctaaatcccttgtaatttaactgttagtcaaagaggacagctctttggacactaggaaaaaccttgtagagagagtaaaaatttacaccatagtaggctaaagcagcaccaatnagaagcgttcagctcacaccactactaaaattccaacatatactgactctcacaccaattggccatctatcacctatagagactatgttgttagtacatgaccatctcc

SEQ ID NO: 709447 - DNA, 716 bp, Homo sapiens
tcgaggccgcggacctgatttctgcgcggtctccgataattagtttatcacggccagcgatatggaccgcttgcacagtgtcatgaagatcacagtagtcatggacatctagatctagtccgtgtctaagaacgaactcatgtgcattgctatcatggtattagcctccataaatttcgtcctgctggtgattatgccggagcaggatctgacccgtatgtcagagcggaccaagaccctggcatgagatcgtatcagtttcaaggcttttcacgtgatcatgggtatacaatggccacttggatctggacgcaacatctctatggaagtgaccatcggcatgcgctacaacatcctgctgcgcaaggtatacatagtcccaagatcatagattacgacgctagcacttgtagcaagcagggacacttccgttgtacggtgctaggcatctgccattcatacattgtactgcaattgcttacccatattgactagtattcctatcagacaggttcctactgaaatgtcattgacctatgcaattcattacagctctcatctatgcaggtttgcacggcaccttggaatcatgccataacctacttttaccacctcctaagcactagatcaacaccgcttcaaccaactgcaagcgaactagtcaaccaagaactcctttaggtcctcaatgaggttctgttctagcgcccctttcc

SEQ ID NO: 709448 - DNA, 935 bp, Homo sapiens
cgtgatgactatgtgtgtacaaaatcccatcagtttcgtgcaccgcgaggtgggcggatcacgtgccggctcgtgagtacaagatcagcctgactagtatggccacctgccatgtttactagaattacaagagttgagacagggcagtggtggtaatgctgggtgaattcacagactagatcaaggagtggtgagagcgtgagagaatggattggacgacgaggtaggcaaaggtctgtgagtgagctgaggatttgcgtgttgctgtccagacactgggtaagtgaagcgaacacatctgtcttgaaaagcctaaatgagatcacagcaaaagagaaggtttctcttcggccatccactagtgaattcgtgagtcagagtgtggcggctttgctcgaaaaagtggtctgatgaagaaataccaaaggagtcgttggggtggttctcctaccatgatgaagttgtggatcgcggagggagggtaccttgaggagattgaaacttgcatgcattatggcttttagaaaagggggagaagacgtctgggaataaagttggtgtcctcaaggaggctagactaagatcatggccgggtttggaaatggatggctaagagactgataccgtcaaaacttgggtgggaattgactcggttggcaattgggaagaaagttatgtccgaggtggtcggcaagaaccaaagattaaagaagggtggggcaggtgtaatacgggagagagtggttgacagtgtttgggagcctgccacagtgaggattgttaacggggggcaacagtaaatggctccagacaatgtgggaagttataggacaacttttgcgcggtgtggaaagaacactcaccaggggtgggctctacagagaatgtgttaactgaatggtgagtttgtcgatatacgcgggggaaaattttgt

SEQ ID NO: 709449 - DNA, 531 bp, Homo sapiens
ggtattaggtattaggtggtattgcacagaaaaattatgggcatgacattaaatacattccaagtgtcatgatcccaacggtaaaacgggctattgaacgtttgattaagatgtcagagaagcctagacatttagcataatgtgcttgagacgagcgataaatttccgagacatgagctttgtcccaaagtacttgatgatcaattattaaagcgtacggaagtgttaatggcaatgggttttgatgtgacgctatatgatgatcgtcaagcaaataacagcggtatacaatttttaaaaactcgtgagattcctattcatgattattcagtctgctcgaatgatttaaatattaccctacgaaatagactacctaaagattttccctatataccgtttaaaacgggtaatggtgtacaggttaaatggtcagaagctttattcgcttgttttactcatcagtatcacaagatatattctccaatattaacagagttatggatgccacatattgatactttaaatgaggat

SEQ ID NO: 709450 - DNA, 255 bp, Homo sapiens
  misc_feature (94)..(94): n is a, c, g, or t
cccccccgggggggggggtgcccccccccaaaagtttttcccgggggggggggtttggggggggggggccccccccgttttttttgtttaggcngggccccccccccccctttgggggggggccccttttttcccgggggggccccccctttgggggggccccgggttttttttcccccccccccccccccccccctggggttttttttttttttttgggggggggggggttaaaataaggggtttttttcccca

SEQ ID NO: 709451 - DNA, 268 bp, Homo sapiens
  misc_feature (66)..(66): n is a, c, g, or t
  misc_feature (135)..(135): n is a, c, g, or t
  misc_feature (193)..(193): n is a, c, g, or t
ataactttacaaaactgactgatttgcaaagtatatagtctgttattacttgaatccatgtaaaanggtgctctgctccaattcttaaatgctcagtgcagaagtagaatgaattccctttaatactcgtttgtnctaacgatgtctttattcttggtagaacaaacagaagataacagagtaggcttatggntccttctttcaggccaaagatcacaatgcctattaattcaaccttatttcactgtccatcgcataagagacgaag

SEQ ID NO: 709452 - DNA, 250 bp, Homo sapiens
attttcacctaagtactatcaacatttggagtgggataattcttgattgtgtgggctgtcttgtgcattgtagaatatttagcagcattcctggcctctgcccattagatgccagtagcatcctacccagttatgacaactaaaaatgcctccagaccttccagggtttcctgggggccaaaatcacccccaagttgaggaactgctttaggtacctagaaggcaggaggatcagagcagatctttgctg

SEQ ID NO: 709453 - DNA, 811 bp, Homo sapiens
tgtgctcttctggttctgtggctgctgtgccatgtccggctggcggctggcccgctctcctctctgcacgctcttacctttgctttggctcaaggccccggtgtggatgcatgcgttcttagtggagtgcttggccgcattcgaatgccctgtgaaatccagcagtagggtgtgtccgatgtctactgctatgtcgcccgtaggtgagcttgcagcacctgacgccgctcatcctcaccctgaatcttgcacacttctggctcaagacgctcgggaggcttacttgcctgggagcctcgggcccagctcctctactagtccccgcgacccatcgctcatgccagcgctgcccccatctggtctctggggaggacgaagtcctagcagtctgcagcgcggattgccgggggccctgggtggcctgcttactcccctcttcctccgtggcgtcctggcctacctcatctggtggacggctgcctgccagctgctcgccagccttttcggcctctagttccaccagcacttggcaggctcctagctgcctgcagaccctcctggggacactgaggtctgttcctggggcaagcgggacagctagccatgccccctctgtattgcgcaccccgtgtccccagcgtgcaaggtggggccggactccccggcgttcccttcaccacagtgccatgacccgcggccccccttggacgccgagtttctgcctcagaactgtcatctcctgggcccagcagcatgaggtcccgaggccagttgtctccgaagcgtatacccaggggtgagtggcgacggg

SEQ ID NO: 709454 - DNA, 178 bp, Homo sapiens
tgagggctccgttccagttaccgctgcccgggcgggtctctggggcccggctcccgcgggggtcgctccgccccgccgtccgcacccgtccggccgccggggaggctctgtcacgccaagccatggccacccgctggctcctctgtctctccctgccccagcctgctgtcgccgcggg

SEQ ID NO: 709455 - DNA, 732 bp, Homo sapiens
  misc_feature (201)..(201): n is a, c, g, or t
gcctcgccccctttttcccccccggaatggtttttgggcccaccaaatgtgtcccgcctccttttccttctgcttgcgggggagaaacccaccccacacttctgcgggggatgaacttcctctccacagtctcgccccactccccacacaggagggccttcgcctcggccctcctggcttgcaagaacgtgcgcccccacncttcgtctgcgtcgccattcatacgctctgccaccccacagaacggtgctcctcctgccgcccctaattttcgaatcccccgaggcgggcccaaatttgggggcccgccctcatagtgtccatgggggcgggcatgtattgagtgggcgccccccccccttcttctggcgaggccttttcggggaaccccctcttttcctctcaggacacccctttcggtgttggtgcgtctcctcctcccgcacgcctccgagtacgacctgcggtcgcacccccccgctcgccactctgcggcagcttgtgtgccccacactatcctccgcccactcctccccggtggatttctgggggcgttctctctgcggtcacccccactctttttctcctaggaccacacattgctttacccccgacagccactccttgtgcatgggcatggtctccatctcccctctgcagaccccgattgttcctcacacctctttctgcatataaccaccaggtgtccccacccaccaatcatagtcaaaa

SEQ ID NO: 709456 - DNA, 1152 bp, Homo sapiens
tgtgtgcaggagagtgagatgcatatgcaccttgcagcaaagatggatgttggtgcatgcaaacgatggtccttgatggatgagcacctgcctgtgacttacatcctgacatgcatcaccctgtgtgtgcctgcattttggcagttccactgcttgccccaaggttgcaccttgacaactgcactatcttagtcatgttgtgttgtgtgtgttgtgttgtgtaccatcaatacatgtcatgtaggtatgattagttgtgtgaatgccacttgcctcaattgtgtgtcatccaacacattgatgacccaggaacacgacaactgtgccagaattgggcttcattgtgcagaactcgaatgccacttttgggtgtgcatgcaccggtgacagggcccccagggcgaacagtgaccctttgtggcccccattgaagaggttgaaggcaacacagttggggtttagcaccaacgttggtcaacaaccccgttgtccattccccagaagtccgtgtggcacgttcacaagtaggtgagggacacacaattctgaagtgagacgttggattagcttggaacccgttatgccgcaaaggagcaaatgcacattgggcagttgtaagttcatcgaccgctagtaagcgagaagagaccaccaaatggccacaccattgtgttggtagacagaacacccattggtcaccgtttgtgccagctttaaaccgaatgtttcccaatcgtttgcacaacagtgggcaagtttagagagcagctttaccaccaagaggtcaagggtgaacgggcccagagatttcagcgcaccgcaaaagggtgataccgtggttgctaacttgtggtctcattcccgatttccaaaggccgtataaacgtacaacggaacacgcacgtgcatttcctccgaaggcaaagacaggcgcgattttatccacccaaaggtgggggccgcccaaaagaagtgaggacccccacgggtgcgaccaagttagtatgtggaccgccggtttaaaacaaggggaatcacagtttaaagagtggcgccctattgtgcagcagtaccacccaaaagtgtggccaaaagggacaaagggggggtgctggaccgagaaaacggctacagtttggcgccaggcggggc

SEQ ID NO: 709457 - DNA, 290 bp, Homo sapiens
cagaagatccagatcactggacattgcgaactttactcctgcatgtgtatatctgtcacaattgtcagcatgacaaaagtgacagatgttatttttgtctttttaaaaaacaattggttgtatatccaagtttttttcatttcgttttgtgccagatccactttttcaacactccccatcaagtcaggtcatctcttatcagttcgtcagactcatggcaatgtccaggtgttccagcccaaaccagtcatgcatggcaaccagtgcaaagtccaattccagtgcatggc

SEQ ID NO: 709458 - DNA, 719 bp, Homo sapiens
agtacataagaacaatataaggagaatagtgaataaagatagtaggatggtagtatagttagagtgtattgttaacgaggacatatggtatatatagtatgtaatatagatgatatattttaggagtaggatttatttatagagtatctataaacagatagtatagatgagaagtatgtcgatgatagttcttcatttaatgttttataatggattatagagtgtattatgctaaagctctagttgttcgctaatatctccgtagacttatggtgatgctagttagtgtagcatgtgctaagttagtagcttcattgttatatgatttactcataattcatcgtcatatagtgtacgtctatccagtagttgatatctctatagtacgctaagctaatcggactataagcatcgatgtatgatacttgcttaatattgagatctgagattgctgacgtgactagatgaattcttattttatatttctattattgtagttagacatttatatactcagcatactcgtatagcctttctcctgtgatagtttatatctattcatgcgattcatatctacgtcgcggcagcgcttgtgtccatcccggacgtcttatctgactctatacgcctactcgaagttaactgacagaatatgcattcgtcacaccgcccccaccacgactcccgatctatgcagcacactgagtagatcgtggtct

SEQ ID NO: 709459 - DNA, 138 bp, Homo sapiens
gccagccgagatcgccgggcatcctcatcgacctcttcgaccgcgagcgtgcacggcgggctcatccagttgacggcttgtagctgccgccgtcggagtgcacgagcagcgagccgtcgcccttgtgtacgaggagcc

SEQ ID NO: 709460 - DNA, 197 bp, Homo sapiens
catgtctgcaataccactgtcttaggctcgagcaataataacacacggtgtcgggattgcataactaaatgatatgtaagatcactgccagtgtaccgctaggtaacactaacaccatattcaattatacccttgcagtctccgtaattcaaacgggagagcaggatggataggggcaacaaccaaacaaacaaaca

SEQ ID NO: 709461 - DNA, 166 bp, Homo sapiens
ggtgcacgccgagaagaaggtgaagatgctggagcagcagcgcagtgagctgctggaagtgaacaagcagtgggaccagcatttcccggtccatgaagcagcagtatgagcagaagatcactgagctgcgtcagaagctggctgatttgcagagcaggtgactgac

SEQ ID NO: 709462 - DNA, 143 bp, Homo sapiens
  misc_feature (54)..(54): n is a, c, g, or t
  misc_feature (70)..(70): n is a, c, g, or t
  misc_feature (118)..(118): n is a, c, g, or t
  misc_feature (132)..(132): n is a, c, g, or t
ctgcgtctcatggtttgagtgccagatcatatgcagtaaagtagatcaccaagnagacttctaatgtatnttatcctaatccctggctaccagacagcacctccaaaaactcttgagncctaggggaacttnccatcctgaat

SEQ ID NO: 709463 - DNA, 1508 bp, Homo sapiens
  misc_feature (1330)..(1330): n is a, c, g, or t
gggttgcctccgcgtaggcctatgagtcgtcgagcgccaatcgagatctgggctaaagtgactgctggataggcaagagctacgtcggaatgggggaacgtgatgggtgccctgaacaatcgatacgtaactgaccagctgatccttggactcctcggatgaagaacagccatataggtgtgcgcaatggagccattgaggcagccagctgggcataagttatgtagacgatcgactggccatctgagtcatatgtggtgaacgcatgaatcgacagtgagaactaacggcatcagtatgtgcagactggcgttctcgccccatatgccttcgttgtaccggtagccggtagtcgccggcttggaaacaaaggagtcggcaagctcagtagccgtcagattgagggtagacctatagggcatagaataatcgcttatcgtgcagaatgctagggatacaccaacttgggtcagaggccaaaaggcggcccctatccttattacttccaccaggctcgcgaaagctcacaccttaagtcggattcagggagacccgacgataaaaccctcctttaggcccccttcggtgcgtaaagtccatcttcgatacatgccattccccgccatgaaacttgcaaagttcacattacgccgatggtaaataagtccctcaaattggaggaaccgaattggtaacaacacgtagggaagcccaggcgatggcagaaggcgtccacaacgtccgaacttccaattattggcctaaactgtaccttcctattttggcatcatctccggggatgaggacacaccgaaacagacgctttcctcaattgccaccacacccgaagtccctttcgtgggggggcaattacactacggaattcccaaacgcaccctcgggagattctgcacacgttggcggaagaatgctcccgggagagggaccagcggagggagaaaaaaagggggcggccttcgtggcacaatttggcggtctttataggggcacccacatcgcggataaacagcttgtgggtcccagcggttcgaatttctttcccgtaaaccaaaccctgcggccgttctcacggcgttagagagggagacccattctcccggccgttgttggcaacagctcgtctaatatagagtgttaaccaatgttggctttgggcgggatacctcttccgtacaaagtgtgcctcatatgcgaacacgtgtcctataggcgaattaacggtaagccgtctaccggttaaaggtggcgagtccaaagactgggtagattctataccaaaattgttttcctgggtaacccaattaagaanattacaaaagctttgcgggttgcggacctaattaggttcggcgtaagaattggtaataagcgagtgaatttgtcgtaagaagcgcttttgctccggttggaaatgggcgtcggaataaagggaatatggtttttataagaaggtaaagtttgaggacaattaaaaggggagtactgaa

SEQ ID NO: 709464 - DNA, 1187 bp, Homo sapiens
aagcccctcttctgggtctgcgacagatgtgaacgactgcggagacaacagacgacgagcaggggtgcagttgtcctggcccagaccttcaggtgttccaatgggaatgtgcctctcgaaaagccagcagtgcaatgggaaggacgactgtgtgggactgtggtccgacgaggcctcctgccccaatggtgaactgtcgtcacttgtaccaaacacacctaccgctgcctcaatgggctctgcttgagcaatggtgcaaccctgagtgtgactggtgaatgtgaggactgtagcgacggctcagatgagaaggactgcgactgtgggctgctgtgtcattcacagagacagtgctcgtgttgtatgggtggcactgtgatgcggatagagggctgagtggccctgtgcaggtaagcctgcatgctctggtgccatgggccacatctgcggtgcttccctcatctctcccaacttggctggtctctgcctgcacacttgatacatcgatgacagaggattcagtgtactcagaccccacgcagtggacggacttcctgggacttgcacgaccagagaccagcgcagcgcccctggggatgcaggagctgcagagctcaagcgcatcaatactcccaacccattcttcaatgacttcaccttcgactatgacatcgagcatgctggagctggaagaaccggcaagagtacagctccatggtgcggcccaatctgacttggcggaatgcctacaccatgacattccccatgcaggcaaggccatctgggatcacgcgctgcggagacacaaccacagaattgaagggactgaagagcatgatcatgcaaaaggttagaacaagagatatcaaaccagagcacatgaagaacatcagtccgagaagaaacaaccggccataaaatcgagtggcaccacagaggaggaaccacgccggcaacacaggggacccgccacgtaagcagagaggagagcacacagcacagaagagaagagaacaggcccacccagaacaaagcgaaaaggcacaccgcacgacaacaacaggaaggagccacacaagtagaaaccgcaacaagaacacaacgtataacaccatagacacaacaacacgaagagagcacgccgcgcagaaaaaacagccacacaaacccaccaccccacccaccgt

SEQ ID NO: 709465 - DNA, 517 bp, Homo sapiens
  misc_feature (348)..(348): n is a, c, g, or t
catgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaatctaatccctaggaatcttgcttataaacaaagcatttctgggacaggagtacttcctctattatagcaatgcttcacatcatattgtgctgcagtttccatcatttttaaaggacagagacataaatgataaaataatgggtatacaaatanttacaattctaccaccctcaaaaaaacaaatatttgtttatgggatttcagagtttgggagattcaaagtattgattgcagttttttttttaaaaagaatgctacaattatgtgggtttttatttctcatgtttatattaaaagctaataaactcttttttatttaaaa

SEQ ID NO: 709466 - DNA, 254 bp, Homo sapiens
  misc_feature (104)..(104): n is a, c, g, or t
tttcatccatgcaaccaaattgttcattccttgctgattctgggttttaaggaaccatgctgcatcatcacagaaaccaggcgattctattctgaagcccagangtaagaaatggtggggatttctgagttacagatggtgcaggtgttaacactatctgccactatcaagggaaaaatctatctatgctaaactttggtcttccctagtgacctgtatccagagtagcgaagatcagggcctgcgtgaccgat

SEQ ID NO: 709467 - DNA, 166 bp, Homo sapiens
catactttcgagcagttctaagggaccatacagagtattcctctcttcacaccaggaccagccactgttggggcatgagttcccagcagcagaagcagccctgcatcccaccccctcagcttcagcagcggcaggtgaaacagccttgccagcctccacctcagga

SEQ ID NO: 709468 - DNA, 1113 bp, Homo sapiens
  misc_feature (239)..(239): n is a, c, g, or t
  misc_feature (466)..(466): n is a, c, g, or t
  misc_feature (471)..(471): n is a, c, g, or t
  misc_feature (479)..(479): n is a, c, g, or t
  misc_feature (482)..(482): n is a, c, g, or t
  misc_feature (511)..(511): n is a, c, g, or t
  misc_feature (517)..(517): n is a, c, g, or t
  misc_feature (519)..(519): n is a, c, g, or t
  misc_feature (527)..(527): n is a, c, g, or t
  misc_feature (530)..(530): n is a, c, g, or t
  misc_feature (536)..(536): n is a, c, g, or t
  misc_feature (542)..(542): n is a, c, g, or t
  misc_feature (544)..(544): n is a, c, g, or t
  misc_feature (581)..(581): n is a, c, g, or t
  misc_feature (587)..(587): n is a, c, g, or t
  misc_feature (600)..(600): n is a, c, g, or t
  misc_feature (684)..(684): n is a, c, g, or t
  misc_feature (687)..(687): n is a, c, g, or t
  misc_feature (890)..(890): n is a, c, g, or t
  misc_feature (1037)..(1037): n is a, c, g, or t
tccctttatctgccatcttgcgtacccgcgatgtgtgcgcctaatctcaggtggtccaaccgagacgccattgagcagctaacctcgtagtcctccacagcgcggttccctttattctgctccgcacgaatgatgtatacagaaacaatccagtcgaaccgaggcaaagaacgtcgccgaaacatggcatggccactgaggttcgcgtcgattggggttgcggaaacggtaatctggcntgcgcgacggaaatgaagagaggctgggtctcataggaaccagcgcgatcagggctagcatcgacgagagagataatctgtgcagtgtgtctcacttatgaagaatgttataggggcgttaaaacagactgagtcgtctggcgataattatgagacgaacggttagaaagtgagttgttttgaagcaacgattccaattagggcacagcaaagtgcatcccgggagntattnataagtanacncgcgtaacacaggtctcgacgtgcggatncatacntngcgcgtangtnagaaancggacntntgctctactccaatgtaaacgatggggctcgatggcntcggangaaacaataggcnatggcatggagcaacgacagactggctgactcccgagccagttcttctaggaaccgaagcgtttgggtctgacggcatcacgtnctnggatctgaagttctgaaatggaagaactagtgtcacggtagagtctctttgagcacctaataaacaaatgctggttgagagtgcgaacaatgacgacgcaatttgcataaactaggtacgaagggattgatagcatcgcatggacaggttataccatggattctttcgtgcgaacggacacatatcttgcattgaagcggctntaccaaagacaactggacgggcacacactggaagtcggagctcaaagcttgtcttgacaggattaaaaaccctggagagacagcgtaacctgtgggaagcctggcttatttttaataattcattggactggcgtttgtttacagacnaatttatggtgtaatggaatcttgagtaaaaattctagaatactctaaagtagtgtttgtacagcccaaaggcccc

SEQ ID NO: 709469 - DNA, 739 bp, Homo sapiens
ctacaactctgggggtcataggtctatgttaagggatcagagagaaaaagcagcctggtactatcttgcaaggcatatattatcatgtcccgtagcttgcttcaaatagcaatgtactttctacctgtacccttttacataaagtgtttaaatttcagaaagatcttttattaagcatactttcacagaataactgtgtttaggagctatattcatataaaaaagttaaacacgcttttttttcctgcctaaaaacaaatacaatgccagtatgtatttttaatggaaccctatttttataatggtacgttactgaatgtgttcatatgcgtgaccgttaagatatatcattggaaggtgaaggttgcaatcaaaagcaccaaccgggggttaacgatttagtagatataaccaaaagggcggcgtttagagtggggatatacatttaaacattttcctggttaaggttcccaagagagtgtaaaggttttagcagaaagcaaatatcttgcatctttatggaagttaaagcatgtttgcaaatattgcagccctctcaacacttcgcccgttcaggaaagatgtggacgcacgcgggtggcgcaatattaagacgctcatggtagcctgtcctagcctcgcaacaaggggggttctggggtcaacaggtaggttcacagaatcaggtctggttacaacccgcccaatttagttcaaattaactcttgtgctcaaaatt

SEQ ID NO: 709470 - DNA, 954 bp, Homo sapiens
ggtacaagccccaactgggccccaagtcccataaatagctttggattccaacatacaagcatttgacgcagtgaggtgctgccgacttgctctgtgactggagcaagtcatttagcctctctgggcctggtgtcctcatctgcagaatggagatgataatatctacttcacaaaggtgtgaaggccctgtgagacaccgcatgtggatttcctcgacattgtttgcccatcgtaactgctccagagaggctgggctcccttttctcgttgcaacactgctgtttatttcaggagatactctaaaagggaagcaagctaaaacaaagaacaaccaaaaacactgatcccgggacaactgcccggcaggacagcagagcaagggtacttggtgctcttcgttggggggatgttgggagaaggggctggagccatcccagggtctccaggctctggaagggagcaccccatgtcctcctctgggtgtggaatagggtgagtgtcttaggggtggagagagaacaggcagagtgtgctctcaccccttagctctgtagtgattttaatgattaaggctactgttcggtctgcatttggacctgagcaacagggacccctgcccagaggtccatccttcagcagggtgcactgcgtccccctccactgcagctgtctctatgagatgaagcatctgtcgctcagtgtagccatcaggtccactgcccctgaaatatgactgactaggttcaaatgttgactctgacacttagaagctgtgccaccttggggcaagttacttcatctctctgtgccttactttcttcctttataaaatgggtaaaataataaccacaccatcggttgtctatgaagattaaatgagttgataatatatgcaaagcacttagcatggctactggcacaagggtcagtaaacgttaactgttccacaaaaaa

SEQ ID NO: 709471 - DNA, 404 bp, Homo sapiens
tgaaacacccagagctggattctcccaagaagaagctgaacccccaactcccatccctgagaagcagcccctgggctgatgatcaggacttacagaacctggggcgatggaaacctctacaaatatcccatttagaaagaccgccagccctgccaacagaatgaaacggaggccaggttgctatggtctctactcaaatgttgactctgacacttagaagctgtgccaccttggggcaagttacttcatctctctgtgccttactttcttcctttataaaatgggtaaaataataaccacaccatcggttgtctatgaagattaaatgagttgataatatatgcaaagcacttagcatggctactggcacaagggtcagtaaacgttaactgttccacaaaaaa

SEQ ID NO: 709472 - DNA, 99 bp, Homo sapiens
ctgctttctcccactggtagtgggcagcttaatgctgtcagcccatgacaactgggccaaactacagcgggtgagctgggcagtgttggtgtacctgag

SEQ ID NO: 709473 - DNA, 646 bp, Homo sapiens
ggagccaagggacgcaagaaatgtgactccgggaaatggatgggaaatggattctgcagagacagcaaggccccgccaacaaccggatttgggcccagtgaaactgaattcggacttctgacttccagaactgtaagagagtaaacgtgtgttgtttcagccaccaagtttgtggtaatccgtcacagcagtcagggccaatggatacgcgggtctttcatccctttcgtgtatgctgcatggtacacctaaaaacgcaggctcggccgggcggggaggctgttgcctataatcccagcactttgagaggccgaggcgggcggatcacgaggtgaagagatcgagaccatcttggctaacacggtgaaatcacgtctctactaaaaatacaaacaattagccgggcgtggtggcatgtgcctgtagtcccagctactggggaggctgaggcaggagaatcccttgaacccgggaagcagaggttgcagtgagccgacatcgtgccactgcactccagcctgggcaacaagagcgaaactccatctcaaaacgaagacaaaacaaacaaaaaaacgcagactcggagcctgataggagagtgggaaccacagactatcaggaaggttctcttcccaaagagggtaac

SEQ ID NO: 709474 - DNA, 1717 bp, Homo sapiens
gccatggcggactgtggaccctgtacacgtatcctgaaaactggagggccttcacagggctctcattcgctgcgtcagatacagcgggggctcagggtccgcggtgctcgtccggcagcactccaggttccatgtgttggccaaagcaaccgcagccccgtgaatttctccgcaaactttcctgccggcaaggtcccagcattatgaggtgtgattgatggattcatgtgatggttatgacgaggcgaacgaccgaattgtcctacattactgtgtagcaagtgacgggagacttgcgtcggcacagctacctctcagcaggtcagacagacctcaggatgagttgacaagcagaggatgcagacatgttcgcgtgaaattctcagaatactagatgcaccgcactagcgcaacgaatcacaatggcgatgattaccaccaaagctatgagcgcaagtcgaatgcggacccaaacaagacaacacacaacgtgacccacggtagcagtcaaagtgcagaatgcgtcagcgaagatcgcaagcgcaagagactctcatcggtgcagccttgacatggggaattgtctcatacagccttgcagtcaacgaaacggaaagggaacgtaacacaacatggatcgagatcccgaaacgagaacggctcgacccactacagcaactagacacaatccccaccataccactcgtcacctagcaccccaccaccatgacatagagaagaagcgtcaataaaatgcaagacgacggaagataaccctaccaacaggcagcacaaaacagatacacaacacacagcaaccaataggggacccacactaatggaccaccaaaaagtgaagacacacaaccacgacgccaacggagacaaaacagaccaaacaagaattagacacctaagaataacagcaacagcatcacgacaacacaacagtagccccggagcagccacatgaggcatacagaccgatagggaaccaagtctgcacacaaccccggacgaaatcaaacgacaaacgcgcaatcacacacacccaaagaacatgcaagaccaaggcaatcaacgaacaaagagactcaggccagacacgaacagctcgaaaaaccaaaccaaatacagagcaacaaggacaagagcaaaacagagaacaacagacagaaaaccagcgataaaccaacgagactaccgagagaacaagagacaaacaacaaccagcacatgtcacgaaacacccgacaaaacgagacggtaacaaaccaaaaaagcacatagaagacacccacgcaacaaatccaaagaaacagcacgacaacaactacaataaacacaaataacaaccaccacaaactacagaacgaaacacaagaccatcagacatcataaacaaaacacacaaacaataacaaatatacacgaaaaacaaacgaacaaaccaagacaatagacatgtatgtacctaacaactacaacaaaatcatagaaaacataacaaataatacattatcacaaactacatgacccaacacaccaaccaacacacataacaaataaacaacacaacaaaatacacaagcaacaaacaatacacaacaatcccaccaccaacaccaaaacaacaaacgatactccactcatcacaactaaataaccactcatacaccaacaatacacaccctcaaaagtacaaaacaatataaac

SEQ ID NO: 709475 - DNA, 826 bp, Homo sapiens
cacagtggctcacgcctgtaatcccaacacttgggaggccggggcgggtggatcacgaggtcaggagatcgagaccatcctggctaacacagtgaaaccctgtctctactgaaaaatacagaaaaattggccaggtgtggtggcgggcacctttagtcccagctactcgggaggctgaggcaggagagtggcgtgagcccgagaggcggagcttgcggtggggctgagatcgcgccactgcattccagcctggcgacagagcaagagtctgtctcaaaaaaacaaaacaaaacgaaaacagaagattccataggcatttgtgtattttttctaaagtgacaacctatttggccaaaagcaaaatgtagatgacgaacgtatagccttgtgttttaacatttttgtgcaaatctcgtaaagtgcctgacttcatagaagacagcgtggatttctcatcagttcctggatttaactcgtgtgcgcaaatagttgtttccattgggagggtcatatgacaagaaacaattgtgccctcaggcaggtatctcattagacacaagagacggacgtggccaggcacaaggtggctccattgcgctgttaatctcaagccaccttgtggggagggcccaagggcggggcagaataaactgtgaagccccaggaagtgggagaccaaggcctggacaacctggcaaaaatttggtcctctaacaaaaagacccaaaaattagccaggcttgggtggtgtgccgccttgtagaccaagaaggaggctgacaggggaaggattgctggaacctgggaagggggagggctccgtgaa

SEQ ID NO: 709476 - DNA, 1184 bp, Homo sapiens
  misc_feature (1105)..(1105): n is a, c, g, or t
  misc_feature (1164)..(1164): n is a, c, g, or t
  misc_feature (1174)..(1174): n is a, c, g, or t
ggtggggggggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataataaaaatgatttctggttatttcagataaatagaaacattcaaacaaaggcaaactacatggagtctagaaggctggagtagaaatagtgttgcagctgcagacatttctctctgcatggagaagttgctgggataatcttactcattgcctggcacctgtgtanccccctaccctccccccccccaacccccctccccatgtatgaaatacttggcagctcantcaaagccantgaacttgat

SEQ ID NO: 709477 - DNA, 1260 bp, Homo sapiens
  misc_feature (446)..(446): n is a, c, g, or t
gctgggacagtgatcacaggtcgattgctgggaccccatctggattcttcgaatcacgtgcatcagcactagcagctacctgtgctggatactgaggagcacgacatctgatcctgatagtagaaacctttcccgtaggacctacaggaacttgcttgtgaggttcatatgtcgcacaaacgttgcatcgttcctatccgacagattgacgctcggttgtgtccttgtactaagcgcttgtgataggcgctcgacttgcgacacgcttgctacgaaccagtgcccagtagatgatctactaccgatttgcagtctggtgcaaagtacactatggaggtacctagtgcagagggtcacagacgcaaggtcatggacttgctccgcgatttgcggacattacaaagaaatacggggtattggaaattggagtggtttcacccaggaanacgccgaggggtgtctctgtcgaaagcgccaatcggtgggttgaacaggcccagagtccctgtcaacgcagagcagaggaagaaaactttccacaaacaggaacaccatacgtcagaaaaggcaaatcggtgtcgaaagacgatacggttacactaagcgtgaaagaccgcgagggccactttcaccttcagcgtgaaaaatgacagggacccatggactcgagattcgcaatcatagtacttagaaacatggtcttttggcacatccgaagcgccttccgtcctcccactggggacaacgaattcgcggggctggcggtaccgactacgttggccattgcagaacaggaccgcccacgttttccaattcgggttcctctgttgaacaaagacagagtaccactacgcaagaagggaaacatctacacgccgaggaacaggggacgttcccccaagggcgtgacaaccctgggaaagaacttggggtcgggccacgtgcaccccgacagcctgaaacagttgcaacttccctccaggagaggggccccaccttgcgggcagaagaacaacacgtggagaccctggtgagtcgaagaaacacacacctacctgtgttcgccaggaacgtgtcgcactcgcaaggggcgcctcttcacatgacacagctacgataacactgggggcagcgcattgacacacgcgtcgcacccccattgcccacgcacgacaaacccagaacacagcccatcgggcgctggtatcgcagagccaagtgggcgcacatctcatacgcaatgaacacccagaggagcaa

SEQ ID NO: 709478 - DNA, 1129 bp, Homo sapiens
ggtggggggggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttattataactggggtatctttacagaaaaaaaaaaaggggggggctaaaaataccgaggggcaagttaccgtcccggttttggtaagggccaaagaggggaataagaaagaaggcggggttaaacgggaggaaagacgggagttgtgggaaccccttggggggtatggagaccacaatagacgagaaaaggttgagagctggcgagtgaaaaaacgaaa

SEQ ID NO: 709479 - DNA, 119 bp, Homo sapiens
ccctgggctctgaaagaatagtgcctctgacctgccccttgatccatatctatactgtgtctttgttacatggcttgacagagcagagcccttacctattattcctatggacacggtaa

SEQ ID NO: 709480 - DNA, 1126 bp, Homo sapiens
  misc_feature (1047)..(1047): n is a, c, g, or t
  misc_feature (1106)..(1106): n is a, c, g, or t
  misc_feature (1116)..(1116): n is a, c, g, or t
ggtggggggggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagattttactttttcaaatatgcatacaatttttagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataataaaaatgatttctggttatttcagataaatagaaacattcaaacaaaggcaaactacatggagtctagaaggctggagtagaaatagtgttgcagctgcagacatttctctctgcatggagaagttgctgggataatcttactcattgcctggcacctgtgtanccccctaccctccccccccccaacccccctccccatgtatgaaatacttggcagctcantcaaagccantgaacttgat

SEQ ID NO: 709481 - DNA, 1110 bp, Homo sapiens
  misc_feature (1031)..(1031): n is a, c, g, or t
  misc_feature (1090)..(1090): n is a, c, g, or t
  misc_feature (1100)..(1100): n is a, c, g, or t
ggtggggggggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtgatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataataaaaatgatttctggttatttcagataaatagaaacattcaaacaaaggcaaactacatggagtctagaaggctggagtagaaatagtgttgcagctgcagacatttctctctgcatggagaagttgctgggataatcttactcattgcctggcacctgtgtanccccctaccctccccccccccaacccccctccccatgtatgaaatacttggcagctcantcaaagccantgaacttgat

SEQ ID NO: 709482 - DNA, 1130 bp, Homo sapiens
  misc_feature (1051)..(1051): n is a, c, g, or t
  misc_feature (1110)..(1110): n is a, c, g, or t
  misc_feature (1120)..(1120): n is a, c, g, or t
ggtggggggggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataataaaaatgatttctggttatttcagataaatagaaacattcaaacaaaggcaaactacatggagtctagaaggctggagtagaaatagtgttgcagctgcagacatttctctctgcatggagaagttgctgggataatcttactcattgcctggcacctgtgtanccccctaccctccccccccccaacccccctccccatgtatgaaatacttggcagctcantcaaagccantgaacttgat

SEQ ID NO: 709483 - DNA, 641 bp, Homo sapiens
  misc_feature (58)..(58): n is a, c, g, or t
  misc_feature (68)..(68): n is a, c, g, or t
  misc_feature (91)..(91): n is a, c, g, or t
  misc_feature (101)..(101): n is a, c, g, or t
  misc_feature (203)..(203): n is a, c, g, or t
  misc_feature (349)..(349): n is a, c, g, or t
gtaacctcaattctactttctgtctctgaattggcctattccaggatctctcaccccntcactcaggntggcgcaatcacgactcattggntcactgcagnctagacctcccagctggagcaattctcctgcctcagccttctgagtagctgggactacagttggttctaaagagtggtgagtcagaagagacgtcaggcagncaagcgacttgggccatggctctgacctagacttctcacctccggagtgcccgagcccactttcctggagaacctgctacggtacggactcttcctgggagccatcttccagctcatctgtgtgctggccatcatcgtacccattnccaagtcccacgaggcggaggctgaaccgtctgaggcccagaagtgttgaggtgaccgaggaagcccaaggctgctgttccttctgtgaacaaagaggccaaagaaagagactaagacagaagcggtcgaacgaggaggcctgagtgagctgggcgggcagcgacgagggtcttggggaacagccctcctgggaatctacattgtgttcccccgattcaagggctcagggtcttgaacgaggttgtgacgccctattgaccgcagagatctagacagtccgtaaagtcccag

SEQ ID NO: 709484 - DNA, 774 bp, Homo sapiens
tggaaccatgaccggtggcctttatatttaaaaacggtaactacccccgtgccgggggcccctatacaaaaacaaaacacaacctaaaaatagggttcctccctgaccccagagacgggggaggggtagggagggggggggtggggggcaggacgtggggctctccaacaaatgtggaatgtgtgtgtgccgggaggggcccaccgtggaggcccccacttccacccccacccgactcctcaggagtggcgcgtgggcgtgtccccttcgcctcgtgttccttgccagaagagtggaggagaggcgggccccaatctctttctgtgagaagtgcctccggtggggaccccggtgtgtgcgtgagtgggcgtggtttccaccaggccggggccggtgttgtggcaagacgcctctcactccggccctcgtgtgttccccgtgctccgggggcccgcgggatctcttctttctccttccattcttcaaggcgttcgtgtctcgagaaagtctcctccagccgagtggggggcccccccagtgtgggtctccgcaatatcggccgcgggggttcccccggaaagggtgcaaaactcctccaaactggtgtgggggcacagaagggggataccttcggccgtgaagaggggcagtaaagagatcataacagggaagtgctcgcagctaacaacgttaatccccgcggaagtggacgtgtaaatgccagcagtggttggtgttgacaaatctccccgggccaaaacccccaactccgaa

SEQ ID NO: 709485 - DNA, 299 bp, Homo sapiens
  misc_feature (299)..(299): n is a, c, g, or t
ggcggacctggttccaacatcatgtagataatgccccgtaaacctctcggaagatgcacgaaatagtattcctcatagacaccattgcatagctcttgttcttcacgttccagttgtactcccggagccatttggtagtcatacacatcatctggtgcatagatccatctcctcctcctggtcccgctttcgtgacttcaacgtcgtcttctacaggcaggaaataggccacaaactggttccctacctcatccatcatgccactaatcatggcctgagacgtcatctccaatgcagtn

SEQ ID NO: 709486 - DNA, 697 bp, Homo sapiens
ctggccttcgtcttcctttcgtgcttggagcttcctgccctcgaacatcagactccaagttcttcaggttttgaactcttggacttacaccagcggcttgccacatggtctcaggccttcaactacagactgaaggataccctgttggcttccctacttttgcggttttgggactcagactggcttccttgtctcctcagtttgcagttggcctatcgtgggacttcaccttgtgatcatgacatctccaagaacttcgttcactgaagtcttaaacccctcacagtgacccatgaggattggaatcagcttctttcaaactcttactattgttgatattttgatcgcttcctatgaatcgtgaatattttaatgacatctaaaatgtgactcctggccgggcacagtggttcacgcctataatcccagcaccttggtaggtcaaggcgagaggatcatttgaggttagaagtttgagaccaacctgaccaacatggtgaaaccctgtctctactaaaaatagtaaaaattagctgggcgtggtggagaatgcctgtaatttgagctatatgggatactcaggccaggagaatcgcttgaacctgggaggtggagattgcagtgagccgagatcgcgccactgcactccagctgggtaacatagtgagactccactcaaaataaattctaaatacat

SEQ ID NO: 709487 - DNA, 558 bp, Homo sapiens
  misc_feature (168)..(168): n is a, c, g, or t
ggtaagtgtcgctagtttgctgcctcgtatctcaggtttgtctctgtttttgagaaatggacagtcttatttgaccaggatgtgcacttcatgtttcctatggtgacttctaaataccagcacagaatgactgtgactcaacatcagaccgtacttgtgttatggggnatgatgagccgcacagacctcactagtttgtgcacatacttaattgtgctatgatggggctgtaacggtgaacggcacgagagagggttcagtccgacattgttatgcatactgggcaaacgtgctggttcacaccgagtttgagattagtatatttatgactactacacttgtgataatcttgtaaatcagaacaattcctccatagttgtatccacatcatgtatgcttttacgcattgttaattggttactaacagcgaacgatcctacataatgttgtgataccacgctatcaacgcaaacttttccccacgtacgttcgtttgggtccaggtggcccgcgaaaaaagaaaatgtttactaatcggaaacaaggggagagatgcca

SEQ ID NO: 709488 - DNA, 1151 bp, Homo sapiens
tgtgtgcctccaggccgtcgcagtgaccacatggagtccgcgcactgggccatcacgtggcaccgctacaggtgtcccatgagggagttgctgtgtggcacctattatggatccccatggagcgccgggtggtaatccaatatgaatgtctcctatggcccagaccatggagacgtcacgtggcgatcagaggagctgtagtggaggatgcacgtggtacctgcagtggctcgtggatgtggtagacgtgggtggaccacacctggtgcctaagggtgcagagcctgtgtgacgtacacgtcgacatgtggcgcctgactaggctctacagactgcgtgttcgcgtggaggcagcatgcgcatcagttggtggacggctcacatggtgccagagaggtgtcagacctgcctggtacatgccatcgaatcgtagtgccagagtagacctacgcaggctcgacgcgtcgtaggctgcgcccggtgccccatggcgcttggccacatacgtgcggtagccgcgcccacatgccctgctcgtgatgcaggaggggcgccagaacgtgtggcatggccatcctagcaaaatctagaggttaagccctgagagtccgggtgggtacccccacagagaggacagccgagcgttgacccggcagggacgaggggcatggagaggtatgacattgggcgggggcctacgcctatgtgaagggccagcgcacacagcacgtgagccagggggacatagccccacgcattcgctttaaaaccgatgggcaacggtctgggaccaatggcattgacgcgatcgcaagggagacaggcccgaagacgccgaggaaccacgaatttgagtgataaacacttaagcaaacttgagggtacgcgcgataccgagagaagggggtaccagcccccattagaggttggacgacgagacaccgtacagcggaggggcccctaataaacgcggcgaggagcttaacacgggcgcacaagtgactggacatagagaagagatgacacactcgggcggcgatagcaccaccatggtagcgagcagaatagggtctcttgtggaacagtggcgcgttagggcaggccaaaaatattgggagccctggcgacacgacagtggacactacacgggc

SEQ ID NO: 709489 - DNA, 160 bp, Homo sapiens
atcacacaggtgtatattgtaatggtttaaggtgctataactgggctgggtgcagtggctcacacctgtaaccccagcactttgggaggttgaggcaggaggattgcttgaagtcacggagtttgaaaccagcctgggcaacaaagtgagaccttgtctc

SEQ ID NO: 709490 - DNA, 420 bp, Homo sapiens
tcgttttggctttttctccccccccaagtctgttttgggttttcacgtgcttcaaaaaaaaggggctgcccccccccccctcacgtcactcggggctcggtggacgggcccaaggtgggaacggccggcccccctgtcccctcgggaggggaacttagcccgacttttaccggggtcccccagcttccggactggccgccccccggaggaaccacgggggcgcttctgggaacgtgggcggggggccgtttccttaccctaccagcctgggaggcccaggtgtaacggtcccagggggccggtcctgcctgtcagctccaggttctggaaccccgtccagcccaaagtgggcggattccccgtggccgactcttttccctgctttggtttgtttgaaatttaaaaaaaacccccttatta

SEQ ID NO: 709491 - DNA, 428 bp, Homo sapiens
tgttgcccaggcagaagttgcagtgacccgagattgcgccattgcactctagcctgggagacaaaatgagactcccatctcaaaaaaaaaaaaaagaaaaagactggcttaaatcacatcaaatgtttatttctgaaatttcttaaacctgatattttgtataattttaaatatttaggcttcagttaaactaccaaaataaaacttaacgtatctcagagtaaataggaaacacctagtggggatttcttttgggtgtctctgtcctaaatcagactcatagcttagcctttccaacctgttcttctttgtgataggtcagttttttttctcccccagccaaactgtatccagctttaaagatactttccaaaaacagtcatggtatttcaggcagaacatggacaatccttaacaatgagcgacca

SEQ ID NO: 709492 - DNA, 637 bp, Homo sapiens
cagacgttcacagagtgctacccaccaagcactcagatcttcatgagttacacagcgtactatgccagtatgcatccgaggatggacttatacgcacaaatgaccagtccaggactctacccaatgaatgggaatgtctgtaagggccccagcaggtagaacatcctcagaaaagaagtgacagaacgatgaatggggatcatgaaacgtactgacacaagctattagcgtatccaggggaagttcgtctacactcatgctgcagtattgacagcaaacttgattgcacaaagctgcctgtgccttatatgttgacggagtcctggcatattgctgattgctagtaggcatttaatatgcgaattcggaatcagatgtcgacattacttccagctaatgtggcatcataggcgtcagctaaggtttaagacatggatgaagactccaccggagactaccatctctaccatgagctctgttaaggaaggctgattagtcgatattgccgctatattctgtacatttccgtgacatgtgcataatcatgcctttcttgctgaagtagtcaagcataacatctccgagtaatggagtcacggtcgtaggagataggaatactagtgattgtcccgtgtct

SEQ ID NO: 709493 - DNA, 253 bp, Homo sapiens
gggatcccgcagattgagaacctcatggaggagctgctacctgaagaagaccacgaggaggagatgaacgccctgcgaggccaggtgggtggtgagatcaatgtggagatggacgctgccccagtgctttggaccttgagccgcatcctcaacgatgatgcgtgaccatgtagtagtatggcggcagatgaagaacctgcaagtgatgcctgagtgattgtgttcttcatgcaatgacatgagtgaagctgaa

SEQ ID NO: 709494 - DNA, 150 bp, Homo sapiens
atacacaaaataagtcttaaaaattggaatatatcaatatcttctctgaccacaatggaaaaaaaactagaaatcaataacaagaggaatgtttgaaaccatacaaatatatggaaattaaaatatgctcctaagtgattgttccccgct

SEQ ID NO: 709495 - DNA, 180 bp, Homo sapiens
aaaccatctgtggggtgcagagtaacctgagggaggctgggccactctgggatatgggcggtctcagcactgtccatccaagaagcctgctcgccatggctgcagtgcgccatttcattctttgccgtccgtctgggttattgcccctctgctccagattgctcaccgcacttcaatggt

SEQ ID NO: 709496 - DNA, 919 bp, Homo sapiens
  misc_feature (143)..(144): n is a, c, g, or t
accagcttatgaccatagattagcgaatttcgaagctcccgtaccgcgagccagactcgtgatttccgagcacatcttgtggtgcgtgtccatgggacaacaagtccgctcccgtggacactggacggcatctatcgctgagnngtcaaggcacagtatgagtgagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgctcccaccatccatcctccagcaccacccacaatcacaagaaagattcccacccctgctcccatgcctggtcccagacagtgagacagtctggaaagtgatgtcagaataggttcaataaaggaagctcattctgaggcctgagtggtc

SEQ ID NO: 709497 - DNA, 326 bp, Homo sapiens
gggatcccacacgaccgaagactgagatcttgatgtcattgtcagtgtcagtgaactgaaggctggacagcatgtcagaagctcacaagttcttggagccttacaactgactcttatccagcccaaaagaatgatgtctgccgcctggacgctattacgaacagccagataatggagtcctcaactacccaaaatgtgcctgcaaattcaaaccggacccagctgggcaaattgtccggcatttgggggacttccacccactatggttactgcactgggcagccctgtgtcttcatcaagatgaaccgggtgtcttcgggtcgtat

SEQ ID NO: 709498 - DNA, 188 bp, Homo sapiens
ctacattctcgatgataataaagtaaacctagtgaaaaaaaaacaccaaattcccttaataataaaagtctctggataagtggtgatgtagtaaagtaaaagagcagtggccagcaatagcaaccaaaaatggtagagctcagaattcaagtaagtatacctggcgggatttttttaaaacaagaaaa

SEQ ID NO: 709499 - DNA, 321 bp, Homo sapiens
  misc_feature (2)..(2): n is a, c, g, or t
  misc_feature (12)..(12): n is a, c, g, or t
  misc_feature (20)..(20): n is a, c, g, or t
  misc_feature (29)..(29): n is a, c, g, or t
  misc_feature (40)..(40): n is a, c, g, or t
  misc_feature (47)..(47): n is a, c, g, or t
  misc_feature (50)..(50): n is a, c, g, or t
  misc_feature (68)..(68): n is a, c, g, or t
  misc_feature (75)..(75): n is a, c, g, or t
  misc_feature (81)..(81): n is a, c, g, or t
  misc_feature (90)..(90): n is a, c, g, or t
  misc_feature (113)..(114): n is a, c, g, or t
  misc_feature (124)..(125): n is a, c, g, or t
  misc_feature (142)..(142): n is a, c, g, or t
  misc_feature (145)..(145): n is a, c, g, or t
  misc_feature (163)..(163): n is a, c, g, or t
  misc_feature (175)..(175): n is a, c, g, or t
  misc_feature (186)..(186): n is a, c, g, or t
  misc_feature (233)..(233): n is a, c, g, or t
  misc_feature (249)..(250): n is a, c, g, or t
  misc_feature (297)..(299): n is a, c, g, or t
anttatcaatanttgttttnattaccccngtgttcctacngagatgnggnttaaatcctatgggattngtttgtnatttanaaaatttanaattgcgtccttactattcaagnnagtagaaacnnttttacacagtaacacnatncgttgttggtatttagtntatctgaagggncgcagttgccntgagcacttggtatctcgcagagcttggacctgtagattttgaggcngattaggaattctgcnngatgggtaagcttccggtattgggaggtggagaaggggagggttcgnnnaaataaataagagttattgcac

SEQ ID NO: 709500 - DNA, 285 bp, Homo sapiens
cggagtgtacgtgaagccgggcaacaaggaacgcggctggaacgcccccccgcagtttttatacgggctgcagacccaggccggcggacccaggcgttcgttgcttaccaagagggtagccccaccccaaggattggatcccccagagtccccgcatcaaaaactttttcttgggccctccccaaatggggcctccacctccttcaaggaagggctccaaggtccccacctgtgggaggtggccctccctctggggtggagccaacaagtttccagtgagtctag

SEQ ID NO: 709501 - DNA, 122 bp, Homo sapiens
  misc_feature (88)..(88): n is a, c, g, or t
ggctcaggatccggcatcctttatgcctccacagcaccttgctctttccccagccaatcactttagatgctgaatcgattttaaacanatgttttgtcatatggctaatcaagagccaggta

SEQ ID NO: 709502 - DNA, 169 bp, Homo sapiens
  misc_feature (68)..(68): n is a, c, g, or t
  misc_feature (91)..(91): n is a, c, g, or t
tgggatggaaatgcggggaaaagagacggaagggaaaccgaaccgaagggggaagggaaggtcccttntttttggaaggaagcctaagaanagcggtttgcccggcccccttaaaggttggaagcgaaagaagggaaaggttcctttcgcccgtttttcttccttgcca

SEQ ID NO: 709503 - DNA, 998 bp, Homo sapiens
  misc_feature (17)..(17): n is a, c, g, or t
  misc_feature (29)..(29): n is a, c, g, or t
  misc_feature (33)..(33): n is a, c, g, or t
  misc_feature (36)..(36): n is a, c, g, or t
  misc_feature (63)..(63): n is a, c, g, or t
  misc_feature (998)..(998): n is a, c, g, or t
cgggatggtgggggttngtttagggtgtngagnagnttgagtcttaggaaaagccctgcgggncggacacgagattatgctagcatatctacggcattacctgtagacagcatgattgctcaaagtccaccaacaaaagcatcagcttttcaacttcattatgctcggccatccaggtaggcatgtgtaactgagcattaaatttcggatggagtcatcatggccaattataggacctagattgctctcagcaggcctgagaaatgagttgaaatgtgcagaactgtagaaactttagaggcaacagattttggctccccgatcagtgagtgcctgttcacagcactatctatctttctctctccaaatgtcactgagccctttagatgtttatattcaccacgagaagccagtcataaagatacaggaaatttgtgcattataaatgcagtatcactgtcttacacttgactgtttgatattattcttgtgtgatcaagagcaccgcacgctattccaactgtacatgaagaaacgtgaacatgttctttccacctgaggggtatagataactgtgtcttctgaagacccacaaaatatcaaagacaccctgtggtgtatacaccgggttggcaggtgccaactgtactatttcacagcttcttagccctgtacatatgtataagaccagataggtcctcctaaaaaaacaaaaaaaaatgggctgcatggtgccacacaggaggaggacttgagcgcccgtggccccttaaacggggtctcagggggaaaattctcctcctggatactccggggcctgggctttttggcgggggggagggagatagggccctctaggggcggggtcgggggattccccgatccgggggaaaccccggagaaaacatgtgatgcaagtggcccgcaaagccgggatacgcattaagccgcggggagggggttttttcccttggccccgcccacaggaagataaaaan

SEQ ID NO: 709504 - DNA, 207 bp, Homo sapiens
cctaagccgcggggcccctcggctgcctcagcttcctgactagttggctggtatcgttcggacgcagtcgtcgattcggttacagcaggacttcgcggtgctcactgcagagatcacgtattgattagtgtgtgtgtgtgtgatgtgtgtatatgtttgtgtgagtcttgtggtgatgttattatgtgtcatgtttgttgggggttg

SEQ ID NO: 709505 - DNA, 845 bp, Homo sapiens
taactgttgacgtttccaaagttgtagagttagtatggcctctgtttccagtggctggggccaaaatacgggatgagttattatctcctactaaccttttagttttgtaaatcactaagacaattgtttgcttggcagatcataagttgacttggcaacactcattactatctattctctgaactgctaagaaccctttcagttttcttcacagctgagacacttttaacacagcgggcccaatgttcatcaactgcaatattcgatcgtgttttctctcttcacttccccttcaaccactttaacaccattccagagatttttttcccctcagaaatattagtcttggacgattgtgcccagctatatatttgctctagcagttcctaatggtgcccatttcatcctgacctaaccagtttattctcaatacatttttctaaaccacacgaatcactacctggcatgtgaacactgatctgtcggtaactggcacgaaacctccgcatctgtatttcatacccataaaactcgatacgtagtctactaagaacaccaccactacacccaccacccccaccctttccgggcagtgcaggctcgctcgcaccgatccctcacaccacccggtgcgcccgcgccccacccgtactacacccgcgcccaacgtgaccaacgacccgcgacctacacgtcgcaccaccgaaaaccaccacgagcgacgaggctcacaacccaagcggcgcaggcctcggcacccaggccccacgccatacaacccgcagccacccagccgcccgaagcacagccgacagccccccactaccgccgacccccaaaccacc

SEQ ID NO: 709506 - DNA, 567 bp, Homo sapiens
agcagccgaccaacagtgaagaaccgtgtctctactaaaaatacaaaattagccaggcatggaggcaggcgccggtaatcccaactactcgggaggctgagagagggaatggcttgagccaaggaggcggaggtggcagtgagccgagatggcaccactagactcaagtctgaatgacagagcgagactctgtctcaaaaaaaaaaatctgaagcataaaaggtttcttcagaaaagcagacacatcttatactaagggttttccaacattattaatctccggtaatttagctcggtctgggagaacgggaaacatcatagtcaaggacctagatacatgagactctgcatttcatttatccaggacggcaacatttggaatatggatgatttggaactccctatttactattaactaagtgatgatgtacttttcaggcggctagccacctgcgtaatgtcccataataaacgtaatccaggaagtggcttagagagcatagaatggtgtaacaagaatttcatctaggcaatagaaaccagtttattcctaaaccccaacctagt

SEQ ID NO: 709507 - DNA, 590 bp, Homo sapiens
  misc_feature (49)..(49): n is a, c, g, or t
  misc_feature (125)..(125): n is a, c, g, or t
  misc_feature (150)..(150): n is a, c, g, or t
  misc_feature (186)..(186): n is a, c, g, or t
  misc_feature (231)..(231): n is a, c, g, or t
  misc_feature (233)..(233): n is a, c, g, or t
  misc_feature (377)..(377): n is a, c, g, or t
  misc_feature (406)..(406): n is a, c, g, or t
  misc_feature (408)..(408): n is a, c, g, or t
  misc_feature (427)..(427): n is a, c, g, or t
  misc_feature (435)..(435): n is a, c, g, or t
  misc_feature (536)..(536): n is a, c, g, or t
aattcgcggccgcgtcgacacggctgcgagaaggacgacagaagggaangtatgaggatggtagaagctctcgtcgaaccagatggatgaagaccactaacggcttttgtttcctctggtaacancaagagacagagcgacatgagagantggaccgcggggctgcactggagaatttactggtangataattcatccctaaagagattgaagtgagcttcagaatgggcnangagccccagagtatctcaaagggactttgcaggaactgcagaagaaactgtctctgctgatagactccttccagaataactccaaagtggtggcctttatgaagtctccatgggtcatactttggacagccatccgtttctggncttcaccttgctggtgttcatgtcagtcngncgttcctgttgggattctnctgctcangtggtgcttaccaacctggctgctctgctgggggtcaaatatggaaggccactgacacagccaaacaccagttgtgacttctgccagccagaagtctgcanacttcgaagggctttaccaggatgatgatgctcggccgggcttctttcgttgct

SEQ ID NO: 709508 - DNA, 134 bp, Homo sapiens
ccacatgtgctggctaatgtttaaattttatgtagagatggcggggggggcgggggtctccctatgttgcccaggctggtctcgagctcctgacctcaagcgatcctcccaagtagctgggattacaggtgcaa

SEQ ID NO: 709509 - DNA, 1027 bp, Homo sapiens
ctccgactgcagggtctgatgtcatcgtagacagccttgcttcgtgggggcctggcagggcccctgcctccccgaccccacgcaaccaatgacaaacccccgaacccaccgcactacactctatcttacccagaccatccactccggcccctgagccaacatgcggcccaccagacccagacatacccagggaacgacaccagatagagaacacaggaacacagatccacatgaaccagaagatcctgacgaccagatgcacatggagatatacaccggagcatcggataaatgggcacacaccactaggaacattcacaggcatatgacacacagaacaagaaggaacacatcaccatgagaggaaacaaggagatgacagagagagagaagataaccatggtgacggcacgagagagatgagaacactgagagagaacgagcacaattgatgagactaccataccccaatacgcaacacctcgacccccatgagagcacatccaagaaaaaccaacataaaaataacaaaaagcgacatgatgtataccgatcgatgtctaagccataaaaggcatagagtaaccatataagcgtgcgaacagcacaacgacatagaagacatggaactcactgagagccacaacaaaacagagaaaagaaaaaagaaaaagatcaaacaccacatcaagacaaaagcacatagaaaaaaaacacatcacaacacgaaaaaacaaagacgacaagcgaaaagaagagcaacacaaagcaggaccgacgaagacaaaaaagacaccacgcagatcacagaccgaaaacaaaacaacccaacacaaaacagcacccaaaaccgacagaacaaagaacaaacaaaacagagaaaagacagagagtagcgaccacaagacacccaaacacaagccaaaaaaaagtagagatagaacaacgaggcggcaacaacatggaagccaaaaaacaaggacaacaagcacaactaagagagaacaacaaacacagatgatcacaa

SEQ ID NO: 709510 - DNA, 255 bp, Homo sapiens
cttagtaaggactgatgatacctaagcattattgctagttttatgtggatgtgtaagaaaacacccatatttttagcaaggcaaactgaattaagtagatatgtctggaatgcttataatacttcagtaaagaaaagaaaaaaagaatagataaagcaaaatggccaaatcttgataaatgtcgaatctgggtaacaggtatatgtgttcactgaattattctatttttgatagttcatatttgaaaatttttat

SEQ ID NO: 709511 - DNA, 1445 bp, Homo sapiens
tgcttggacggaaccctgcgctcgtaccccaccccggccggacgaccatagccagccctccgtacacctactatcacctgcaccctccgtgactagccccaatggccccactgccgcgcagatccagactgcctgctgcagccgacctgtcctgcactgcctgactgccctacctaccatatagtactgcctgcacatgactgacctgctgtacacactctgctaggtagctgccgagaactgacctaccagtgacgtcagagtgcctgccatacaaacctgcgcagatacagacctaggcagctactaacggccgtcctaacgtatgtacctagtaccatagtctatactcacctatttgacctgctgatgattgtcggctatcttgaacgaactatttggccaaaataactaaactatacacccaatactcccatgagtgcagcaggcgcaaccatagctagaccgaaaactagcattgcaagctagcaatgaacccaaccgaggtcaggcccgaatcctatacctatacaggactaatacaaaggacaaccaggacttgtcgatagacttggcgatccagcctgggactagaattagcccacctcgcgacgtagtagcattataacatatctgggacacagacgcacatagttgaatacaggtaccactaacctgtgcacactagccagcaaaacatagggaccacttgaacaaaaaaaattagacccccacaaatactagtagtaagactatacgatatgcagcacaacatataccattgaaatgaccctaggtagaaaagcccatccagagcaataagggggtagaaccaactgtagacccatagttagctgcaaagattggcgatgctgctccggaaaatactaggacttgggctgagaatatactacgttcagaacaaaggaacaacacttagggaagcacaagcttgattaattgaaacgcttaaaacactacgacgactaaatataccaccaaaaacacgatggtggaagtaaccataccacctggtggatcaacccaacgcgcaatctgcccatgtgcatgtaaatggcgcgaattaccatataaccgttaggctagtataagttattgatccacatcacacactcccacttaaaattatccaatggagaatggaacccgataccataaccagagtaaaggacacgtaggggaaccaccgacacaaaacaaaatgacaacaagaacaccacacggaaacacataagctagagatgcgcaaaacaaacgacgactacatagcgcagccaccaaagcaagacaaaacggagatcgaagcacacaaagcacgtgcaaagggcacgaaaaactgcggaccaccacaatgatcaagcaaattacacaagacaccgtacgaacaaacatagcacacgaccagtcggcgacacacgcggcgc

SEQ ID NO: 709512 - DNA, 880 bp, Homo sapiens
  misc_feature (558)..(558): n is a, c, g, or t
gggcacacgatcaggttgtgtgtgttgctgaagaatctgtacaagcaccattgtgacgcgatatgcggatcgtgcatgtgactgggtgcccggcagatgagaatgcacccacagtgcagtcacatcaagcaacaacctgaaagagcgcgatggaaccccatgtgtggcctgtccatagagaagagctggtgtggccccactgtagagagcttgccctaactctcctgatagaaccaacgtccaagaagtggcactaacacatactagagttgtgatgcaactgtagcctagatttgattttcacctacccgatatgctcattgagcactgccaaacggcctcttgtgggcagaggactcaacgggacagtgatgctagccttgaattaaacaaaaaagtgctatcacagaagcaaaagatagccacggcttgactgtgcacttgttgacgccagaatactttccgtgtgcacaaaacgaactcggagcgctgactcaaacgacatgtgcggtgcactattatgatagcccagccgtcgacatacagcgacccgtgaantataagatttgacacgttgtcccatgcacagtttcctgcgaacatcctcttggcaagaccacatagtttacccaagtgatgctaccaacaacagtctataacgcatcccacagcacttgcttacgaccgcttctgtgttgcccgtagccgttagaattacacctcctgcaacgtagtctacaacccaactagattaacaacagaattactgaagtagcaattacataatatcgtcgcggtggcccaagacactcacacactatacaacgattgtgcttcactcctgagtaggtacacaacaagaccaaaccgtgcctctaca

SEQ ID NO: 709513 - DNA, 757 bp, Homo sapiens
ggacctattcaccctccacttcccgtctcagaatctaaacgtggtcaccttcgagtagagaggcccgcccgcccaccgtgggcagtgccacccgcagatgacacgcgctctccaccacccaagccaaaccatgagaatttgcaacaggggaggaaaagagaaccaataacttccaaggccctgcgtttgtttatcgtatcacagagatacgttgtaaacaaggcaaattctgtactgatattctctattatttacagtttgtatattgttccgtcacagtattcgttacgggtcaggccagtttatatacatgcatctcgcgcatgacgcgaaagccagcacttcggcagtcgtcttctgttcctacttctgacgtttactttgtgggtgtgaccgatgttcgattataatctcaaacggagaaaaaaaacctctgtaaagaacacagccaaaaatgacaacagaaaaaaccaatcttattccggagcattccaggtgaacgttttgttggatgtatgtacttgagctggtacatatgaagtagttggtcttgtacttgagatggttaacacaggccacagatgactaggtccctatgttgttctatccgttgtggagtcgtatgacgtcgctgtttattccgtgtaggcctgttcgatgtatgtgtgaaacatatgtggtccacccaatacaaccaggactgtgatattgcggcagtggttctaaagactggacaaacgtcaaagccccggggcat

SEQ ID NO: 709514 - DNA, 516 bp, Homo sapiens
  misc_feature (82)..(82): n is a, c, g, or t
  misc_feature (292)..(292): n is a, c, g, or t
  misc_feature (320)..(320): n is a, c, g, or t
  misc_feature (323)..(323): n is a, c, g, or t
  misc_feature (330)..(330): n is a, c, g, or t
  misc_feature (335)..(335): n is a, c, g, or t
  misc_feature (339)..(339): n is a, c, g, or t
  misc_feature (343)..(344): n is a, c, g, or t
  misc_feature (347)..(347): n is a, c, g, or t
  misc_feature (350)..(350): n is a, c, g, or t
  misc_feature (355)..(355): n is a, c, g, or t
  misc_feature (363)..(363): n is a, c, g, or t
  misc_feature (365)..(366): n is a, c, g, or t
  misc_feature (371)..(372): n is a, c, g, or t
  misc_feature (381)..(381): n is a, c, g, or t
cggatccccatgggacaatcacttcttgctgtcctctgtgctgtgctgaggaatccaacctctctcttaagtgacgagtgcnagagagaaataggattatttgtgttttcggaaaaaaaccttagttcattgtagagggcggacagcaagaagtgatgaggacctttaagaccacggtagtggaatttgagaggcaagagcagatttgagaactattaagaagacagactcatcagccctgtatacatgattgtgtaatggacacagaggaatgagggacctatgtaagatnacgtggagttctggggtgggtggctagntgnttcatgntaccnttcnccannatnggnaagtncagcacangnnttggnnagaaagaanatgagttcaatgtgacaccaacttgatcccggccagacaagcagctattacatgggttgacatagaagacgttcttcgacgtatagacctaggatagattttagtcgatatcgcttatgagcgtcgagtcagatg

SEQ ID NO: 709515 - DNA, 522 bp, Homo sapiens
  misc_feature (82)..(82): n is a, c, g, or t
  misc_feature (292)..(292): n is a, c, g, or t
  misc_feature (320)..(320): n is a, c, g, or t
  misc_feature (323)..(323): n is a, c, g, or t
  misc_feature (330)..(330): n is a, c, g, or t
  misc_feature (335)..(335): n is a, c, g, or t
  misc_feature (339)..(339): n is a, c, g, or t
  misc_feature (343)..(344): n is a, c, g, or t
  misc_feature (347)..(347): n is a, c, g, or t
  misc_feature (350)..(350): n is a, c, g, or t
  misc_feature (355)..(355): n is a, c, g, or t
  misc_feature (363)..(363): n is a, c, g, or t
  misc_feature (365)..(366): n is a, c, g, or t
  misc_feature (371)..(372): n is a, c, g, or t
  misc_feature (381)..(381): n is a, c, g, or t
cggatccccatgggacaatcacttcttgctgtcctctgtgctgtgctgaggaatccaacctctctcttaagtgacgagtgcnagagagaaataggattatttgtgttttcggaaaaaaaccttagttcattgtagagggcggacagcaagaagtgatgaggacctttaagaccacggtagtggaatttgagaggcaagagcagatttgagaactattaagaagacagactcatcagccctgtatacatgattgtgtaatggacacagaggaatgagggacctatgtaagatnacgtggagttctggggtgggtggctagntgnttcatgntaccnttcnccannatnggnaagtncagcacangnnttggnnagaaagaanatgagttcactttcgcacttacttaatcctggcagacaagcaggtatcaaatggattgacctggaagacaggtccaggctatagcttagggagatgtatatcatactgctcatagatcaagctatgggtactcggatgagt

SEQ ID NO: 709516 - DNA, 135 bp, Homo sapiens
gcccccccccccccccccctttttttttttccccccctgggggggtccctccccccttaaaaagggccggcttgggggcccccccccctttttaaaaaaaaaaggtttttctttttggggggggtttttaaatta

SEQ ID NO: 709517 - DNA, 357 bp, Homo sapiens
  misc_feature (66)..(66): n is a, c, g, or t
ttttcaactgggtagggggaaaaagttttgccccctttgaggcccccctgccaatgttggaaggtntggatttgccccttgagccagggggatgtttcccgggggttaaaaaactttctgggtccttccctgaacaagcctagtcccacattttttcccagggggtccattttgggggtccagggggataaatccaaaatcatgttttggggataatttttccaaagggtttttttttgtggactaaatcaggggggggcattcccctataatgtaaaaagatttacatacaaacaatgcaccccactatccaagggttttacccactaaaaccccccataacccttggacagggga

SEQ ID NO: 709518 - DNA, 645 bp, Homo sapiens
ctcgcggcgcgagtctatcccgaaacagcccagcaaaaaaactccgcgttatccttttcacgtgaccggccttttcgcgccctgccttgctactgctacgaaccgagcatacatgaccttccgttacttcagccccggcagaagtaaagaagcatcccgcaccctgacttttattcgtcagttacgctccatgatccccgagatgttaaaacctccccctacccgtacaagttcccgagagccgtagctccaaactttgaacagcgcgagccgcacaattacttgcgcgcgtcccactaagataacctccaagaagagtcacgctccttcgagtacctgcatgacactcctgcccttatccagagaccctctcctcatagctaacaaggcgcgcccgaagatcgctatttgtaccttcttgtacttattcttgcccgatcgtactaccgaagttactccgactaattaactcctcactaaagtacaatcgaccgcatccccgccataagctatcggcgaccacagcaactataggccgacggctcaacctaaccagtctcagaaatcttacgcgagacgtcgggaatcgcgctaattacctaccgcccattaccgagtgacttaagtagtaagtaatgctccggg

SEQ ID NO: 709519 - DNA, 97 bp, Homo sapiens
  misc_feature (14)..(14): n is a, c, g, or t
  misc_feature (43)..(43): n is a, c, g, or t
gcaggttatagccnagtgtccccaggcatgtggcaagcaagcncttctgcctccttttgggcatgaatctcggacacctgcggccccactgtccaga

SEQ ID NO: 709520 - DNA, 971 bp, Homo sapiens
ctgccggggccccttttatgtgttgtggcctttttgaggcgacacacgtgcttttatatccccgttgggacaccaccaccggtttcgaccctaacccccgggctccgggtccatattgctcctgcgccaagacactccgggggtttgtcctcctccacccgaacctggcgctgtttgttggagtggggtcctgccccccggcggcaatctgtcctgagtcccacctgggtgagtacccccccgtcgtgctggcaaaccaggtcgtcccccgctcccccgtggtgcacagacaacctgtggcgccaacaacatgcgtgcccgccgaaatgggcggcaagacccactccaggataggcgcgtcctcccgccaggtaaagacggttgaagcaccccgagcccccttctgggacttccaacaaggtcaggacgggaacatcattggatagccccacaaggagtgccagagaggactagaacgtctctgcacccacaagagagtcgcaaccaagaaacgccgcgcagaccccgccggcacggtggacgacccactgtgtgtcgcactctctcggaactgaagaagctgggaaaacgctccgcggagtgaggaggagaccccacgaagaacggttgcgccacacaacacaaaacggggcaggcggacccgagaagcacaatacggaaccaaaggagctatattgcagggggcatcttcctacaacatagtgccacctggggaaccgggaagttaaaaaagcctcatcaaacctcgtgcgcagtggatccgagagaagtggaacaaaggtggaggccaatagattaagtgggagaagggcacagatacccagggtctgtaaggcgagcaacgggcgcccgcagactgaagcggggggtcctgcccctaccacaagacgccggaagacgacccgcgggcccccggcctttaaaaaaaaaaattacaaaccacatataca

SEQ ID NO: 709521 - DNA, 466 bp, Homo sapiens
ttcattgggtaaatgattacacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaagggggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctcacaattatctcaaaataaaaataaaaatt

SEQ ID NO: 709522 - DNA, 245 bp, Homo sapiens
gcccccccccccggccccctttttaaaaggttttttaaaaaggcaaataaaaagccttcccctttggaagattccagtaactttctgaagcaagtttttcctctacaaaaacctatttttgccatgaggaacggttccttttcagggagtcctttgagtttttgttattcagggaaacaaagttcccgttgtttttttagtccccaaagtttaacaaagcccctaataaaaagggctttccccca

SEQ ID NO: 709523 - DNA, 1409 bp, Homo sapiens
accttcctcaccccctcgactcctcacctactcagtcctcacgtcctcactccgtcaccttcctcacttccccatctcctaactccgtcactctccttctacgtcctgtcgaccttccgtcacactgcctcaccctcctgactcctctacgtgcgtcactttccggcaacgctccggtagctgcgcgtcacgctctatgacgtcgcgtcagagccacctgaactcgtccaacccgcgatcgacgtgggtccatctcgcatacgagtacacccgcgcggtcacagtacggctaacctctcgcgaacggtctcgtctcacaacgcgaccgatacgctgcggacctcctatcggggcgtcacatgacgcatacactcagccgagggtgcacttcatgtcaccacccctccagatacagcctcacatccagcccatacggatgcagagtcacgggaggccgtaaccatcagccacatccgctcaagtcgtgccactacagcgcaaacgatcaggccaatatgggttgcacgcgcttcgcggcaagagatcccaatacaaagcgtccaaggcaccgatcacacgcgagcagaccacctagcggagagaagaaacctcccgagcaaagtacggacaaagagccggaccacgtctcgagagcctcacacaagacaatagaccacgggcgaaagcaccgtgcctgcccacgacgaccgcatggccagaacggcaaaggggagagtcaccataccccgcaagtaccacgccaaaagagcccacatgaacaaatcccacgacacacacaagcgcagcacaagacacccgtagcacacaccgagaatacaccgcagcggcaacaccgaaagcgcccacacagggcccgtgcaaacccgagacgcggacacgcggaagggacgacaacagcgaacaccaccagcgggcgcatcacccagaaaagaggcacacaacggaacgaacgacaacaaaacaaaaagcacacatccgaggcctgcaaacggcccagacagaacacgacgaaggcgcacgacaccaaccacgacgccagcaccacagccgcggccagaaccccaacacccactgcaaccacgcacgacgcgcccactacaggagccaacaacgagagaccaccccacggccggaggaacaccaaaacaggagaacatgacacactcagacgcctgcacccacggcgcgcacactccactagcgcagagcacacacacacacaaggcgcaagaaaaaccacgacgaaccacaacccacgagacaccccgccaacccgccacaacgagcgaccgccaccaacgcggcgcaccacacacagaaccaaccagacccccggaacacacaaggaggcacacacacggacacacacacacacgggagaccaagag

SEQ ID NO: 709524 - DNA, 1080 bp, Homo sapiens
tatgtaaacaacctagtctttaatttggcccaaggccggctggtggcaagcactggaggccccaaaatcttccaaaagggaaggggaggaggggcaaagcactggtgctctaccaggtgctagcctgccccgtcctgggttcctggcgaggagagggtgggcaaggggagagaaaaagcgggaaattcggcgccatacaagtatctccccaggttttcagccactatttccagtgggtgaaggaggaaacgtggaggcacaggcatcccccacggggttctacgtggctagttccaggggttaaactaagatcccttcccctaaatcttcttaccccccagcaaaagtggagcgtgaaaaagcaaccgtggggagagggtcacgagagaggccccactcgtgggtggccgtgagggaagccgggggcagggcccaagacccgaggggctcaagggcgacaagagggagtggcgagggaaagacagagaaggagagatgaggcgcgtggagcggaagaaagaatagacatagggcagaagaagagggaagcaaacccagcgaaaaccacgaaaaagggggaggacccacaagaacaggggggataccccagacaagcggaacaccacaaaaagggggcggacacaggcaaaacagcaccgcacagaacagacaacaacaacagaggcacaaccctcggaagggcgcgacaaaagaaacgacccgagatatactgggggaaaagcggcgagaaggggacacaaacccatccaagagaacagacgaaaggacccgcaaaccgacacagtccccccacggaaaagcacccaacggacatctcggaagatgcgcggaagcacggacacgtggcgaagaggggacgacacacacccgaggtgataaaagaaacgggcgcggaaaaagaagaggctggaaaagagtcagcacagggaaccagccggggacacgacggaagaccaacatgacaaaaactgaacaaaaaagaaagaggaggcacaccgcatcacccacgacaagaacagggtggcccaaaggagaacgtccatgggggaatcgaaggga

SEQ ID NO: 709525 - DNA, 266 bp, Homo sapiens
cctagtgactcacgcctgtaatcccagaactttgggaggctgatgcaagtcgattacgaggtcaggagttcaagaccagcctggccaagatggtgaaaccctgtctctactaaaaactacaaaaaaggccgggtgtggtggctcaggcctataatcccagcacttagggaggccaaggcgggcagatcacgaggtcaggagatcgagactatcctggctaacatgcccagctaatttttgtgtttttggcggagacagggtttcac

SEQ ID NO: 709526 - DNA, 544 bp, Homo sapiens
  misc_feature (178)..(178): n is a, c, g, or t
  misc_feature (328)..(328): n is a, c, g, or t
acataatttcttctttgagaagtcatgtcttgccacttttcaagtggtgttgcttttctgtaaattgttaagttccttatagattctaggtgttagatctttgtcaggtggatagattgcaaaaattttttcccattctgtaggctgtctgttcaccctgcatgatagtttattttgntgtgcagaagctctttagtttaattagatcccatttgtcaacttttacttttgttgcaattgcttttgatatttttgtcatgaaatctttgcccatgcctatgtcttgaatggtactgcctagattttcttttagggtctttatagtttngggttttacatttgagtctttaatccatcttgagttaattttcatatcaggcataaggaaggggtcccagtttcaatcttctgcatatggctagccagttctcctagcaccctttattaaataggaaatcctttccccattgcttgtttttgtcaggtaaccaaaacagcatggtacctggtacaaaaacagacacatagaccaatgtgacagaat

SEQ ID NO: 709527 - DNA, 143 bp, Homo sapiens
atggcgcgtaggctcaagacattcccagccttcgccacatcttctttgtggtcttagccttcttcgcggcaacattggctttgtctgcccgccatagccactctgcttccgatcatagcgcctccttccctggccattcaacg

SEQ ID NO: 709528 - DNA, 433 bp, Homo sapiens
caggggcccgctgaggactgcagaaacacacatctgcacaacacactagtccttgtttctttacttagcacatattccagctacccttttctccaatgaacataaattcccatagccagtaaaatgaaaaagtattttgatcaggcaaattatattaatattaggtagaataaatacacatgaaatctataggaaacatttaacatgaaataagttaaaaatcataatattgagaatacttagataatgtttgtaacaactgggaaatgagctgggagattagaagagaatatacagtaaggaagatggcaaagaagaaatgaaacatttttgaaaagcagtcttggaataaaacagagaaaaagaaactaaaactttgaaaatacattcctgtcattagtgaataagaagctgaggtgtgactaagaagaca

SEQ ID NO: 709529 - DNA, 750 bp, Homo sapiens
  misc_feature (293)..(293): n is a, c, g, or t
tgccagtcttttttctctatcatgtgttgtcgcgcaggtagaggcttactacaagtgtaacaacgtagtctggattgaggccacagcgatttctagcatagtcagtagaattaggattgtgaagatgataagtgtagaggaaaggttaatggttgatagtgctagggtggcgcttcctattaggtgcatgagtaggtggcctacagtaatgtcagcggttaggcgtctgcacagggctattggttgtatgagtagtatgatggttctataaatacatagtatggggataggcngtgtatgtgcgccttgtggtaagaagtgggctagggcatttttaatcttagagcgagagcatataatctctgcgcccgctcataaggggatgcccatggctaggtatatagatagttgggtggttggtgtaaatgagtgaggcaggagtccgaggaggttagttgtggcaataaatatgattaagtatagtagtataagagatcaggttcgtcctatagtggtgtggatggctatcatctgttctgaggatagtttgaatagtcaatgctgggtggtgattagtcggatgatgatgagatatttgtaggtggggatctaatagagcgggaaatagaatgatcagtgctgtggcgggtagtcctagtattgtgggggcaatgaatgcagcgaccagattgtcgttcatgatggttctcagggcttgtgatattttttattatcatgcgctttggctag

SEQ ID NO: 709530 - DNA, 443 bp, Homo sapiens
acgcacatgacgccaacatggcacaagtgtggcatagtaaaattctgggctgtggtggctgcggctcaggcctgataattccagcagtttgggaggccgaggcgggcgaatcatctgaggtcaggagttccagaccagcctgtgcaacatgatgaaaacccttgtctactagaactacaaaagctagccaggtgtggtgatgggcgcctgttatcccagctactccggaggttgagtcaggagaattgcttgaacctaggaggtaaaggttgcagtgagctgtagatcacatcactgcactccagcccaggacacagagtgagactgtctttttttttctttttttttttttttttggttttttttttttccccccttgccctttttttacacccgggggcccggggggttttttgtggaatccggggccccttatgaatccc

SEQ ID NO: 709531 - DNA, 481 bp, Homo sapiens
cctggggcctggaatgacttagactgggtgtgatgaacattcatccatggtattaccctaccattttgcgttgtcttataaccaaggcacactccccactaagagtttactgtcagagaaagatcagcatagctagccaccctcctttaatttacaactcattatctgctacaggttttctttaattccttgatcactggattggatatgtttttttcccaccaggtactcagaggtctgctgtgaagtgagtcccggtctaggcagacttcagtcatcccttaagcgtgagcatgttgcctgcatggctgggtggggactggtggatgtctctggagctccagaaccttggagaattcctcatggaatttccctcccagctcttagtgcgctctgtggggtcaggaggagcctcttcctccaggttttccttctttcctcctcagcagagaaactggagaaaggacattaaactctgtgc

SEQ ID NO: 709532 - DNA, 316 bp, Homo sapiens
  misc_feature (202)..(202): n is a, c, g, or t
tagaggatcccgttatgccaacacatattaaaagcaaactgactcaactacaatcacttctggttatcactagtgaaccgaaagtgacttaaagtaaaatcattattagcagaagaatagaaacataacttcattgagaggtcactgtaaagagaacagttcattaaaaggttctgtataaaaagaaaagggaagggcccanatagcccatttcagggcagagcaggtgaaaaggcctggaacactcctggtgcgctcactgtcggctgctgaacagggagcccaaggccagcaggatggagggtgtgaccgaggg

SEQ ID NO: 709533 - DNA, 560 bp, Homo sapiens
  misc_feature (8)..(8): n is a, c, g, or t
tgagcgangtaaggtctttgcggcccgatgttgatcgaaagtacgctatgccaagcgaaaagctaggagagcggaagagacggacagcacaaaactgatcggagacgagcagcttagcggcggggcgttcaccggtgagctggacaacgctgtcgacaacgacagacgttcaagaacctgcaacgggagcgacgttaggcaagatcggcatcgccagccccgacgacatcgcggcgtgctgccgcgagtgcgcgcgccgctcagaaggcatgggcctccgatactccggataatcgggcagccgtttttccaaaggttgtgcaggttgcaaccgagcggtgggacgagatcgtcgagtggatcatgcgcgagagtggatcggtcagagcgaaggccgaattcgtgcccgaaggcgagaacggtgaagaggggcgcaaagcgcccggcaggccggcgcctcggacccgcccgcttacacgttgaaccggaacagcatcacgtcgccgtcgtggacgacatattccttgccttcctggcgcagcttgcccgcctcgcgcgcg

SEQ ID NO: 709534 - DNA, 555 bp, Homo sapiens
tcaggcggccgggaagatgggggacattcagacggagcgtgcctaccaaaagcagccgaccatctttcaaaacaagaagagggtccggcggggagaaacgggcaaggagaagctcccggggtactacaagaaacatcggtcggggcttcaagaacacccaagggaggctatggagggcacctacatggacaagaaagtgccccttcacgggtaagggtgtccattcgagggcggactcctctcgggcggtgggtgaccaagatgaagatgcagaggaccatggtcatccgccgagactatctgcactacatccgcaagttacaaccgcttcgagaaagcgccacaagaactgtgtctgtacaccgtgtcccccgtgcttcagggacgtccagatcgggtgacatcgtcacagggggcgaggtgccggcctctgagcaagacagggcgcttcaacgtgctcagggtcaccagggctgccggcaccaagaagcagtcccagaagttctgaggctgacatcggcccgttccccacattgaaataaagttattttctca

SEQ ID NO: 709535 - DNA, 331 bp, Homo sapiens
gagagttaatagcactataactggatactattagttcccattttatataattttatttatttatttagagacggaatttcactcttggtgcccaggctggagtgcatggcgtgatctcagctcactgcaaactctgtcccctgagttcaagcgattctcctgcctcaggctcccgagtagctgggattacaggcatctatcaccgcgcccggctattttttgtatttttttattttagtaaaaccggggtttaccatcttggccaggatggtcttgaactcttgacctcatgaaccacccgcctcagactcccaaattgcggggatataag

SEQ ID NO: 709536 - DNA, 189 bp, Homo sapiens
gtaaccgagcactgggatggcacatgttgttttttgaatagtcattccagatatgagatgcgtgttacaggaagtcccttgtcatccgtaagaagccagcccacttctctctaaggagaatggcccagtcctctcccaagtccagacaggggacggtgactggcatggcttgacgatgtaaacttatgt

SEQ ID NO: 709537 - DNA, 643 bp, Homo sapiens
  misc_feature (75)..(76): n is a, c, g, or t
  misc_feature (99)..(100): n is a, c, g, or t
  misc_feature (185)..(185): n is a, c, g, or t
  misc_feature (197)..(197): n is a, c, g, or t
  misc_feature (208)..(208): n is a, c, g, or t
  misc_feature (223)..(223): n is a, c, g, or t
  misc_feature (235)..(236): n is a, c, g, or t
  misc_feature (239)..(239): n is a, c, g, or t
  misc_feature (243)..(243): n is a, c, g, or t
  misc_feature (245)..(246): n is a, c, g, or t
  misc_feature (257)..(257): n is a, c, g, or t
  misc_feature (297)..(297): n is a, c, g, or t
  misc_feature (300)..(301): n is a, c, g, or t
  misc_feature (354)..(354): n is a, c, g, or t
  misc_feature (382)..(382): n is a, c, g, or t
aagaaaaaacacctgggccggggtgaccactaccatcaagacgcggagaccagtagtggccctgaacggtgggtnnctgatatttattgatacaagacnngggggcagggtaaggagggtgaatcttctaagtgattgacaaggtgaagcaagtcacgtgattacaggataggcgggccttcccntttaggtagccnaagcagagagngaaggcagcatatgncagcgttttctnntcncacntnnaagaaagatcnaagactttactttcactatttcttctaccgctatctactncgnncttcaaagaggaaccaggagtacgggaggagcatgaaagtggacaaggagtgngaccattgaagcacagcaccacagggangggtttaggcctctggatgactgaaggcaggcctggataatatccagccttccacaagaagctggtggagcagagtgttccctgactcctctaaggaaaggagactccctttcacggtctgctaagtaacggtgccttcccagacactggcgttaccacttgaccaaggagccctcaagcagcccttatgcgggcgtgacagaaggctcacctcttggcttctagatcacttctcataatgtccctcaagagctgagccct

SEQ ID NO: 709538 - DNA, 140 bp, Homo sapiens
  misc_feature (51)..(51): n is a, c, g, or t
  misc_feature (94)..(94): n is a, c, g, or t
  misc_feature (106)..(106): n is a, c, g, or t
gagaagagacagaagggcacttcagaaagaggaatagtcagattccagtgnatttcctagagctctgtgggcatctgggtatagaagttactgnatgtttatttgnaatattcagagtttacatacacccagagcagtgg

SEQ ID NO: 709539 - DNA, 607 bp, Homo sapiens
attgacctatttacagatactagtgccaaatcatgttgagctctttcttaaagaaaaatagaatacattaaaataaaaaaagttaaatgtttttttaaggatacttatacatccatggatatactgaaatcattctaagtcatctttatcattggcaaggtgaatggaagacaaaggaaaacattgtaaagataagagtcctgtgtgactaatgacaataaataggatgaggatgataaagagaattctctgtatctgacaattatggagagagagagagagaatgtggctgaggtctcagacccctagaccagcactttccatatagaaatacaatgtggggcacatatataactttaaattttctggtagccacattaaaaagaaatagtattaattttaaaaatatatttcactcaatctatccaaagtattatcatttccccatggaagcaatattttgttaatgagatatctcatatccttttcattgtactaagtctctgaaatcttgcgtgtaagtcatacttaaagtggatctcatttcagtctagccacgtttcaaatgctcagatgttgcatggctagcatcttattggatggggcg

SEQ ID NO: 709540 - DNA, 717 bp, Homo sapiens
agggaccttgccggggccggcgatgagtgctctccggtgatgagggcgaggtagcacgtgttggttacctgcacgcgtcgtaatccacgtgccgtgccggtgactccgtggggaccattgatgtgcgcggggcgaatgtttgcgtggccctttgtttctggtctctgtgggtttatggttattggcgtgtatgctgccggtggacgcccgggggtggtggtgattggattcggtgtttgcggccagaagcataatagtgtagtcgtggatggtgacgcctcagtggaagattgccagcaccgttgtgtgtgccttgtgtgtatggtgtttgaatgtgtgaatgaattgcatggtggcttgagtgccctgtggttgtgactggccagcatgcaggttgtgagatcacgatgatgcagcacatgtggcccttggtgcatgcagtgcaaggtgttggctcagatctgtattcttaattggatgtttaagagcatgtactaccttgttaccacgcttggtttgagtgtagtggacttacttggacatgacgatgcactcgagatagatgtggtaattttatacgcacatttatcacacatgattttgttttcgacccttgcaaggtaaacattaataataaggtggtacttgtgtagcttgtacataaaagccaaaattatagttgggaaaagaaataaactttataacttgcaaggtgta

SEQ ID NO: 709541 - DNA, 692 bp, Homo sapiens
aactaggctaggtacgaggcgggggtgactcggcgagccgggcgtaagatagcgcgacgtgtatgctcgggaggactgaagggctgtcacaagcccgtatgtatgtatgtcaagatatacatatgcatgggtctggtgcggcctcttccgtgacggataatataaaacgttggcttgaaagctggtgatagcatgatggtatgagagagaagcccagcattttccatcctggagatctacaggattatcaaatcgagtcactgtcgaagaagtgctggattcccgtggtcagcaatgtcaacattggagctgggtcagatgccctccgctgatccatatggtgggcaggcgagtcctgactgatgagctgaaacacggatatgatccgtcacctctatgtaccagaattccgagacatccagatccaccattatcctaatgggattgtaactgtgagactgtgcccggctcctgaaagccgagcaccatgcaaccaacggggtggtgcacctcatcgattaaggtcatctccaccatcaccaaccaacatccagcagatcattgagatcgaggacaccgtttgagacccttcgggctgctgtggctgcatcagggttcaaggacgatgcttgaaggtaaagcggcagtacacgctttggcccgaccaatgaggccttcgagaagatgcccga

SEQ ID NO: 709542 - DNA, 941 bp, Homo sapiens
cacaaaacaagaggttaatgcttcttggggcacatttcttagagggcttgctgagtgtgtaagatataatcgactttgttatgtgttacatgacttctgtgacttcattgaaaatctgcacaattcagtgttcagactctggattacttcagttgacctttgtgaaggttatatctgtgtagaatgggtgcccccttgtgtagcctataaattgtatttctttcactctgtattacaagtaaaacttactaaaagaaaagaggtcgtgttcacattaaatggtttggttgggcttcttttagtcaggctttctgaacattgagatatcctgaacttagagcatcttcaatcctaagattttcatgaaaagcctctcacttgaacccaaaccagagtactcttactgcctgcttgttctaagatgttcaggaaagagcatagacagttgcagtcgttttcaaaagtgagggagaaacattggcctgccgttgtaaataacaagacatcagtgctgtattgtttgtaaactgcattttagaagaatgggatagtataataaacaataaggagtaagccaccattaaatagggcacccatggtagataagatagtacttacatctacaagcatatgatgatttaccgttactaatcgggaaagaaaagcctaccatgtcataacaaagcccaaccaatatggcaccagacactaataacgaggtgacgttcgaaggtgggaagtactacacacaaagaagggaccataatggaaagcggtggaaaattcgacgaaaaacaggttgcccaagacacaaatttataagatgacttgcggactacagcacaggagaacagaagaaccaacacagaacaagaacacaaacagaagaacagagcaagacagggaatacacaaacacacgagacgagaaaaaacacaaca

SEQ ID NO: 709543 - DNA, 588 bp, Homo sapiens
gagagagagagagagagagagagagagagagagagagagagagcgtgtgtttgcgttgtttttctctttagctcggcttattacactggtgtgtttcgtcgagatgctcacacgactgaggttgctcatcggttcaaagatttgggagaagtttcagagccttggtgctgattgcctttgctcagtatcttcagcagtgcccatttgacgatcatgtagctgagaattgtgacatctcacttcataccctttttggagactaattgtgcacagtggcatctcttcgcgaaacctatggtgaaatggctgtctgctgtgcaactcatgaccctgagtgaaatgcaggcttcttgctcacagagatgacaacccataccttacccgattgctgagaccagaggttgatgtgatgtgcactgcttttcatgacagtgaagagacattcttgtatgcatacttatctgaacgtgcccgacgacattcctactttgatgccccggaactccttttctttgctaaagggttgctagtattacggaatgttgccatgctgttggtataagttgctgcctgccgcccgggtcgatg

SEQ ID NO: 709544 - DNA, 170 bp, Homo sapiens
gcctgcacaggagaactgctgataaatcttaagcatcaacagccaaatcgaccaagcagaagaaaggatataagagttgaagaccaccttactgaaataagacatgcagacaagaatagagaaaaaagaatggaaaggaatgaaatcccaggtgtccagtgtggagagag

SEQ ID NO: 709545 - DNA, 119 bp, Homo sapiens
gtccgttcgagcctgtaaggaccctgagaaaggcatgtggggcctcgttaacaatgacggcatctcaacgttcggggatggtggagttcaacatcctggagaactacatgcacgtggca

SEQ ID NO: 709546 - DNA, 127 bp, Homo sapiens
tcccctgtggcgcgggggtctcaccactgttgcagctgttctcaaactcctggcctcacgcagtcctcctatcccacagtgctgacattacaggcatgagccaccacgcctggccaccactagtttt

SEQ ID NO: 709547 - DNA, 299 bp, Homo sapiens
  misc_feature (34)..(34): n is a, c, g, or t
  misc_feature (135)..(135): n is a, c, g, or t
  misc_feature (149)..(149): n is a, c, g, or t
  misc_feature (171)..(171): n is a, c, g, or t
  misc_feature (265)..(265): n is a, c, g, or t
gaattcggcacgagccgtcagtgatcacgtggcngatcatgcactgctatcgtgagtaagcatgcacttatcatgtgccgggagccggggaggccttccactctggacaaagttcatgaggaaggatgctcggantacgcaaatgcggnatcgagcctcaggggtccaccnggatattctcgagcatctcccccgcaaaaaaaccagagtctgcctactgtattgctttgtgctctcacctctgatttcactgggggctatcccncaccaccatctcactctctctgtcaaagagttta

SEQ ID NO: 709548 - DNA, 866 bp, Homo sapiens
  misc_feature (22)..(22): n is a, c, g, or t
  misc_feature (90)..(90): n is a, c, g, or t
  misc_feature (102)..(102): n is a, c, g, or t
  misc_feature (111)..(111): n is a, c, g, or t
  misc_feature (268)..(268): n is a, c, g, or t
  misc_feature (276)..(276): n is a, c, g, or t
  misc_feature (298)..(298): n is a, c, g, or t
  misc_feature (333)..(333): n is a, c, g, or t
  misc_feature (348)..(348): n is a, c, g, or t
  misc_feature (354)..(355): n is a, c, g, or t
  misc_feature (364)..(364): n is a, c, g, or t
  misc_feature (372)..(373): n is a, c, g, or t
  misc_feature (379)..(379): n is a, c, g, or t
  misc_feature (387)..(387): n is a, c, g, or t
  misc_feature (394)..(394): n is a, c, g, or t
  misc_feature (412)..(412): n is a, c, g, or t
  misc_feature (613)..(617): n is a, c, g, or t
  misc_feature (744)..(744): n is a, c, g, or t
  misc_feature (746)..(746): n is a, c, g, or t
  misc_feature (761)..(761): n is a, c, g, or t
tgattttttgatgggggggatntccaggacacctccaagaagagtgtgctgaaagccatcgagcaggctgacttactgcaagaggaggangagtcgccacgnatttgctgnagaagatgggtttggcatagcccctgctgggccggggtgtggcgatggggtcctggcagcgtggcgggaacggctgcttctcctctgcccagggccctgttcttggtggatctcggctgcccctcctctgctgcctcagccttgcggagtagagctntggggctncaggccctacaaacatcccctnccctcccaccccctaacctccactttccccttttncccacgaaagttttnaaaagnnaaggaaggncaggaaanngttgancccagatngggggtngtctattttggcttttanttccctgcctttgcagaactgatgtcacctcagaatgtccttccctccctaataactgtaaatatataaatatgtcaggttaaagggaaaaggtgttcagggcacttcttgtcctctctgtcccataacctacctccacctccaccctcctcctagccagccaggcagcttctctgcctgggaggggagcctggacccccnnnnnactccttggctgcagtggggcctttatccagtgccagggaggaacaacatagttaatttttttctaaccttgccactttgagggaaggaagggttgggggaagggcaagctttatgggaccctggtncnggccctggcctttcnctccagttttggggtaggcaggaactgggagggggggggagggggagggggaagggtttgcctttatgtccttttttttgaaaaaaaaggaaaagcatttttgga

SEQ ID NO: 709549 - DNA, 183 bp, Homo sapiens
  misc_feature (68)..(68): n is a, c, g, or t
cgtcggagctcgtcaagtgtaagtagaatatattgaggaccaggtctcttattgtaccatgtccctanctgtagttttacatgagtgttttctggtgctcacgacatttctggtaacagtatattatctcattttacaataaaaagcaggctggcaggtgtggggtcatgctgtaatccagca

SEQ ID NO: 709550 - DNA, 195 bp, Homo sapiens
atgagcagaatgtcttccatttgtttgtatcctctttaatttccttgagcagtggtttgtagttctccttgaagaggccattcaacgcctccgggccattcaacgcctccggccattcaacgcctccgagccattcaacgcctccgggccattcaacgcctccgggccattcaacgcctccgggccatgcctccg

SEQ ID NO: 709551 - DNA, 291 bp, Homo sapiens
  misc_feature (46)..(46): n is a, c, g, or t
  misc_feature (149)..(149): n is a, c, g, or t
  misc_feature (201)..(201): n is a, c, g, or t
  misc_feature (234)..(234): n is a, c, g, or t
  misc_feature (260)..(261): n is a, c, g, or t
  misc_feature (291)..(291): n is a, c, g, or t
gaccccactttatccgtgggcagcagtgcaggtgaaggtctccccnatggttccatggctgggcacagccaggcaggacactggacacgctgtagcagccacagaggtcacgctcaggtggtccttgaacagcgctcttcccacttgangggcgtccaggtgaacggtggcaccagaaggcatctctcagggccggtcagntgtgcacgtgacgggttcgcttcttgaacctanagagcaggtcctctgagggccggtcnnggtgcagctgacagtcgggggttggcagcn

SEQ ID NO: 709552 - DNA, 121 bp, Homo sapiens
aaccgcaaccgagggtaactgaggcagcggaggtggtggtggaggtggaggtcagtgatagtacaaactacggcaagagccagcgacgtggtggccattcacgggccattcaacgcctccg

SEQ ID NO: 709553 - DNA, 795 bp, Homo sapiens
gacatcctatctgtggataccctggaacacggatatctcgtgagcttaacgtgcacatcgcgtgttctgcagtagccatctcggtacgctctcgctaagtccgaagagagcctagatggatagagcgtatcactaatgtcatatacatcatctgtagtctcgatgcccagaggcagtatctgggcattcttcgtcgggagaagtccccactttgtttggagcgtaagagtcgtacgttcaagcatctaatacaggtcgacttcctagggaagcgtggcgtgttgcccaatgttgggtgctacagctgtgtgttctctagtgagtgcccgaagaagcttccgaggccagaatgagtaggactcgcttggtatagggggacaacggttggtctcatagatcgcatgtttcgacgtcacatttacttaccaatgtagttggcgagctcttgccctgtgtgttaagccatgaatatgtgacaggtggtcaaatagggattagtggagcaattatcttggaactaccacacgttggatgaatccggcgattggtttgtgacaccacggatatagttacgcatcgaacaagattacggttcctaacattgcacaatctcctgtgggggtggccccctgtttggccggtatttgcaatagcttgggtgtaagccgaaaacgagtaaaggggcagatccccctgttgtgattcgggccgagattttccctagagtttgcgaggagcaggctctcgaaagttctagtcttgcgcagaaccggggaggatcaattgacactcacg

SEQ ID NO: 709554 - DNA, 1314 bp, Homo sapiens
  misc_feature (479)..(479): n is a, c, g, or t
  misc_feature (1314)..(1314): n is a, c, g, or t
tcacaaagggagtctcactcggttacccgggtctggattcgcaggggcgcaatctcggctcacttgcaaccttcggccttccggggtttcaaggtgacttctccgtgcctcagcctctcaaggcagctggggactacgggcgcctgtgccaccttcgccgggctataatttggggatattttaagatagaggacggggtttcaccatatggggccaagctgggctctggaaacttctgtgaaccttggtgtaactccggccacagctatacagccttctcaaaagtggcgggggatttaccagggcattggagttcaccatgtgcccaagcttagaggggatacacggtttctcacatttatatgcgcattttgggtagaaaatttactcccaggggtacccattttttatagcgttgtgggccatacacatatacatctctataaatatatgtgggggaatcacaatatgctctctcnctcttcaaaaaaagccggtgttttttttaaaaatctcagaggtggggtctccactcctttataacgaggtctcaaagctgtgggtgtttctttataacactctcaaaaattattgtgggcccacaatatgaggaattttgcggccaagggggcaaggtcaccactcttgtggagatctttttcttgtggggaaaataatcaccatgttgtggggtgtccctaatattttatccttacgcacatattatatttctagaagccccccgcggtttctttccgagggggaaacgaacacttatttctaattaagcgcggaaaaagaagacatctggggaaaagctgtggtgtttttttctccccggagggtgcctttctaatgatagctttttgtgagacccataccgagtgtgaaggagaatccacttccccttacaagaggacctaccttttcttttcgcgtggctttcacactcttcgaattccgcttacaatctcgagttggaaggtgaggacgtattcttgttctacatctcacgagaaaggttcctctttgtgatacagtcatcattaatccttttgttgtggcagcaagagaagaaaatcatttttttgaggaggagtaagaaaacttttgtcggttaaggaaaccacgtgtgaattattatcaacctctctctggggaaggtttcatcatgagggcgacacaaagaggtgcggcgacatacaaatttacttttttcggggggggagagaagatagagtgttaaaaagagagacgcccgtgtgggggaagagcttctctcccagatgtgcgaagagacagaagtcgtgttgn

SEQ ID NO: 709555 - DNA, 569 bp, Homo sapiens
  misc_feature (531)..(531): n is a, c, g, or t
  misc_feature (544)..(544): n is a, c, g, or t
gtaagatcgagcgagtaggcagtgctgcagaggtggctgaggagcagcgggaaggaaaccaggaagcactgggctggaggcagtgaagaccacaccacgtacgagtgggagtccaccaaccatagacctccggactcactgtatcgagacagccgatgctgtggcatctgcaagggactcgacacttgccacatgtcttgacgtgcgcctgaaactacaagggagtgacgtcacagagccatctttctctgttctgatgcatttcagcacttccacatggaccacactgactgacacagaggttacatgacctgccccgttggcctcttcactctcacactgaatgaaacccaacagcccatttccaaagcgacacgctcacacacctgtgcacacacacgtgcacacatgcacactgtgccagcaactgagatgggcaagcatttcggtacacctgtggagaccccagctcgtgtgtcacatggcacgcctgtccctctatcacagtccacaggacatgcggtgctgagngcctcaggcctgngttcaaaacctagaatcaaacgccc

SEQ ID NO: 709556 - DNA, 193 bp, Homo sapiens
tgttgtccttagtaataaaaacgtattttgcaaaaaaaaaaaaaaaaaaaaataagctgggcttgggggcttgtgcctattcacccgagtaacttgggaggctgaagcaggaaaattgcttaaccctggaaggcaaagattagcagtaagcccaagatggcgccattgcatttccaaccttggttcgacagat

SEQ ID NO: 709557 - DNA, 683 bp, Homo sapiens
cacgtggatttcctgtaagatgtttccagggggttaaaaacttgccctggccgttacattccctaggccatggagttgtttaccccgggcaccgaaaaagggtttcccatgggtccccaaaaatgggcgcagggaacccataggattggaaagcgtccaccggtgggatagggctcaagaactccccgatggggtacactatgcgttttctgtcttgggtctgtgttgggttttacttataatacgcctcccattccgatttcgggagaccttcttatggttcacgcaccccaaccggggccgccccattccgcggagaagatgatgggaattactgacccgcagaggggtcacgagcacacatgaactctggaagaaatggtccatcaatatgattcccgcacagacttgggaaagaacataggaaaggcttgcccatctagttatcctctccctgatagttcttcgcttaggataagttaaaatggctggagaagccccagtttggattggggaagctcatggggctttcatggtgaaggcccctaagtttctgggaaaacccctggggacgaaaccggggctaaaattggacgagctgatggatatgaccccccgtcccagagatttgttttaagttccagacttccaattgtggccaattaaaagtgctttttttgtga

SEQ ID NO: 709558 - DNA, 763 bp, Homo sapiens
ggtgtgacctacgtgagttcctcgaacgttgcgacatggtcgtaattgtgaggtgaaatcatgcacttggtggacggtgatagatctgcgatctcgctatcaatgtaggtgctatatgatcagatgatgacacagctgtgaatctgacctcactgaactcctaacacggggacaggactgagggtggatcgcattaacgtgttcgtacactgaggtcaccggcggctagtacggtgtgcccgctgccgtgtctcgtggctctggagcccggcaccatggactccgtgcgctcggggcccttcgggcagatcttccggccggacgaccttcgttttcggtccgcagtggtgctgggaacaactgggccaggggcactacacagaaggcgcggcgctggtgtccctcggtgctggatgttgtgatgaccaaggaggctgacgagctgtgactgcctgcaggggtttccagctgacccactccctgtggtggggggacctgggtctgtgactgggtaactcttcctcatcacgtaaagatccgggagagaggtacccagaacaggatcatgatagacgtaagggtggtgccttcgccccatagagtgtcagagcacaggggtgcgaggcctacaatgccagccctctctagtccaccagctcgtataaacagacggacgagagctagtgcattgctaaagaatctctctaggatgtttgcttcaaagcctaaagctgacagccgactactgggccttgacacctgt

SEQ ID NO: 709559 - DNA, 202 bp, Homo sapiens
agagaggatgctaagcttcctactcactttctcctagccaccctggactttggagcgtggggtgggttggacaatgctccccactcttaagacttccccccctactccccccgcatctttgggggaatcggttccccatatgtcttccttctaaactgtggggctcctcgagggcattgaccgtgcctaatgtctgtgtgtg

SEQ ID NO: 709560 - DNA, 345 bp, Homo sapiens
ccatgcttcctatgatagagcctgcaggcgtgagccaattaaacctcttttctttataaatgacccagtcttggttatttctctatagcagtgtgagaatggactaatacagatggcattttccttttgtgatgactgccaagaatatcagtcctgggtgcggctcaatttcaacagccttaaaatctactatccacacatacaagcttcacaaatcatttttggtgctgatctgccacactaactatattttacaggacaatgtctatttccacattcccattttaaagtatgaatcctggctggcgcggtggctcatgcctgtaatcccagcactttgggagg

SEQ ID NO: 709561 - DNA, 276 bp, Homo sapiens
  misc_feature (54)..(54): n is a, c, g, or t
  misc_feature (270)..(270): n is a, c, g, or t
tctttccttttccttcctcctttctttccttttccttccttcttttcttttctntctttccttccttccttctctttcctccttccttccttccttccttccttccttccttccttccttccttccatccttccttctctctctctctctccctttccctctttccttctcttctcttcttttctcttctcttttctcttctcttctttccttggagtcttgctctctcgcccgggctagagtgcagtggcgcgatctctgctcactgcnaagtcc

SEQ ID NO: 709562 - DNA, 373 bp, Homo sapiens
ggcataatcgatggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgagggaagagctacgagagtatcaaggagcggggtgaagaaaattaagaaagaagtggggaaaggggaaaaaacggccaaagggagtggaaatgaagaagaaaagggtagagaggagagagaaattggatgtcccttttaaaggatctgtggggagatgagatcagaaggactggaaaggactgagaatttggtggagaggccgcaaaagggggagtggagg

SEQ ID NO: 709563 - DNA, 835 bp, Homo sapiens
cggggtccagagtggcagtaaaggaggaagatggcggggtgcaggaggtctctgtgctgctgctgcagtgtggtgctgctgctgcggtgagcgtgaggcccgcacccccgaggagctgaccatccttggagaaacacaggaggaggaggatgagattcttccataggaacccgactatgagagtttggattatgatcgctgtatcaatgacccttacctggcaagtcttggagaccatggataataagaaaggtcgaagcatactgaggcggtgcagtggcatggctggtgttgtgccagttggagtctgcactggcctggctgggctctctttgtggactttcctgtgcgactcttcacccaactcaagttcggagtggtacagacatcggtggaggagtgcagcccagaaaggctgcctcgctctgtctctccttgaactcctgggctttgaacctcacctcatgtcttcctggcaaagcctccttgttctcattgagaccgagtggcagccaggttccgggatacccgaggtcaactgctatctgaatggcgtacaggtgccaggaatcgtccgtctccggaccctgctctgaaaggtccttgagaggtgctgtaccagtgtggctagaaggagatctaacgagagagaaggcacgtgccaattgattccacaggtggatccggcggcctggacagccatgccttacacatcagctcccaggagcatctccgattacgcgaagaatccagtgtaacctgtcgcccatatatcccgcaagcgacagcatgaagaagaagaaatgcctccaccaggcaacggcgccgccagccg

SEQ ID NO: 709564 - DNA, 780 bp, Homo sapiens
  misc_feature (12)..(12): n is a, c, g, or t
  misc_feature (139)..(139): n is a, c, g, or t
  misc_feature (151)..(151): n is a, c, g, or t
  misc_feature (233)..(233): n is a, c, g, or t
  misc_feature (247)..(247): n is a, c, g, or t
  misc_feature (265)..(265): n is a, c, g, or t
  misc_feature (302)..(302): n is a, c, g, or t
  misc_feature (318)..(318): n is a, c, g, or t
  misc_feature (351)..(351): n is a, c, g, or t
  misc_feature (362)..(362): n is a, c, g, or t
  misc_feature (384)..(384): n is a, c, g, or t
  misc_feature (399)..(399): n is a, c, g, or t
  misc_feature (411)..(411): n is a, c, g, or t
  misc_feature (463)..(463): n is a, c, g, or t
  misc_feature (531)..(531): n is a, c, g, or t
  misc_feature (537)..(537): n is a, c, g, or t
  misc_feature (628)..(628): n is a, c, g, or t
  misc_feature (634)..(634): n is a, c, g, or t
  misc_feature (651)..(651): n is a, c, g, or t
  misc_feature (682)..(682): n is a, c, g, or t
  misc_feature (687)..(687): n is a, c, g, or t
  misc_feature (695)..(695): n is a, c, g, or t
  misc_feature (714)..(714): n is a, c, g, or t
  misc_feature (718)..(718): n is a, c, g, or t
  misc_feature (773)..(773): n is a, c, g, or t
atgatacatgtnccacgttggtgtgcagcacccattaactcgtcattcagcattaggtatatctcctaatgctatccctcccgcctccccaggagtactgttatttcatcaggttaagattcaatgttgttattaaaanccctagcaaggnttggcatgtaaccaacgccgcctcaacacagtgaccccttgtctcaggacccatttatttgcttattccctctgcctggaanacgccaacaaaggntaaaagcagcatcccaanagaatttcccctcttgctggtttctttcctctacaantgactacctcaatggnctcacctctccagcctgtgacaaacagcatccnctccactgggnctcactaaccctacccaggccnccagcctgtcctaancatgggagggancaacacggggcgcttgtggtaatcccttgcaaaacgctgagtaccaactggngtgactgggtactcagagccgcatgcaagcttccgggaaggaaagaacttttcttttttatcgctgangaaaanaggacttggtgtgtatttgtggggtgacaatctttatgtactttatgtactgatgtggaaaaatctccaagatctgccaagtgaaaaaaancaagangcgtggagttagccccngctttgcacagaaggggtggggggggaatgncaccncgtgtgtntatatatggcatgggtctngaangctcctctttcgcttcaggctacacttggatcaacagttcccactctggctcttnaaaaata

SEQ ID NO: 709565 - DNA, 342 bp, Homo sapiens
aatggcacgaccaaggagctgcaagagcacacagcaggaggtgagcggtgtcgagtgagggagtgagggaagcttcgtctgttatttaaaaggccattcccctttgctcacattcccgcctgagctccaccttctcagatgagcagcagcattagatgctcataggagaacgcacctgttgtgaaccgtgcatgtgagggatcgaggttgcgctgtccttatgagaatctaatacctattgatctgtcactttctcccatcacgctcaggtgggaccatccagttgcaggaaaacaagcttaacaacgcccactgattctacattatgctccttggtcgtgg

SEQ ID NO: 709566 - DNA, 343 bp, Homo sapiens
  misc_feature (11)..(11): n is a, c, g, or t
cgactcgttanatagcgacgcatacaacatgactgttaagtaacagaggtaggtatacaatgttacaggataggaatacaaccctgggaatcctcacagaagcaatgaggagaagaggaagagaaaagctgacagtgaagaaggggagtaagtggactttcagcagaagaaataacatgaaagaagagtgagagccagctgcagaatatagccttccagatgattccagcttcctcatctctcacttgggtcttcataacctgcttccaacttcaggtctcactggtcctcccctctatcttaaccttccagccccaaggagacgttcatgctccactctcca

SEQ ID NO: 709567 - DNA, 152 bp, Homo sapiens
tgtctagaggatccctcaattttcgggctaacccataaccaaaaacacatactatatgagcagacagcatttgacttcactgaagagcaaacagtatccttaaaatgttaaggcaaggccaggtgtggtggctcatgcctagaatcccagca

SEQ ID NO: 709568 - DNA, 1089 bp, Homo sapiens
  misc_feature (496)..(496): n is a, c, g, or t
  misc_feature (509)..(509): n is a, c, g, or t
tggcttgacagagtcttaactttaaaatgattatcgatacaccaagtaatacttgtaacaagtttcttgaatttctatctcatcttagttaattttgtgatttaagaagaaaacataaagagcgagccccaaacaattctccacttagttattctcactgtggtctcatacaccattatagcaagaaatgtggactacttttagagggctgtgggcgtgggtggctttcacacgaggtttcacaaagaaactatatttatacatactttttctcaatagaaataagagccccgtggaccttctcagagaaagaggtgtttgaggggaaaacaaaaattatttataatctccccttctccttttcttctacaagagaaattgtggtatagtggtgcgcgtattatatttatttattcttaaacacaccatagatatctcttagagacacacaacaaagagcaggggcgggcgcggctctcatagagagtatatctcncctcgcgagaggnggcccccacgaaagcctatatagcgcgcgtataacccgcgagtgtatatctctgtgtgtctacacagacgaggtgggtctcccctatatatatgtgtgagagcgctccatatatatatatagagcatatagagcacacgtgtggccgccgggcgtgttctaacaacacggcgtctgtgagcacgtgtgggagacacacacgtgtgcgattaagctgtgtggggcacctccttgtgtggcagaagggggacacccttttatactttctcggggggggggcggtcgaccatataaatgtgggggcgccaatatctataacctattaagagcaagattttataaagagccctctataaggcgtgtaaaccatttctcttacaaactacttcttcaacaaaagggctggcttaataaacacgcgggcggttccaaacaaactaaaggccgtggacaaattagtatgccattaggcgttggtctttagaaaaaaactctagggggccctaaacggggagaatattgaactttttaactggcaaacactttttttataccagagtgtcgaaacaacatatataagg

SEQ ID NO: 709569 - DNA, 219 bp, Homo sapiens
agtgagacccagtctctatcagaattttttaaaaattagccaggctggtggcatgaagccgtggtcccagttacttgggaggctgaggtaggaggattgtttcagcctggcagtcgaggctgcagagagctgtgattgcaccactgcactcctgcctgggcagcagagagagactcttctcaaaacaaaaagaaaaaaccacacacacacaaacaaaag

SEQ ID NO: 709570 - DNA, 304 bp, Homo sapiens
gcaggaattcggcacgagaaagaaaggagtccgctctttgctaggccacaaggctggaatcctttctttaaaaagcagaagcagtgatgtggagacacacataggacctaactggtttttccttgttttactgcctgtcctggaagctgctgtctttctttgcacatgcgtgtcagcctttccctggtacagcgtaatcttagactcttaactgagcactttagtggcataaagttcaacacttgtatatttggggatgcttaaagacagcagagcattaaacagaggttgacctgctacaatt

SEQ ID NO: 709571 - DNA, 337 bp, Homo sapiens
agttcagtacattgtttggccaattgatttgattggtcacggagggatcgttgacctcgtctgttatgtataagtgatgcgtacggatgggagggcgattaggactaggatgatggcgggcaggatagttcagacggtttctatttcctcgagcgtctgagatgttagtattagttagttttgttgtgattgttaggacaagggcatacaggactaggaagcagataaggaaaatgattatgagggcgtgatcatgaaaggtgatcagctctcctatgataggggaagtagcgtcttgtagacctacttgcgctgcatgtgccatggacacgaatgt

SEQ ID NO: 709572 - DNA, 387 bp, Homo sapiens
gggaggaaagaagagaggaaaaaaaagaggagagggacatagaaaataaaacaagactaaaagatgtggagataaaaggaaagagggaagatcatttaaaaacagaaggggacaagaaaggatctgatcatgtcaaaaagcagggtgtaaggagtacacagtctctgtagctcataggaatagaatgtgaacagcagcatatggaatgtgggatgagacactgatcatatggaagtctgcagcaatttccgcaaaagactatcatttggtgtatggaactttaaaaaagcggcacgagtctctctctctctctctctgggtctctctctctcggtctctctctctctctctctctctctctctctctctctctctactctactatct

SEQ ID NO: 709573 - DNA, 111 bp, Homo sapiens
cccccccccgggggtttttggggcttttttttcccaaaaaaaaaaaggggggggggtttgggaaaaaaaattttggggtggggtttggggttttttgttaaccccccccca

SEQ ID NO: 709574 - DNA, 597 bp, Homo sapiens
cgcatgactgttctagagtacccggtgatccagaatgtgttgctcgtgtacaggttgatgcaggcattctggtgatgctactgtgctgctcagttaccctgaacacattagttttttactgcattaatggtatgtcatattttttactatcaagtacttaggtgtgaattagcataagaaaatgatcgctaatcagaagcatataaattcagagtcaggaatgatggtgatgccaaacaaccagattgtccacatggggggctgggagagtggcacctttgccttctgatggttcaatgtacacaaactttatttcatgcataaaattataaaaatattgtataaaattacattgggactatgtctataaggtatatatgaaacataaataaatttggtgtctagacctgagtcttgtccccaagagatctctttatgcacatgcaaacgttccagaatcccccaaaatccaaaatctgaagcactctgttcccaagcatttgggatatgggatactcaacctgtattttatatatatatatgtgtgtgggtgtgtatgtgtgagtgtatatatgcatatatgactacttttcaaat

SEQ ID NO: 709575 - DNA, 127 bp, Homo sapiens
cctcttagcactgtgggctggtggcgacagatagctcataggctgtttctggggctgcatggtgcttccctgagctggatgttgtgggtgttgctgtgcttcagtgatgtgtggcgaccagaaagcg

SEQ ID NO: 709576 - DNA, 913 bp, Homo sapiens
  misc_feature (305)..(305): n is a, c, g, or t
  misc_feature (374)..(374): n is a, c, g, or t
atagtgttcctgagacgcaaaaacggacgcgagaacttctaccacatagctggaaggcatatgctgctggatttggggaccgcccgagaagaattctggtcttgggtctggacaacctgaacaaaatcacagcccaggggcagtacgacgctccgggtggcacctgcgggaccatggggcatgacagcgctttgctgtctatgacaagttctagcgtgggagatgccaagactcgctacaagctgaaggtggaggggtaccgggggacagcgaggtgactccatggcctaccacaatggcagatncttctccacctttgacaaggacacagattcagccatcaccaactgtgctctgtcctacaaaggggcttnctggtacaggaactgtcaccgtgtcaacctgatggggagcatatggggacgaataatcacagtcagggcgttaactggttccactggatagggccatcgaacactccaatccagttcgctgagatgaagctgagaccaagccatcttcagaaatctgaaggctaggcgcagacgggctgtaaattccagggacaactggtgtgagagaggaataaggcctagagcgaggaaaggattgttaccaagagcatctaataccaacagcccacaccatcggtccacacctgggcatgtggtgagagtcaaagctgaccatggatcctgggctaggaacagtatgtgctaacctcgctgtgattcttctttgcccaaaagatccggctccacatgttccgcttgggtgtgtcagcaaaagttcccgtgaaacatcggaagttacttcctaagggccgggacgggcaagggaggaaacggagatgtaacaccggctagaagggcaaagggtttggcagaattgttggcccttttttacggacaag

SEQ ID NO: 709577 - DNA, 1022 bp, Homo sapiens
agcggggtgcgagcttgcgggggacagccggtggtggcggagcggaggctgcgtggggcaccgggccgcgggccacatggggtgcgacaggcgctgggccgcggactgcagctgggtcagatgcgctgctagcgtgcagcattcacggtgcaatgcgcgggcgggtgctacggcattgagggcaggccgggccctggcaggcgggctgtgtccagcgggggagcgtccaggctgggccagcaggaccagggcgcaggagcctcggcaggggttcagggcctcgagagatccctaaaccggtactcccaacatttgttcccgaccaatgtccgagatggcaccgtggccattgaccgggaaggcggggtatgacacgcgtgacaagatcaccgagcagtgccgggagcccttggggagcttgcaccaggagcaccactttgccgacgcccaggagacagtccttacttggaccactttcgcaggcatagggagcattgagccctcatccgcagggcaaaacaacacagggcgcggacgacaggcccgggcggcggcggtgacctcggcgccagggtccgcgaacgacatcccccaggcccacctgtgataccccccagacaacggccaacgatcgggagggccccctgaccgcccggatgggccaaacaccccgaagaacggcgctataaccgggccactcctccgcggcctgaaaaggaaggttcatcttaggaatatagggggcaaagatcacaaattatgggctaacaggggggattgggagagatgcattcaggatcggtagatatttagaagtgggcgacccatagttggacgataacacagtttaaggcaccccaagatgaaaaaccccattgtgggagagggttgcgacccaaaacagcaaggacaacccacgagggttattggcaatattcccacaggtcgagaacagcaagggagcaccagagagtggtacacaaaaagagttaggacaacccagacgggtcaagacacaggtg

SEQ ID NO: 709578 - DNA, 246 bp, Homo sapiens
ggcgtacccgaagacgaccatgacgatctctagctggatgggcgcagagaacctcaagaaggcatgaagccatcccctgcagtgacgaagacccgcctttctggcctgcctgtgcgtctgttgccctcctctgtggcggcaggacctttgtggggcttcgtgccctgctctggggcccaggcgggcgtggtccacattcacaggccccaacagccttcaaagatgggtaaaggagttgccctccct

SEQ ID NO: 709579 - DNA, 317 bp, Homo sapiens
tcagcttatgaatgtaatatgttctcttccttatgattttttttctcttcatttatttttgagacggagtctgctgtcacccaggctccatctcaaaaaaaaaaaaaatggattggggctggtggttagattatagtgtggtcccattgttccttcccggtatttttccggtggttccgcaagggattgtccttgtccttaggagatccacactgaattatttgggggcaagggggcaactaactcttaattcgtccaaattttagccccggttgccccttgaccttgggttggaactgcttgatcccctttttttt

SEQ ID NO: 709580 - DNA, 240 bp, Homo sapiens
  misc_feature (94)..(94): n is a, c, g, or t
  misc_feature (102)..(102): n is a, c, g, or t
  misc_feature (114)..(115): n is a, c, g, or t
  misc_feature (155)..(155): n is a, c, g, or t
  misc_feature (158)..(158): n is a, c, g, or t
  misc_feature (200)..(200): n is a, c, g, or t
actgagggatgaggaggtaagccagggataccgctcacagggatggtcaggtgtaaagtgatactgcaaggtaggattgctagacctgttagcnggaagcanggtgagcaccanntctggacgctcaggccgtgtcgggcttcagtcatctccancanacaggtacagcagcgctttctggtagtcgcccttagtgtctngctggatataatagtacagggacttgccgaagctggatca

SEQ ID NO: 709581 - DNA, 304 bp, Homo sapiens
ctacagtgacaatcatttaaaagtaatgctgcagtaaataaagtactatgtgatagtcgggggaatattcctaaattctatattgaagtgtataggtttaaatgtgactcagtacttttttcagtgctagtcatatataacccaggctacatttcaaattttttttatcatatttgtaggtctcttttgttaatatcatttgaagctgaaccatgatattaatactattttttcagtaaaaataattgccttcataatttatactgcacatgatcctttagtgatcaaactgtaacttacagtg

SEQ ID NO: 709582 - DNA, 215 bp, Homo sapiens
  misc_feature (69)..(69): n is a, c, g, or t
  misc_feature (77)..(77): n is a, c, g, or t
  misc_feature (89)..(90): n is a, c, g, or t
  misc_feature (130)..(130): n is a, c, g, or t
  misc_feature (133)..(133): n is a, c, g, or t
  misc_feature (175)..(175): n is a, c, g, or t
tgctacgtcccctcacagggcgggccacggggactgtgatacgcaacgcggtgggctagaccgttagcnggaagcanggtgagcaccanntctggacgctcaggccgtgtcgggcttcagtcatctccancanacaggtacagcagcgctttctggtagtcgcccttagtgtctngctggatataatagtacagggacttgccgaagctggatca

SEQ ID NO: 709583 - DNA, 723 bp, Homo sapiens
  misc_feature (122)..(122): n is a, c, g, or t
gtttcctgctttggttcttacagtagtcggcgtaggccttaggtgggttcgtgcgccttctacctcgctgttcggttttcctggctcctcggcccttttctcccctgtgcagctgggagcgnacgaagcgcgaagctgggattttttactgtctcctgaagaatttaacacaaacatggatatcagaccaattcatacaatttatatcaccattatgatatgacaaaattaacaaaggaagaatggaagagatccctatatgccctgttttctcagttggtcatgtggtggacatggtggtttaaagaccatgaagatgagggggcaggccttggtcatatttaaggaactggctcatccacaaatgcctgtgagacagctacaaggatttccattttatggtaaaccaatgcgaatacagtatgcaaaaacagattcggatataatatcaaaaatgcgtggaactttgtgtgacaaagacacagacacagaaaggaaaaagacaaaatgtggaacgagaactggaaaacaaaaaaaaaagctggcagggaactccaaattcagtaatacccaaggaaattcaaaccaaatctcaggtcctgattacctccaatatattttattccttaatacttacagaagagataatgggacgctgtttcctgggggtaaccaggcccggtccagaagtacgttgggcagggggctggcatgggttgcgac

SEQ ID NO: 709584 - DNA, 153 bp, Homo sapiens
ggaaaccatcatccgtcgtgcctccccgaggacacgcagaggcaagaaaagcgaccaagactgagtggacagaagaataagcgagacttttaattcatgaaacagtctcttccctcgatccgaagagccttccctgagccggtccccatagcc

SEQ ID NO: 709585 - DNA, 406 bp, Homo sapiens
actcagagtgacgggagtgggcggctcatggtgctgggaagctatcccacaggctctcctgccgggtgtctatagatcccatggcaataaaacatcaagctcacttagcatttccagctccatgtccaagagcttgcaggcactatatacgggaggcttagagtcatcaggtttcatctgtcccatgggccttcggattggggtgccagaaaccaacgacagaggaggcacggccatggtagccccactggtaagtgcagccaaatttggcatcaaggcattctccttgttcctgaaacatgattccgccgttggtagcatgctgccgagcggcactagaagtctgtggtagtctcctatggtggctggcacgggcctcgtggcagaagcctgggagactgactgc

SEQ ID NO: 709586 - DNA, 166 bp, Homo sapiens
cctctacttctaactacgcataagtctactccacctcaatcacactactccccgatagtctcacaacgtagaaataaaatgacagttggaacatacaaaatccaccccattcctccccatcactcatcgcccttaccacgctactcctacctaactccctaaacga

SEQ ID NO: 709587 - DNA, 296 bp, Homo sapiens
ttgccggatgaactgagcagcagccactattaatgtgaggcagacatatcaacaattgaactattcacttgcatgccaggaggtcataaacatcaaggtcaccaaatgaattctagctatcagctcttggttatagtactgtacctaagtttggtattacttattagttagttagtaatcaggtttcagccctcatcttctatttgggaaattaaaactggtctgtcggcatggctggtgacagagcggcaggcacatttgcatatcctgcccctctggaagtaccaaaagaaaaa

SEQ ID NO: 709588 - DNA, 158 bp, Homo sapiens
aaaggcggatctacaataaccaagagagctagccggacaggtggtagcaatggagatgacagaatggtcagactatggatatctttatgaaggtagaatcaagaacctggagttatccttgattcctttctgtccctcatagaagccatcagcaaatg

SEQ ID NO: 709589 - DNA, 248 bp, Homo sapiens
tgtgaaggccaagctgcgtaataggacaagccttggaagtaaaagaatgaataaggagagactgccagagagacacatagttatatatacaaagcaggtagaaacccaagagctatccataaacattctatgaggattcattcatcatatcattcattcatatcaatgaaaggtaaattatatccagtaatctctaaatgtatcaagaacactatagataaggtacttgggaaaaaccagggtagcag

SEQ ID NO: 709590 - DNA, 311 bp, Homo sapiens
gtggggcaggatgatccagcaggtggtctcagtggaggagctgaacttgtataactttccctcatcaaggtggcagtttaattttgtgtcaggtttagtttcatctcctggtatctgacctaattttacggggtgggaggatctttccctgcgtgtgaattttttaggaacagtttgggacaggtcggtggctcatgctataatccagcactggaggctagcaggtgatcatgaggtcaggagtttgagacacctgaccacacagtgaacccatctctactaaaatacaaaatagccgggtgtgtggcgat

SEQ ID NO: 709591 - DNA, 490 bp, Homo sapiens
  misc_feature (19)..(19): n is a, c, g, or t
cgcgccaccaacacgcacngctggcgggggccagcgccgccacaccgcgggatacgcctccctggccgggccacacatcggtgggccaccgggccgcgccggcacaaaccaacacgcacggcaagcagacggagcggtgcgcggcggcgccaaccaccaacggggaggcgcccctccccaacgacgaggagtgggaccaacaaacaacgggctctctccccgcgtgggggcgacattctcctcccctagatggagcaatctgtggagagcacaagttgttcgcgcgcccgccccccagaagagggtgcttttggcggcccccccctaaggagcagcgggtgtcaaaagggcaccagcacaaccgagtcaactgtccgtctttgaacgccctggtctgtccgcaccacacgtcgcccaccgaggataccaccacgtgtgcgctcatggggtggtcgtgggttaaaaaagggctctccctttctcccacaaa

SEQ ID NO: 709592 - DNA, 1423 bp, Homo sapiens
  misc_feature (348)..(348): n is a, c, g, or t
agagagacgacaactagtctcgagttatggttgccctccatgtattgcttcttttgttttgtaactggagtgtaacgggcagaactggactccgggccgtaggacttcaatcggtggacgactgtattaaagcgcgtccccgggtgccgggtgcaggggcgcaggtgtagatgcgatgacctcccgtgctacctcgcccaatactcgatgttcgacccgtgtgagaccgcctagaactcccatcgcattgtctgttgtgtgtgcccagacaagctacaagatgctgagtaattggggctgggatcgtggcgagaatcaggtcccctgtgtgcattgagtcataccganctgacggagccacggtggtggtggatccatggggggccacatacagacgcatacacgcgcaattgttcgttccgcgtgagaccgctccatgcactgtatggctgacctatggcagcatgagacccgcttgcgccccgagttgtcgtcctcgcgcgagcgacaggtgatcgtcacgagaggggtacctccgggcgatagcgaggtacggcgcgatagaagcgcctcatagttgacaaatgggggagaggacattgccctatgtgagccttgaataagggggtctcggctccccttcggactcggttcaccataccagagttccctttgcgccacgaatttaaacggcttcgatatgcgtgagcgtttggtatggtgcggaccattgggctctccgatggcgtggcgccctaaatagaagggccccttggctcgataagcgcgccctaaaatatggcgctaactctacgaggtcaacccgcaacgattgtggggaaaacaatcttagcgaaaagcgcaccgggcgcacccacgtggagacgctggttagcaacccccgagcggcaaaagccatactcggcacccagggaagttggcgcgtctcgcaaacagcggatcgccaaaacgaggattacgatcactcgaaagttgaccatggttggcggacatactaagggcacggctatatccaccggcgacagctcaaaggttatttattttgcggcagcggggcaatcgcgttggctgtgagcattgcggacgtggacgagagccccagttgttggaacacgccgtcatcgtgcaatggtggagcgccgagtgcccccaacgggcccaatgaagctcggttttgggcgcttcggggggcatattcgccgtctcgtgtttgtgtggtgtggtcctggctgttgtgtcccccccctctcaaacggctgtgtcgcgggcccaaagtttgtacaggcgtcgtctgacccccaccgtgtttcagcttcacaaccagggtgggggttgcgagtaggtcggacaattgtggacagcggtcggccgccagctgttcctataagtgtcgtcttcccct

SEQ ID NO: 709593 - DNA, 114 bp, Homo sapiens
ccgttttatttgaacaggcttttttaatcagatttatatcatccatttatctgttaatgaacagttgttttatatgtgtgtataatattgtatatctcatcttataattgacta

SEQ ID NO: 709594 - DNA, 312 bp, Homo sapiens
  misc_feature (83)..(83): n is a, c, g, or t
  misc_feature (116)..(116): n is a, c, g, or t
  misc_feature (129)..(129): n is a, c, g, or t
  misc_feature (160)..(160): n is a, c, g, or t
  misc_feature (279)..(279): n is a, c, g, or t
tttttttttttggagaacggggtctcgctatattgcccaggcaggtctcgaactcctgggctcaagctatcctcccgcctctnagcctccctgagagctgggattacaggcgtgantactatgcctggnctcaattaaattcccaaagacctttccaggngctatgactttaaataaaccagcttcttggcctagtaaaatgtctggggttggtaacaacagatatgcttcctgtaaataacacttgttgtgcacacaaatctgccttctcattagggnaatcattattttataaacatttgacttcagagg

SEQ ID NO: 709595 - DNA, 137 bp, Homo sapiens
tgctgctcctctcagttcgatttgcgttttcttgttatgtgctagctagactgcttgaaacatcttctgtgttccactatttcttccagtaaccaatatattttaggccaggcagtggtcacgcctgtaatccagca

SEQ ID NO: 709596 - DNA, 177 bp, Homo sapiens
gcgacaattgtatcccccccgcggtcggtgcggcgtggcgaccccacccccgaggggcggcgcggcacttctcttgcgcgcccccccaaccccttggggggaaaaggagggccccccccccccaccgaggtttgggcccccccccccccgggccaagcggggggtttttcccccaca

SEQ ID NO: 709597 - DNA, 278 bp, Homo sapiens
ccaatcaacatccaacccttaattaagggttggagaagaaacaattggtcaagtttggctaaactgtaaataatttctgtggatttgaagatttgaatgggatgggatcaatggtaatagtttgtgcctgataagataagaaagctccctcagattaaaacgggccttgaaagtcattttaaagggtttggactgagtgccaaaggaaatagttaaaaggctttttttatatttatgctttagaaactagcataggcagtaggttggatgttgattgg

SEQ ID NO: 709598 - DNA, 1147 bp, Homo sapiens
ccgctctctttttgtgttgaaagataagtaaagtaatggatgggcgcgagaaggcgcgccaccccgtcctctgcgcctctggtcgcccctatgtatggtttctccctccccttcgtttcttatatggtaccgttgtgagtgcgcagagtcctcctgttctcgagggtcccgctgttggcccttgtaccctccttcctgggcgggattgtttgtcccttgtgctttctattcatgtgttgccccttctcccttgaaggtgtttcccccggttaagggggaaccctgcgccgtttctcctgatgttccggaacagacctgccggccagaacgcccgaacgccccattgacgtgtgggtgcccccacaccagccgcgcaaaattgcttggaggccaactttttggggaacttgtcttgtgatccttggagcttccggagaactttttcggggaaattaccccccgaccaccttggcccgttggagacaaggacttgcctggcccgacgtggggagtcctgacatccagtcctgcgacccaccccgcgaccgtcgcccctcccatcctgaaggcttacccaacataccaatggcccaccaaggtgtctcacacttagcctcgtatccctggctacactcgggcattcgtggagcttttggtggtccctctgggtggctgatggtacacaagcttcacggagcccctcgtaatggacccgagcttgccctgctcacccttcgcccagtggacctgccaaattcctcgacctcggtgtgcacactccctcgttgaaatgtggggcttgatgtcacaacacgagtgtacctaaccacgggctatttttccctaccacgctcaccctgggggccgccctcaagcacacccggagtaacacagcacgcacactgggccacagctgacacactagaaaaaccctctcacgaatgcttgccacgaagaagttgaaggaattgaaggatgaagctattgaacaccacgagttcaacgaagtttcccgcgagttcacccgaggacgagctgccctatgatgactgtgtgtttggaggcccgcgtctgaccttatgagccccaaggggctgaaagaaacctggacttgtataatttgtaccaaaaaaaagttttatttttc

SEQ ID NO: 709599 - DNA, 1010 bp, Homo sapiens
ggtggcagcagcaccccgagctgtcatgtgctgttcctgccgctggcctgctgatggccctgccggcctggctgtgtggtgatgctactgctcctgtgagctggccatgcatgtgccctgctgtgtgatgttgtgtgtgcattgcctgctgtgctttgacgtgctgatgtgctgtgtgcctgctgctgctgttctgtgctgtcaacaatgcactctgctgtgcattgatgtgctgcccatggtggctgtgcctgtgtgcccagctgagctgcctgacaactgctggcctgtcttgcagtgtttgccctgccttctgtgatgttgcttcccctcctgtgtggtcccactgtggctgtcgccttgtgaactccctgaggcttgctggttgcggctgtgtgactggtgccttcctgtgtgctggtgtgcctgtggttctctggtggccccttgtggtgaacattcagggggttttttgcggtgcctggaatcccgagatgatgaatgtggtttcgccccttgcgtttggtgcccctgctcgtccttctggtggaccacacagtcgggtatctttcccagagcctggcggcacgttgcatcgccttactatttttagaacacactttcgttatataccacctggtgagtagcacgctgcgtctgtgcgacaaagctccagagtcttttcatcaagtttgaacgtactggagacctctttaaactgaaacatgaaagatcgagaactatggtgagcgaacctccccatttaggaaccatttcagcgtggttattcccagcagcaataatagctatcaacacgtttaagagacacaccttctgtgatgctatagagctcatgtctcccccctattccactttaagttatctggcgcagcttcgagtcctgtgagggcatgtctcatggaacgagcagtaccatttcatccacacaacctggcacccgtgatcttctctcttggcgcaaccgtgaggcgttggcaaatcgctttcgg

SEQ ID NO: 709600 - DNA, 668 bp, Homo sapiens
aggtgcagtggttcacgcctgtaatcccagcactttgggaggccaaggcgggtggatcacctgaggccaagagtttgagaccagcctggccaacatggtgaaaccccatatctactaaaaatacaaaaattagcggggtgtggtggtatgcacctgtaatcccacctactccggaggctgaggctggagaattgcttgaacccaggagggggaggttgcagtgggctgagatcacgccattgcactccagcctgggtaacgagagaaactgtatttcaaaaaaaaaaaaaaaaaaagaaaaaaaaaaccctttaaataaagtagagtttggatttgccataaacccttcaacggaaaagatggcaaaaattcttcttagcctgctgcataatggttaccacacatagggcatttcacaacatggaattttcaccctatcatattttctcactatttctagcaggtgtaaagaattcttctgagttggcccttgagtgagagatgataaataaaatgttgtttcttacaggactgaggtaccatagtggagatgggaagggctggtctgatattcccaaaagatgtcaattttcaaagttgatagctactaaaaaaaaaaatctgtctaaataccagcaacaaacattgttattgaaatcgtaaactac

SEQ ID NO: 709601 - DNA, 916 bp, Homo sapiens
  misc_feature (35)..(35): n is a, c, g, or t
  misc_feature (67)..(67): n is a, c, g, or t
  misc_feature (81)..(81): n is a, c, g, or t
  misc_feature (107)..(107): n is a, c, g, or t
  misc_feature (110)..(110): n is a, c, g, or t
  misc_feature (113)..(113): n is a, c, g, or t
  misc_feature (115)..(115): n is a, c, g, or t
  misc_feature (117)..(118): n is a, c, g, or t
  misc_feature (120)..(120): n is a, c, g, or t
  misc_feature (148)..(148): n is a, c, g, or t
  misc_feature (155)..(155): n is a, c, g, or t
  misc_feature (160)..(160): n is a, c, g, or t
  misc_feature (180)..(180): n is a, c, g, or t
  misc_feature (186)..(188): n is a, c, g, or t
  misc_feature (194)..(194): n is a, c, g, or t
  misc_feature (202)..(202): n is a, c, g, or t
  misc_feature (205)..(205): n is a, c, g, or t
  misc_feature (209)..(209): n is a, c, g, or t
  misc_feature (234)..(234): n is a, c, g, or t
  misc_feature (237)..(237): n is a, c, g, or t
  misc_feature (240)..(242): n is a, c, g, or t
  misc_feature (248)..(248): n is a, c, g, or t
  misc_feature (273)..(274): n is a, c, g, or t
  misc_feature (298)..(298): n is a, c, g, or t
  misc_feature (479)..(479): n is a, c, g, or t
  misc_feature (723)..(723): n is a, c, g, or t
  misc_feature (778)..(778): n is a, c, g, or t
  misc_feature (815)..(815): n is a, c, g, or t
  misc_feature (836)..(836): n is a, c, g, or t
  misc_feature (893)..(893): n is a, c, g, or t
tgtttattattctgtgagagtgcatattgtgcttntgggttgtttgacgattaaaaagaaaaattcntcccggcgcgtatncgcgctgtgtggcgtgcgggttgccntgntcntngnngncgcgagtgtgcgtggtgagtgctgttgngcttctnttgtngctttgcgcgtgcgcgagancgcgcnnntgggcnttggtccnttnggcntgtgttgcgttgcgtgctttttagngtngtnnncgtggngtgcgagcgtcttattttagaaaannagtattaataaaacaatgaatgcntagttcacttaattactatgttcttataaatgaaattaaattggtctcaaaatatatcctcttagagccaatgtatcttctgcaactaaccaaattcattctcagaatcaagaccttttcgacgcttcaatttccttccatattgcagcttcaatttttgaagtatcatattccctcatcntatcaaattcaagccatggctgattccacttctgagcttctttcatttgctgttcagttaaacaaagatcaaatctgattcctttaatattaaaatttggacgttcccagcgtttagaccagggcttaggcttcatttttactttcagctcattaacaggaactttttggttaggctcttgtactactggcttcatattcacatcaaaagtgctatattcaggaagggcatctcgtaagtatanttagctatcatccagccgtttctctaatttgaccacctgaatctcctggacccgnggattataaagttcaaagcaaatctcgacaccttgtncttcgataacattcctaaggntgaaagtagctccaagtcctcttcctgatctctgaatgcaaatccccagaaactggntgatttttccactggcatatggg

SEQ ID NO: 709602 - DNA, 650 bp, Homo sapiens
  misc_feature (357)..(357): n is a, c, g, or t
  misc_feature (593)..(593): n is a, c, g, or t
aagttgagagtcctgtataagtaaatcttgacacatataactttgctcccaagttaacatggaaccacgaggaattctgttgtgtatcagtgaggaccatatctcataaggctgaatactcttactaaccgatagcgcatagtaccgtgagggaaaggtgataagtacccctggaggggagtgaaatagaacctgaaattgtgtgcttaccagcggtcagagcccgttagggtgatggcgtgccttttggagaatgatcctgcgagttacgttaaacggcgaggttaagtataacggagccgaaggggaaaccaagtcttaatagggcgatatagtcgtttggcgtagacgcgaaanctggtgatctaaacctgtccaggatgaagctgtggtaagacacagtggaggtcctaacccaccgccgttgaaaagttgggggatgaggtaggtttaggggtgaaaagccaatcgaaccaggagatagctcgttctctccgaaatgcatctaggtgcagccttgagtgttcaattatgggggtagagcactgaatgatctagggggcatattgcttactgaaatcaatcaaactccnaataccataatttatagctcaggagtgagaccatgggagttaacttccattgtcaaa

SEQ ID NO: 709603 - DNA, 245 bp, Homo sapiens
cgccgttggaggaatgctgagtctagagaaatgtagtctcaagccctggtaagtccctctgtatctagcccgtagttcatagcatcagtgaactggagccgcaacagcaaattctatcagctgtgtaccatacagctggtgctgaaggcgaatttctagagccattactcagtataaagcactgagttctatctttagagatttatctataagagcaaatttctgctcagcattcctcgcaacag

SEQ ID NO: 709604 - DNA, 109 bp, Homo sapiens
tcatagatagctagtggagcacatctgtttaactatagaggttcatccatgtagctctgaaggtctctgtgtagactatagaggtcgcgtcccatgtggctagtggagg

SEQ ID NO: 709605 - DNA, 315 bp, Homo sapiens
ccttctagcatcctttaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgcttgtgaacgtggccacgctccctaccaatcaccgagtgtaccccgcagtctgccgtgtaccccatttgtagggataggatgtgcttaggaggtctcattttatttttggctttcttaattatagctgttttagatttatgtcatgtttcg

SEQ ID NO: 709606 - DNA, 171 bp, Homo sapiens
ctgagatccaccactgccctccagcctgggcgaaagagcaagactctgtctcaaaaaaaaaaaaaaaaaattactttccttccatttaagccttttcattctgttaccataagggttgggccagattaggttgagttagaaactgaggataggaagttctgggtgctagag

SEQ ID NO: 709607 - DNA, 122 bp, Homo sapiens
agactatcatacatacagctccaggtagcaaatgatggcttgagccggagcaggaggaggtaagtgtctaaatagtatccataggaaagaaagtgcctagctatcctgggggatcttatgga

SEQ ID NO: 709608 - DNA, 170 bp, Homo sapiens
ctcagatcggctttttctttgttctgtataccgtgggctgtctggctcgggtatccccgagtcactgatgctcattccgtgccagcgttggctgcttgggacatggggacggcgaggtccccacaccccacatgtgagctgctggtagctgggctgagcccagtgtccca

SEQ ID NO: 709609 - DNA, 682 bp, Homo sapiens
  misc_feature (156)..(156): n is a, c, g, or t
atggcctagaagtaacatgcgtatgatatactgaagagcggggccaaggagagcttagaaggggagacccgtcatcatgaagttccttaatgcatcttcggaggagcatagcagatgtgtaaatacaattattctaatcacaatatcagtctcaantcagagtattaatgagagataattagctaaagagaattaagatctatataagtaaatgtattggatgcagcattgataaggcatttgtagaagaagcaactattatcgagagggactttaacgaaagacaatcaaccatggtacgcgaaagtgaggccgtatcagaatagggttgggcataatacactttagaatgtgtagcgctcgagatagaagcttcttccatggggggtataaaaacttgtaagcctaaaagcaaattccgggagcagaggataacagagcaaattgagatagaggtaccttggtagacacgggcagggattatacgagtttaaatgccccggatgacttaccacagcttaaagattaatgtgttataagtcgtagtgtgagtgatatataattatgatgggcgaactttaatactagagaataaccgagggtgactgaaagtactggaatgctatgtacgaggagaatttgtgtctataaagcctataaggcattaataaggcgaagatca

SEQ ID NO: 709610 - DNA, 386 bp, Homo sapiens
cagttggacttcttgctaaagttatttatgttttaggtattcaaatattaatagtttttttttaatttcttaaagccagaataatttcaaatgtgatagtccctatggtgtgtgttttttttttttaatatcctcccccccccccccccatccttaggcactgcttggcagataaccctggttggccacagaagctattaatacgcgacagcatgtggggaagaacttatggtgggccaggtggccctcaccctgtttcttcctccctttggtttaaagagatatataaactaatttcacataagttgtgtgtgcaggtgattggtttttacataagtcctatttaagccttttatatgttacagaaataaaagttaatttatata

SEQ ID NO: 709611 - DNA, 243 bp, Homo sapiens
aaaatccccttaaccccagggggtggaggttgcaattaacccagatcccccccctgcattccagcgtgggtgacaaagtgaaactctgtctccaaaaaataaataaaatcgtttttttgtaatactggattaaaaaatgtccctgagctcttccgtgggctctgattgttggttaaaaaatatgtgctccaaaacaaaatcgttgttaaactgtgaccttttgctatgtttgtgtatgtatta

SEQ ID NO: 709612 - DNA, 707 bp, Homo sapiens
  misc_feature (44)..(44): n is a, c, g, or t
  misc_feature (61)..(61): n is a, c, g, or t
  misc_feature (78)..(81): n is a, c, g, or t
  misc_feature (86)..(86): n is a, c, g, or t
  misc_feature (90)..(91): n is a, c, g, or t
  misc_feature (94)..(94): n is a, c, g, or t
  misc_feature (99)..(99): n is a, c, g, or t
  misc_feature (102)..(102): n is a, c, g, or t
  misc_feature (104)..(105): n is a, c, g, or t
  misc_feature (107)..(107): n is a, c, g, or t
  misc_feature (126)..(126): n is a, c, g, or t
  misc_feature (190)..(190): n is a, c, g, or t
  misc_feature (203)..(203): n is a, c, g, or t
  misc_feature (211)..(211): n is a, c, g, or t
  misc_feature (217)..(217): n is a, c, g, or t
  misc_feature (231)..(231): n is a, c, g, or t
  misc_feature (258)..(258): n is a, c, g, or t
  misc_feature (263)..(263): n is a, c, g, or t
  misc_feature (283)..(283): n is a, c, g, or t
  misc_feature (287)..(287): n is a, c, g, or t
  misc_feature (324)..(324): n is a, c, g, or t
  misc_feature (342)..(342): n is a, c, g, or t
  misc_feature (346)..(346): n is a, c, g, or t
  misc_feature (573)..(573): n is a, c, g, or t
  misc_feature (594)..(594): n is a, c, g, or t
  misc_feature (612)..(612): n is a, c, g, or t
  misc_feature (628)..(628): n is a, c, g, or t
  misc_feature (645)..(645): n is a, c, g, or t
  misc_feature (648)..(648): n is a, c, g, or t
catttcaatgagtaaaaaagagcataaaactgtatgtgtaaggncaaaatgttaaaggggntaccacaataataaaannnngtcantttnntcntctcnttnanntnggccgggtgttcaggggtntggggctgggttgtcaatagggcaacacaagttttttgttgtgaattgtttgtgctctttgggntcttattttttcnttgcttantcttcntcttcttcttcttnttctgtctctgctttttttttttcttntttcnttgcccgtccggttcgtggntgtnttggtggctctgttgggttgtctgtggggttgttgtnctcttctgtttcctgttnttangttgtcttcttcggtttcttgcttgttgttttgggtgttttcctgccagggttttattcgccttcattttctgtgccagttgctttccttttctttgcccctcggccttttccttttggtgttgttgttcttctttggattgccttattctgtttccgtgtcagggttttctgcctcttctactttcttctgttttggggctctcttgggcttagggactgtatctnaagacggttttccctttttancagctaccgttttacttngaactttatctgtctntttcagaccaaatgatngtnaaaaacagaagcagaatcttcttcattactgtcaaatttagctgaatcatcttctgact

SEQ ID NO: 709613 - DNA, 354 bp, Homo sapiens
  misc_feature (35)..(36): n is a, c, g, or t
ctgcaaaggacatgtctttctttggcaaccctttnntactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttc

SEQ ID NO: 709614 - DNA, 354 bp, Homo sapiens
tctctagcaggatccccctaccttaaatagctgtgtagcatccccagttcaccttctcatttgtcatctaggaaaactcctgtcagctggctttcatactttcaacttaaaagcaagcagtcgataatcaatgcctacaccttagatcaagtcacatttagaaccactggagggaatcaaacaacatattttgtcgattgaagaaccagtacatgaagctggatattttacttgccttatctcattctatccataagtacgaatattatggccccccattttacatctgcatgaaactggaggtcagaacaaggctaagtccatagctggctttttgttgtttttgtcagtttg

SEQ ID NO: 709615 - DNA, 516 bp, Homo sapiens
ggagtctcactctgtcacttaggctggagtgcagtggtgtgatctcggcttactcctccacctcctgggttcaagtgattctcccacctcagcctcctgagtagctgggattacaggcacacgctaccacgcccagctaatttttatatttttagtaaagatggggtttcaccatgccggccaggctggtctcgaactcctgacctcaagtgatccacccatctccgcctcccaaagtgctgggattagccaatattcagccagtaattaatttcaaaagatagtgtccctgtttcacaggaacatggagagaaatgatttcacctaatgaagtaggccattgtttcctattcctgcctatagatcatgaaatgactaagaaagacatcataaaaacatttcaaatgtcagcttgaaagtcaacattggtaaagaagtctttctccttcaataatataatacactatttcatgacctgaaagtaactggccatttccaaatgtccttgagtctttg

SEQ ID NO: 709616 - DNA, 754 bp, Homo sapiens
gggcagctccaataacagcagtctgaggaggacctgttccatgcaggatttcagccgccaatctctcggccaagtcctccgtgactgcttcttcggaaacagcgttcatcgtgtctgaccatccccatctggttatactggcagaatatgtgcctatggcatcttattcatgtactagcatgtctcgtatagtgtgatgaccctagtaagcgacatatttgtgtactccggtatgcagtagcaacgaatgtgaagattctgttctcgaagcacaacagttagcgagctagcaagagggaggcatgctgtgttccaacagagaagtggactacgcaagacatcttagcttgagacgctgatacactatgaaatgactgtcgtcggaagagggacgaagacgagtgacagcgcaactcgttggtggaacgtacacgaatgccggtaagctgattatcctgaagtcgagcagaccagattttcccacatttacctactaaccaagacgtgcttgtccactctgagtcgcgtagcgatcaatcagtatagcatgtccctctcctcacagtaatatcgacagaaccatctcaagccggcaatctaagctaagaaacctaagatacacagacgcaataaggtagcaaatcgctctagggactctgcctttgttcgcagcgtgtcatacgtaggcgtcgagacccgtagaacccatgtgcacgaattgttccccacctaggactatggggtcgaattgggt

SEQ ID NO: 709617 - DNA, 635 bp, Homo sapiens
ctggcggccgtcttgatactttcaggaaagaatgcattccctgtaaaaaccaaaaacataaatactgagagagggagatagagagagaagatagagagagacgggggagagcgaaacagagggagcaacgaatctgaccgagcaggtcgtagccggcgctcctcctcctctctgctcttcgctacccaggtgacccgaggagggactccgcctccgagcggggtgaggaccccggtgcagaggagcctggctcgcagaattgcagagtccgtcgccccttttttacaacctggtcccgtttattctgccatacccagtttcggatttttgtcttccccttctatctcttgtgctaaaaggacccctccaagataagtttttaaaaaacccttctcctttgctcaccttttgctttcccaggcgctttccccattccccccagctgtgaaaagcaaagtcattcaagcgaacccccccgaaccctttccgcgaggggctaggaaaggccccccccagtatgctctcacccaggtgcaggggaacccggctgcctaatccacatcgagccgagcggacgggccgggtataatcacggtggcgccagtggggggacaagtggggtgttcgaagctgct

SEQ ID NO: 709618 - DNA, 401 bp, Homo sapiens
acccacttgagcttattacaacagagacttcaccaaaccatttacctatatgagatataagtgatggaaatagacacctggatcaatataaatagtactgaaaggaatacacgaagaatcatgacacagcataatataccaaggaataacctgtataagtactgcataatgaattcactataaataactctgtaatgagagctgctactacgcttgatatcagactagctacctacgaacatctatgagaccacacccgtctatgttgctgaatagagggaagatttatacgtagaggcgacgaacttacggagcatgtagataactggatggtctgatagaatcttagtgcaacgatctatatgaccagagaatcctatctctgccattgttgtccctgc

SEQ ID NO: 709619 - DNA, 1432 bp, Homo sapiens
tataagatttttagtttaaagggggagaatagggtaggagtataggcggtggatagggggcgagtgagtgtggtggggacggaagtgggggtgggtttgggttgtgttctcaaagcgtggtcatttttatttttaacgtgggtagatagtggggagataggtggtgattgtggagggtggaagtataaattatagggcgtataggtgtagaaagttagaaggttatagagggagggggtgaagatgggtggaaacgtggtctcctttaagaagaagagtggatattgccgtggggccgtgaaaagaacagaggggagaacaccgtggcgacagagagagcctagcgagaagagagtgaggtacgtgacagaggggtgggtaaccccacaatatagagacagtttatgcgtgacagaggggtgcgcagaacaaaagaggagggcccatctccttccagagtggggggggcacccccgtgggaaagccgaggggccaacacccacatatgagtgcccagaaaaaatctcacgagggggtgcgggggagagtgcaagaaatatgtcacagagaggaagaatagtgccgggaccctcaaaacaaacaaggggggaaatctcgagcccactagagggggaaccagggaggtgtgggcatgaagaggactcacaacaagggggagacacgcctcggtgggctagggagaccccacaaacgagaaaccaaaaaaatggccaacgaaggataccattatgtgcgaagaaacgggccacgggaaagaaagaagaacaacagaaataataaggccaaaagagaactcggggacaatgaggtcactgcggtggcgctcgaacatcgagtaccccccagaagagaggggaagaacaacacaacaccgaaagggggaaatggggcacagcggtgggaggaacacatggcgacgggggctcaaacgacggggtctgttcactacagcccttacatcaaacgcggtgcagggcctgtgcgcaccaaagagcgctaacacaaaaaacccccgaggtaagaagatggggcacccccacaatgggtgaacacatgagcggatcgacaacaaaaaaaggtagcaaaacgtgggcaaccaccatgtaggggggagatcaaatagagagacggcgcacgaggagtgaacacacgaaaaggggagcaacaccgcgggacggccctcaaacgccgcacaagcaggggggtgcccacaccacggaggagaaaacagacacaacaggggaaccgacaaaagaacaggacgctacaggagcgagagcgagagaaagcaagaaagaaaaaagagcgcgggatagaaacgaggactacatagcgcggagcaaagacagggaagagaactgagtcacgaagagaagaagagtaacagtgagaacaacagacatagcaacag

SEQ ID NO: 709620 - DNA, 251 bp, Homo sapiens
atgttgatattcattgtgtgtagttttaattcggtcccagccccgtttccttttattttggagataatgccagatgcgagtctagttttgagtgcacgtaaaatagaatcagcaaatcactattatttttcatccttatccggtattttatgggatgtttctgtcagagcagtgtacaacaactcttcctgtatattgcccttcagttgaaaaatgttgaatgatgaatagaattttctataaaaattata

SEQ ID NO: 709621 - DNA, 100 bp, Homo sapiens
actagtccacggtttggctactagtacgctggaatggaattgagccaaccgtggtactagtactagtccacggttggctagttacgctggaatggaattg

SEQ ID NO: 709622 - DNA, 284 bp, Homo sapiens
  misc_feature (127)..(127): n is a, c, g, or t
  misc_feature (238)..(238): n is a, c, g, or t
  misc_feature (244)..(244): n is a, c, g, or t
  misc_feature (277)..(277): n is a, c, g, or t
aggcaggaacatgggttatttatgaaggatgcctgtagagttcaacaagcctgcttactgcgggttagttgtgaccattgtctaaggtaatttaatggttttcctatggaggagctgaagggagccntgaaaggggaaaagggtggctcccaatgagttggcagccaatggggaacaatttggatataataaataggtctcatgttgactcctttccaaaacggcctttcaaaggggnagtgtnggcttggcctggcaaacttctccccacccactncaccaca

SEQ ID NO: 709623 - DNA, 560 bp, Homo sapiens
tatggcatcctccatatatcaatttctctgggatatgtggatcagagatcgcacctacagacttcgcaagattcgcttctgattgtatactctttataagctgctatgtggacgatgattactgttagttaccccaggatacggagtataagcgatacatcatcactgatactcacatcaaaggaagatcaaagtagcctgagaccctagaaggtcagacgcaaagaccactgacacaggcaaggattaaggtcaaggctgcctagagcaagctggaaaatgagggtaataattacaagagcaggcccaggtataggcttatgggtactcgtctgactccaaggcaagtgggctgttaggcaccagacaacttagaaagagcaacctcccttgcctttttcacaaaagggccaacagtctggagatgagtagattataggggtttgtgctcctgtatcacctccattcatcacctccttagtcaaggctctgaactgctttttctctccaaggatctgaagcaggtatgcaagcagcagatgttgatttttgttttcatt

SEQ ID NO: 709624 - DNA, 414 bp, Homo sapiens
cacgaggaggacgctcacttcccgcaccgcgccgttcacttccagggaataggtgagggcgcggccctcggccaggaaggggacgtcccggggctcgaagcgggggacgcccatgtccaccgtcacttggccgtcggcttccagccggggcacgatcacccccgagcgggtctccacccggatctcccgcttggcggtcaggcccttctcgtgcacgaagcgcacgaagcagcgggcgccgttgccgcactgttccacttcgcttccgtcggcgttgaagatccggtagcggaagtccatgtccggccgggacggcggttccaccaggaggacctggtcgcagcccacgccgtagtgccggtcggccaggcgccgcaactgatcccgggtgagaacgatggattggcgcacgcc

SEQ ID NO: 709625 - DNA, 365 bp, Homo sapiens
ctcttccggacggcggtcctccggacttcttggatgtcctgaactttccgtagtcctttttctggaattggttcattataaatatagctgggcattggttggatcttttcaacggtcttcacggcatcagtagttttattccatagttctggcagatattggacaggctggttactatattttccaaattcaaatccacggtaagctcattattagcagtggctttacagaaggctttagtccacctaacctttggagaatggcacttcttttaaagttttggtgacatttatgtttatacaatcggaacacctggcaacagcggcagatgaacatcatgatgtggtcaggaagagaccgggtac

SEQ ID NO: 709626 - DNA, 271 bp, Homo sapiens
tcacacctgcaatcccagcagattgggaggttgaggtgggaggataccttaagcccaggagttcaagatcagcctgggcaatatagtgagaccccatctcaccaaaaattttttaaaagagataggcatgctggtacatacctgtagcacagctacttggaagattgaggcaggaaggtcccctgagcccaggatcttgaggctgtcagtcgagctatgattgcactactgcacgccagccctggagacagagtgagacccccatccctta

SEQ ID NO: 709627 - DNA, 216 bp, Homo sapiens
gggcatcgaccgatgagaccggtctggcagactcatccgcgcagtcaatggagaacgccaggcccttggcctgggcgctgccaggtgaactgatggcgcaaggtatcgagctcgccgcgcaggctgaacacttgcggatgggccaccaggcgagcggcctgcaactcggtgaaggtgaggatgccgttgaccatgcgcatcatgtcccgcgccgag

SEQ ID NO: 709628 - DNA, 981 bp, Homo sapiens
gattttagcacagttaagaaaattcagtattaattacacatcattacttgattgctaccctcttgttcggcaaggaggacaaatacgcaatgttggaaacaccgttgtgcatggcatatctctctcctcttaaacacaaatgtaaacgataactttgcgtctctgcacgggtttaacactgcgttagataatgccgtctaccaacgagacacagaacaatacagatcagaaatacttagtgatcagcacatcatgggtgggcacgagtaggccttctcgacggagtgatgatggagggaaggttgtagcttggagtccagggaagttcggagaaccaagcccgaggcaagagctagtatggcgtaagacgccgtattctctgaatagactatattgtattaatgacgccaagggtcgccgaggtgggcgttcaacggccctggtgatatcccccaggcaacttcctcgggtacgagtccgatgcgaccggggttgggactcgattgcaaggggtgccagagatggaattccgaaggaacgcgaattacgcttggaacgcgttagaacaaatgcggtggaagagaacctcagcctggttgacgttcgtcaaccttcacattcacagaaattagcccagatacaagacgaatcttaaggcccccgtgagactgccggaggtgtgcgagccctgtgtagactgtcaccctcgagagtaaagggttcctcccgatggccatataaacattacctggtcgtagagagtgtggctttcggaacgggtggcaaggggggaatagcatatagttgtgcggcgctggttaggaaaaaacggcccccggggggtacacacggttggagcaagcgcctattatcgccccaattgtgtctggcagggcccccatggaagcgaaattctgtgtcagccccaaactataggcccaaggatccggaggcttaaggagtccaccgagacctttggag

SEQ ID NO: 709629 - DNA, 189 bp, Homo sapiens
cgcacatggtagcaggcagcctgtagtcccagttactagggaggcgtgaggcaaaagacatagctttaaccccaggaggctagtaggctgcaatgagctgcgagcgtgccgactgcactccggcctgggctgactgagccagctgaaccttggtctcaaaaaaaaagaaaaggaatggggaagcaaact

SEQ ID NO: 709630 - DNA, 328 bp, Homo sapiens
gcagcccgtggtggtcagacgttggcacgggattggacggtgtcttccatttcctagtgtttcaactgaataccacagacctgggactgtaacgggggtttcaagatttgggcctgggtggacttaaaccagctcctctatcaacatttttggggtctcccagggatcaaaaagggagtgggttttaaaaataaaaggaattcagcggccaaattgtttttcagaaggatggaattggtttagcggcccaattttaagggagtggacctccctcaacactccgaggcatcggctcaaggcaagtttgaggcggaagcgagtgtaacca

SEQ ID NO: 709631 - DNA, 111 bp, Homo sapiens
atccgtatcagagtatgaattatgctgtcatgccgatttgggttaaattgttttgaccaatccagtgtgcacacaggtaggagaaaaaattgcccttaggtcttgatttga

SEQ ID NO: 709632 - DNA, 268 bp, Homo sapiens
cacagagaagagacgatgatgacaggtgagtagatccaaacataattgccacatttgtaaaacattttccatttctcatccatccttaaagaaaatcatatatcgggtcacaccatcctcacggttctccaataaagcaaccatgccatctggattcatgttttcacctgtccagaactggctagtttttgaaattagcaaggatgtgcttgatttgttctgcagccccttgtcattataggttttactccatctcgtctcttctctt

SEQ ID NO: 709633 - DNA, 129 bp, Homo sapiens
  misc_feature (17)..(17): n is a, c, g, or t
  misc_feature (24)..(25): n is a, c, g, or t
  misc_feature (27)..(27): n is a, c, g, or t
  misc_feature (113)..(113): n is a, c, g, or t
aagagaggcgggtctcnggaagcnnangcactgctggtggaagccagctgcaggcaggggaggaaggaggccttactcttccttcttgtcatgggacatctactgcagcctgnagctttgctgtgctcc

SEQ ID NO: 709634 - DNA, 310 bp, Homo sapiens
agtcgcgtgtgcttacacttactgcagtttatccatttacttttgatggacatatgggttagctccagtttgtaactatgacaagcagtgctagcacaaacatcctgaaatatgtatttaagagaacatgggatatatttctattggttatatgcctaacaacaggattgttgagtagcagaatgtgcatataattctacatttttgcctcttttttttactagtgttgcctgacttgtttgtattgactagtagggatttctttgcaactctagatatacgaccagctgtggtggctcatgcctgtaat

SEQ ID NO: 709635 - DNA, 376 bp, Homo sapiens
ccagttacaacagctctacagtttctatgagacaggctccctgtagacctgcagaacggggattctgagcatcctgatcataacgtacagctgatcaagcggagttcgatgcggaggagctgacaagcccaagtgtgcaacacatcattgttaatcctaatgctggctatgacaagttcaaggacaagagactgtcgacaaagggactagatttctcagatcgtattggaaaacaccaagaggacagggtatgaatctggagaatatcagatgcttggagagggtctgggagtgaaggagacaccccagcaaaagtaccagcgcctactgcatgaggtccaagagctgacaactgaagttgaaagaatcaagacga

SEQ ID NO: 709636 - DNA, 401 bp, Homo sapiens
ggggcttacctggcaaatcaaaaagaatgaaatcatgtcctttgccgcaacaaggataaagctggaagccatcccatcctaggcaaattaacacagaaacagaaaaccaaataccacatgttctcactataagtgggagttaaacattgggtacacatggacagaaagatgggtacaatggacactgggactaccagtggggaggaagaaaggggacaagggctgagaaactacctattgggtactatgctcataacctgggtgacgggatcattcaaactccaaacctcagtgtcatacaatatacccatgtaacaaacctgcacatgtacccccctgaatctaaaataaaacttcgaatttttttaaaaagaaaaattaaaacaaaggtgacaacaaat

SEQ ID NO: 709637 - DNA, 210 bp, Homo sapiens
gggccaattattttaggccccggggtttaaaaaaaaaaaaaaaaactctgtttctgcaggggaggatattggtgagttgccaaaaaagcaatacagcaaatcggcttttgccttctgttgtttattttcccggcagaaattaagaaggtatgcattatgtaaaacgcccaattaaaaatttttgttgggttttttaattaaagacttgta

SEQ ID NO: 709638 - DNA, 147 bp, Homo sapiens
aagcaaggccaagaaaggctcgtcctttcagactgtgtcagctctccacagggaaaatctgaccagctgttgcccacttgcgctccaccatcccactttgtacgttgtatcatccctatgagcaaagttccaggggtatgcaacccc

SEQ ID NO: 709639 - DNA, 517 bp, Homo sapiens
cccggttgaaggcagtggacatgggcttgaaagttctatataaaggggaagcacagaacactgtcccagatggatatcagcagagtgtcagagctcaaacctctttggagatcatcaaacttcccaatcaccaacgaaagaactaattcctagagagaagtgacttagccaaagtcacccaaagtttattggtagagctgaaactcccaaactggatttttgctactatagcaaattgcccaggaaatataccaacgagttagagaaaagaagaaaagagagtactgataataatgtttgcctacagccatccctaagtgctgccttactgtcctttcccagcttctgctctgattttatctaaatccaaggaaggctgggtgcagaaacaacaaagagccccagacactcaggagagtagtaattctccacttgacccccctctcctgaacatgataaatacacttaactatggaactttgctgaccccctcacaccaacaaaatgactcaaactg

SEQ ID NO: 709640 - DNA, 446 bp, Homo sapiens
gtgacgtacctgtgacatgaaataaagggggctgaaagaaccacttagaaaaaggattttcatttaaggcactgtgtcctatcagaaattctgatgggccaaaggtccttaaagccagaacctctacggttcatattctggagagaatgtacggtaagtggtgaagaggttagctggccaacggtgagaagtatgaagaaagcactaggagtctacttctcttcatacaattcttttttttttttttttttttttttcccgggaggggagagtcgggccccagtggcccgggggggagggcgggggggaaaccccgagccccagggagcccaaaacttttggggccaaggaaaccttctaacctaagcccccggaaatagggggacccgggggtgctgtgattcaccccgggttaattttcctatatggggaagaaagggggtgcc

SEQ ID NO: 709641 - DNA, 281 bp, Homo sapiens
agctgggaccaaaggcgtgtgccaccactcctggctaatttttgtatttttagtagatatggagttttaccacgttgtccaggctgttcttgaactcctgacctcgtgatctccctgcctcggcctcccaaagtgctgggttacaggcatgagccaccgcacctggcccacattttgacttttatgattaccttctttatatgtgtaaaaacagaaggctctgtttctctcggtcctgcgaagttcggctcctgacaccaagttcttcctgcagcacacac

SEQ ID NO: 709642 - DNA, 532 bp, Homo sapiens
  misc_feature (149)..(149): n is a, c, g, or t
cacgtttgtttcttcgtgcctgttttatgtgacacatagggcattgagacttcaagcttttctttttttgtccacgtatctttgggtctttgataaagaaaagaatccctgttcattgtaagcacttttccggggcgggtggggagggnggtctgcctggtcttcaattaccaaaaattctccaaaacaattttttgcaggatgattggacagaatcattgcttatgacatgatcgctttttaccctgtattacataaataaattaaataaaataaccccgggcaagacttttctttgaaggatggccccagccattaaataatcgaagtaattttgggtggggaaaaaaggcaaattcaattttctttaaccagtttgaagtttcatttatgatacaaaaaaagatgaaaatggaagtggcaatataaggggatgaggaaggcatgcctggccaaaccctttttttaaaatgggttttccatttgtataaaatggggttttcatgtaaataaaaacatttttggaggagca

SEQ ID NO: 709643 - DNA, 207 bp, Homo sapiens
cacaggcccgactcccttaccctgcgaatctcctggaagttggtcacagagagaacgattgcaggcaccacccgggcagtgagcaggagtggatcctgagtgcgaccacttcaggcatcttcctgcactggatgtggtcaaccttgttcagtcaaagcacttgctaggggcaagtctgcatctgctgaggagctgaggcggcaggct

SEQ ID NO: 709644 - DNA, 196 bp, Homo sapiens
  misc_feature (51)..(51): n is a, c, g, or t
  misc_feature (147)..(147): n is a, c, g, or t
  misc_feature (156)..(156): n is a, c, g, or t
  misc_feature (176)..(176): n is a, c, g, or t
gtaatgaagcctacgtaacgcatcgtcaggcaggtaaagtcagtgtgattnacgcgaaaagctataaagtggtgaaaacgttcgatacgccgactcatccaaacagcctggcgctgtctgccgatggcaaaacgctgtatgtcagtntgaaacaanaatccactaaacagcaggangctacccagccagacgttgt

SEQ ID NO: 709645 - DNA, 121 bp, Homo sapiens
gcaatacagaacacaccgaccgcggtataaactgccggggttgttcatatgacccacggagaaagttacatggccactggctcgttacattttaaggggaccaagtattgcaggagccaaa

SEQ ID NO: 709646 - DNA, 751 bp, Homo sapiens
gcctgtggtctccgcgcgccggagcgcagagactccctggcatccttaccccctaccttcggctcgtgacaacgaagcgccacgcggtctgagtgctgtgcggcgtgcggccgacgtgtgctgacctggctgagctgctgagactgtggactgcctggcctcgcggatcgccccgccccctgggtcttggactccgagcccctcccctctcggcgctatcccgttacgccccgattggatcctggacgcgggtgccccagagagaaccaatttccacgagacccagagggcgcctggtcagaagacacaagatcagacaaggacgaccaaagatgaagacataacccatgacgtgagactcgagcagacaggaccttggacaacattccaaagccatatcccgaaccgagggaataatagggagccatccctcgaaatgacccgtggcaaaaaccatcgatgcgtatgtgcccagacaagagaccaacagaaggggccacactaggaatgaaacccaacgacccccagatcacagatatcccagacccgtacccgaatgaagcaatatgtgggaaaggccagaagaccgattccccgaaaagagggaccgtgacataaaccaagaagaggcagacccgcaaaatttgaagacacacagagagaacacacacaaacgaaccagaaaaaggaatacaatacccatggtgaggacacgaaaccggggaacaagactagacataaccacaacgga

SEQ ID NO: 709647 - DNA, 911 bp, Homo sapiens
tgacaacttccaccagatggcgccaaagtacatctgggaccagaagggatttggatcctgtagccagacccacaactctaccaaaccaacatcgcaggcccaggggtcatttcattaacctctcaataacatcgctctgaattttaatttaattttttagtttccacttactgctttatgacagcggttttagtgtgcatggatagggctaaatcatgtaaataatagagaaagatacaaaacaaaaatgcgttttttttttttttttttgggaaacagggctcttgctcttgtcacccaggctggagtgcgggtggcgcaaccacggcccacttgcagcctttgaccctccgtgggcttcaagcagatcttcctgcctcttgccctccataagatagtgtgggacatacaacgcgtgtgctacagatgcctagttaacttttaatttttggtaaaagatggggtcttgctctgttgcccaggctggtctcggactctggggctcaagcagatcctctggtttaggcctccccaaatgctggaattacaggcgtgagccacctttcctcgccataaatgcttccatttccgcctcgacaattattccacctgaagctgtccatttcttctggacattccttccagaaaaaggttatacacatgtgcctgaattttaagcacctacttaatactatttcctccctctgggtttggcaatatgcaatagtttaccctaaaaggtgacttgcccgcgtgtttgggactaccctttgatcttaactaattatcttgggcaatatatttccttacccaaatttttttcgccctaatctccacatttctcaaatcactcaatttccataaatttattcacaattgtgttctaacatttcgtataaatatagaaacca

SEQ ID NO: 709648 - DNA, 782 bp, Homo sapiens
agggcctcaatgcaagaagggcggacaagaagttcctcgggcactgctggtgccacaaatgacccgccatggaagcacggctcacgctcagggatatcctgaaccatccggccccaattagcccggctagcccccgtatgtggattgccaacccgggtcacattgcaagccagtttggctgagctgaaggcaaagattgatcgccgttctggtaaaaagcttgggagatggcccctaaattgttgaaatctggtgattgctgcccattgtttgatatggttcctcggcaagcgccgatgtgtgttgagagccttcctccagactcatcccacccttttgggtcgcctttgcctgttctgctgatatgagaccagaccagttccgggtgggggtctatccaacgccagtggaccagaaaggctgctggactggcaaggtcacccagtctgccccagaaagctcagaaggctaaatgcatattatcccttatgacctgccccccccactcttggatcagtggtggaaggacggtctcagaactgtttgtttccattggcccatttcaagtttagtagtaaaagcactggttaatgatacaccaaagcatcgttaaacctctcagaagggaaggagcaatgttttgtggaccaatttggttttcttttttgcctgtggcagttttaagttattagtttttaaaatccgtgaccttttacatggacaccagcttgaccccaaatttgtcaccgaattttgagaccccttccaaaagttaaatgaga

SEQ ID NO: 709649 - DNA, 1770 bp, Homo sapiens
ctacgatagttgataggcgccacacggtgtggtgacgaatctcgcgtcttggtgatgcctgctctgcgctcgcgcgtgttgattgcctcggtggggggtacggtcttcggagtgcgttatgctctcgtatagtgccgaggtcgcgtctcgtcgtttgtgtagtgatcttcgtatcagaatggagggagcgttttgggcctccttcgtatagaattgcctccctctgttgtgggtagatcgtcgttggtgacgcccgcattaaactctctgtgcggtgtttggtatggtagaggctccgcacgcttggttggggtccgtcgcgtcgggagtagttgttcgggtgcggtggcgcaaggagaaggtcgtcgccgcggcggtgggtggtggtggtgcggcgagcagagtgaggtggttgcccgcgctgctggatgaaggtggcttgagtatagatgggggatcgtggccccgtcgttgtttgcaacgagggtgtcggcacaaggacgcgctggccagcagctttgtagtatagggggaagtgtgtaagtaagatgccgctcgtgtgtgccgtctggggggaaggaaggacgcgcgtggtagaaatagtggtgcacatcatgggtgcgcccccggtggggaatataggtcgtctatgtgtgcggaaagacatgcgtgtggggacggccgactgcgggaggtagttgaagacgcgccaacagctggagtggaagttgtctctcttatagtgaaattaggaagtatggtttcgcggggtgtgaaaggaggagaagagggctgggcgcgcaccgccacagcggggttggtacaataggggagcaggggagacaagggttgatcaagttcgcggagaacggggccggcatcatggccacagggggcacaggggaggagtcttcgggaggggttgtggaggaaaatgccgacggcggcaacagcgccaacactgggaatagaagaggggggccacggcggggcgctcgcggcggggggagggactgaggaagtagtgtcggttgtgcgaagagacgccgcactaggccaccgggggcgggaaggacacaggaaagggacgacaacgcccccaacagaggagaggcccgcaacaggctcaacgggccccccgcaacgagagacttggcccacgcggggcgcacacgccacagaggaggcacaccggcacacacggggagagcctcgtggggggccgccgcagcaatgtgcgtgtgtggagagataccggtcggcggtgagaccctcgtgtgagtgtcacgacaccacgtgggacacagctgagagagagaaccccccacgtgcgccacacgctctcctgggggtatgttgtttaagaaagttcttgcacctgaagcccgcgggaacacgctcacggtttctgacgttcgttctcgtgttgttgggtgtttgtgtaataattgtggcttaattttaaagggagacactctttctctgtgggtgtttctatgaagaacgccccctaagagtgacccctcggttccacttaagaccggtttccacaggtgtttttcccacaggtgaacgctgttaagcgcctcacagctggcggtgaacacagccggcccacagcgtggcgccacccaccacacacccccacagaagctgtccacaggcaccaagctccgtccccagcgctcatggtgttgtaaactgttctgtcaagcaccccggggtctgggtccaaccccagtaataaacggtttactgtccgccaaccgt

SEQ ID NO: 709650 - DNA, 175 bp, Homo sapiens
  misc_feature (120)..(121): n is a, c, g, or t
taccctgagtggatcggggacgggagagagcacgagcccatcagacaaagtggtgaagaaagggaagaaggacaagaagatcaaaaaaacgttctttgaagagctggcagtagaagatanncaggctggggaagaagagaaagtgctcaaggagaaggagcagcagcagcagcaa

SEQ ID NO: 709651 - DNA, 131 bp, Homo sapiens
agttcgacggagactctccctcagtcagtcccccaagtctttttttgttctcccccctgagatagggtcttgctctgtgaccaggctggagtgcagtggtgtgatcacagctcacagaagcttcaaactct

SEQ ID NO: 709652 - DNA, 479 bp, Homo sapiens
  misc_feature (328)..(328): n is a, c, g, or t
  misc_feature (437)..(437): n is a, c, g, or t
  misc_feature (459)..(459): n is a, c, g, or t
caaacagacgccctccaccaaaaaaaaaaaaataatacatggtggtttacagaagaaatatcaaaccttgtaagtactaggtagaaaatggataggcttcagcattaacatcaatgctggccaaagctgattatgtcctgggagctgttctaagtaatagatacatttaatcctcatgaaatcccctgtgggataggtattgcttttatccctaatttgtaggtggagaaactacagcatgtgactttcccaagaccatccagctaccaatttgtacccaggcagcctcagcccagaatccacttctaaccaccaaactgcctcacangtaaagggcctttctcccatgtttcacgcaacattggcgttcatatgtatcctcatcagaagcgtcatctatttgtatagtactacttagctactggcttttgtacagngtgctcgtctctgtaccttttnccattttgcgctccttgggg

SEQ ID NO: 709653 - DNA, 497 bp, Homo sapiens
acttatctgagtactaggaggacaccctcaagatacctcactccagttgactccttgagtctaaatctttgagttaaaaactacaggaggttcttcatggaataaacaggtattaagctatataaaggcgagggctgcgaaatgcttgattatgggctcaacaagttcgcaggccaagcgttagtcatttccttccagtaactagacatgtgtctagcccctaatagttcatcagactatatttgcttaatcgaatcaaacacagttgcctatgccctttgacattctggactaacaacagcgggcctctagccccatattagcttaccaaactgaacatcatagatgatctggattcaggcagggactgcaaaacgagcgactgggccacataacaataatcaattcactgatgacacaaaactaacctacaattgtccgcacccctctctactccttatcttgcgaaatcaaatacagcatgagaacgtgccggg

SEQ ID NO: 709654 - DNA, 434 bp, Homo sapiens
aacgatggtcctcagcttccaccagcttagccaaagcgcctttgtctaagctgaggacatcgttgcaatgatggtcctccagcttgaagtgctgtatacttagaggttctcttcagagtctaataaactatctgaaaagctgccatgtgttcatcaagttcaaggaagatagtgctgtaataagataaccacatcatcaaaggccatgctgatgatggtttggaggaaaggaaattgaatgttaagcaaaattagcagtccaataatgatagagaatccaatattgaaaatgcaaaggtgtacataaatcgagcaatcaagttttctgatttctttcttcttccttcccagaattatcttgaaaaactctagcaaattcagagagaatcaatgcacagattatcgtcttatcctatcacgtgaagtgtggatgt

SEQ ID NO: 709655 - DNA, 333 bp, Homo sapiens
aatgcaaaaaaaggttccccaggggggccttgattttgtcctaaaaccgtttcccggaagcttttcctggggggggggcttttaacctaatcccccatcgattccagaactattactctgtttcccccgggaaactgggtttaggttttagggaggcccgttcctttatgtttcttaaaaatgctttcccgggggaaagttccttaagtttgggggttcaaattccctaccgccccttaaaatccccttcctgagttttaaaaactgctttgttgttttggaaaaacccatccaattgttgggtgaagtgatgtggataaaaaaggggtttta

SEQ ID NO: 709656 - DNA, 443 bp, Homo sapiens
cagtgacatagattagcatgtcagacttcgagaactccaggaatatggagccaatgacatacatggtgatgcctcttcgatcactcaggagacatccctacggtaggaaaagaagagttggttggcaccactgagatgcaccacagagaccaaagaagccaagaaggccataaaggtcatccaaggaggaagccgcgatggcctacatagacttcctgctccagtcgctgcaccgtggccgccgaggcccaggacggtccccaggaagcctagacggtgtcgccgcctgctccctgataccattggaatgatcttcagaatcatgtcgatcctggggccctcagctcctggggtacccactccctgctctaagacctgcctaggtttttcctactgtcctcagaggcgttgtgtcccctcctcagtgacatcaaagcctggca

SEQ ID NO: 709657 - DNA, 409 bp, Homo sapiens
tctgaggatgagatacagctttcatggtccggcgatttgcatcggcttagagcgtatcagcataatgaaactttcaggggtctcacaaacgacaccacaactccggcaagtacaatgaccagcgttcaggcccgagcttccacccagcccccccaggccctggaggactcgctcccggagaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctggctacagcgtggagctcagatgactgcgccctccacgggcactgagagcaggtggtattcacagcctgcatga

SEQ ID NO: 709658 - DNA, 193 bp, Homo sapiens
cgtccttcgattgcatcgattccattcgattccattcgatagcagtcggggtcataccattccacttgcattcccattccattccattgccttccattccaattccattccgttccattccattccattccattcgaatagattctattccattcccttccattccattacatacaattccattcgagtagat

SEQ ID NO: 709659 - DNA, 829 bp, Homo sapiens
  misc_feature (12)..(12): n is a, c, g, or t
  misc_feature (475)..(475): n is a, c, g, or t
  misc_feature (505)..(505): n is a, c, g, or t
tactgggcccgnggcaccgggtgggctcaatgccctggtgactgcgaggcacttttgggggagggccataggcagaacaccactttgggagggactcgactcaacacaacacaacttgagtccaggagttcaaggacctcaatctctattaaaaaatagctgggcatggtggtgggtgcctgtggtcccagctacttgggaggctgaggcaggaggattgatggagccagggagattgaggctgcggtgagctgtgattataccactgcactccagcctgggtgacagagcaagaccttgtctcaaaaaaaggggagaaaatattggagctctgtaagaaatgtaattacataacatgactaggctaggaataatagttgcttcatcataatcgtgtaaacactggatattaatctattctcaattataaaactgtcctgaaggaatccgagaatggaattatatttcctactangtggggaggagcatgggagaaggaagaatncttcattttttcacagaaaggatggtgatagataacatctatacttacaaaaagaaaaagcaggtgggggcaagtgggtcacacctacaaatccagcactttgggaggccaaaacggggggattggttgagtcaagaggtcaagaccagcatgggcaacatgagggaaacaccggtttacctaaaatacaaaaatagccggcgtgggaaggggccccggagcccagctacttgcagggtggggggggaaaatacgtaggttagggagggggacctcaatggggcggggatgttaacccggcccacccagggggaagccagacct

SEQ ID NO: 709660 - DNA, 435 bp, Homo sapiens
actttttataaagcacagcagaggaatcaaaagagtgaagagataatttatgcaacagaagaaaatatttgcaaaccgtacatcagataaggggttaatatccaaaatatataaggaactcaaaaataactcaatagtaagaaaacaacctgattttaaaatagggaaagaacttagtcatttctcaaaaagaagacataaaatggccaataagtatatgaaaaaaatgctcaccatcactcatcaccagggaaatacaaattgaagccataatgaggtattacctcatacctgttagaatgacaatcatcaaacagacaaaagataacatattggcgaggatgctgaggaaaggaaacccttgcacatcgctggtgggaatgtaatttattacagccagtatgaaaaacagtatggaggttcctcaaaaaaaaa

SEQ ID NO: 709661 - DNA, 860 bp, Homo sapiens
  misc_feature (290)..(290): n is a, c, g, or t
  misc_feature (558)..(558): n is a, c, g, or t
agcggggattacaggcacgcaccagccacgcctgggtaatttgtctgtattggcggtagagacggggtttcaccgtgttagcgcaggatggtctcaatctcctgtacccttgtgatcttgccgcaacattctacctcacgcaaataggtagcttggggattactaggagcacaagtggtttattcttaagtcttgatcacattgtcgatagtttacgtgacaaatctatcagtctcgctggcaacacgagtgtatgacattggaagtcatacaatcctttctctctagtnttcatttctttggtggtgaccgatcttgttagagcaacgatggaggtatcattgtcgtatgcttgcgccagggatggcacgtggcagtgaacctaattcaccagggtatgaatcgagtagcaactagcgtgcaagtcactcaagcttccttgggactcatggcgatccccagtcccgtcgagaccatctccgaagattaatcctaggcgtgattaacctaggttggtggtcagcacaaccagttgtcgtgtagggtctctctatactnaaattctaattcttgtacttacattttcataaaaagtttacatgtagtgcaacttgttgtatgaaaatggcggctagaaacagcacgtgattgcatgaagcactcgtttgtgagagcagtctcccgatggccctatgcaacgttgctatgccccagttgtgccggctctagctagaaatctcttcgttttgatcctccagcaaaagctactaggtgaagaccttatttcgttgaaaacgctataggagagataagccaccggaatcacgtaggggagttgcctgcaagaaaaagtcaattca

SEQ ID NO: 709662 - DNA, 312 bp, Homo sapiens
gcccccccggttttttcccccccttcccccctttttaaatgggggggggggccccgggggggggggcccccccccattttctggcccccggtgggggggtttttaggggggccccccgggggggtttttggggcccttttggctaaaagcctttggtttggggggggggggggggccctttttttttttttttcccccttttttttttttccaaaaaggggggggggggggggccaccccccctttttttttccccccccccgggtatttttgggcccttttttttttcctaaatttttttcccccccccca

SEQ ID NO: 709663 - DNA, 118 bp, Homo sapiens
gtggtagtgatggtcatgatggtgatgatactatggtggtggtgatgactgtgatgatggttgtggcaatgatgactatggtgatagtggtggtggtagtaatgatggtcatgatggt

SEQ ID NO: 709664 - DNA, 433 bp, Homo sapiens
gccagtatatgaagtcccaattttctggggatattcagtgtaccgaaagtaactgcatttaaaatcattataaaccaaaaaacacgtcaaatagcattatcgtattattattttttgtttgtttgttttgagacagagtcttgctcctgtcccccaggctggagtgcagtggcatgacctcagctccctgcaacctctgcctcccgggttcaagtgattctcctgcctcagcctcccaagtagctgagattacaggcacctgccaccatgcccagctaatttttttcgtatttgtagtagagatggggtttcaccatgttgaccaggttggtctcgaactcctcacctcaggtgatccacccgccttagcctcccaaagtgctgggattacaggcgtgagctcccacaccctgccagattattaacattttaa

SEQ ID NO: 709665 - DNA, 325 bp, Homo sapiens
tatactgtagtcgtctatgtttcgtgactctgctcccacggcctcccacttatctactctgcagaagcggaaatctccctgatatctagctcagacggccagggagcacggccgcccctggtgagggtcctgactatagcaccattgacccagagggggaggagctagcagagcttccatgggggcttcccccaacatccctcaggagatctgggtccctggagccagtacgctcctccagagtggagccagggggacagtggtatgactccaactcctgaaaccccgtttagccctgaccagggtaataccccacaagaggatc

SEQ ID NO: 709666 - DNA, 131 bp, Homo sapiens
cgcgagtgtaggggctattacttttatgccgcggcagcgcgccgggcgctcaatgcttgggatgcgagggcgtcagacagctatgtcgaccagggcgatgcccagacgcggacaggatgaacagcgcgtgg

SEQ ID NO: 709667 - DNA, 269 bp, Homo sapiens
agcctttaaatcaatactcttcaaatactgggagataaggaatctataagcattatccttgagcatatatgaaaaacgttacaaagtgaagttaactctttttttcagtcccttacagatgtattaataaggaatccatagcttaattgttcagttttctagcagttctctagttcttcatgagtaaagaattcttttgatacacaaatcatagtaattacagtttctcaaatgggagataaaacaagtgtgatagaaaccaatgcaac

SEQ ID NO: 709668 - DNA, 372 bp, Homo sapiens
agccggcacccgctctcgtgaactctagtcggatatgtttcccctgccactacaggaatacctcttttgcttttctaaacctcatccttgtctctgacccctgaaacctcacttggatcttgcctccctcactagtggcccctagtttatttctgcacatgggtggggtgaccttcgtgctctggcagactcatactgaacccctcgatgttcctcaagaggcttagtcaccaagcaagaccataatacttagaacgcgccacattttgcttactctatgagaggtaactaggaccagaccccagagccaatgcttcctggtactcagtgacaccaggaaatgcttgactaaagggggtggggcatggagag

SEQ ID NO: 709669 - DNA, 145 bp, Homo sapiens
tcttctaaaacagggctactcctcggggtcacagagtgtgaataggtggtaggcttgtacatacaagtctccagaggggtttctgcgtattcatagtatgtatggtacaataaagtcttaactactgtgtgtcttatttatgtag

SEQ ID NO: 709670 - DNA, 740 bp, Homo sapiens
  misc_feature (7)..(7): n is a, c, g, or t
  misc_feature (112)..(112): n is a, c, g, or t
  misc_feature (126)..(126): n is a, c, g, or t
  misc_feature (129)..(129): n is a, c, g, or t
  misc_feature (135)..(135): n is a, c, g, or t
  misc_feature (164)..(164): n is a, c, g, or t
  misc_feature (186)..(186): n is a, c, g, or t
  misc_feature (245)..(245): n is a, c, g, or t
  misc_feature (251)..(251): n is a, c, g, or t
  misc_feature (323)..(323): n is a, c, g, or t
  misc_feature (367)..(368): n is a, c, g, or t
  misc_feature (429)..(429): n is a, c, g, or t
  misc_feature (442)..(443): n is a, c, g, or t
  misc_feature (445)..(445): n is a, c, g, or t
  misc_feature (451)..(452): n is a, c, g, or t
  misc_feature (470)..(470): n is a, c, g, or t
  misc_feature (479)..(479): n is a, c, g, or t
  misc_feature (484)..(485): n is a, c, g, or t
  misc_feature (488)..(488): n is a, c, g, or t
  misc_feature (497)..(497): n is a, c, g, or t
  misc_feature (507)..(507): n is a, c, g, or t
  misc_feature (515)..(515): n is a, c, g, or t
  misc_feature (519)..(519): n is a, c, g, or t
  misc_feature (548)..(548): n is a, c, g, or t
  misc_feature (552)..(552): n is a, c, g, or t
  misc_feature (554)..(554): n is a, c, g, or t
  misc_feature (563)..(563): n is a, c, g, or t
  misc_feature (576)..(576): n is a, c, g, or t
  misc_feature (590)..(590): n is a, c, g, or t
  misc_feature (593)..(593): n is a, c, g, or t
  misc_feature (612)..(612): n is a, c, g, or t
  misc_feature (617)..(617): n is a, c, g, or t
  misc_feature (623)..(623): n is a, c, g, or t
  misc_feature (628)..(628): n is a, c, g, or t
  misc_feature (724)..(724): n is a, c, g, or t
agtccanctatgagttatacacatttagcatagatattcagagacggaagacttagagcaatattaactaagtacaaatagcaggcagcccgagatgtgctctgatatggtntattctaattcatncangcctgntcaatagtctccttagtaaactttcagtntgatttccacaaatatatagcngcccaaacacaaatccaggagcacaatggcaaagtttgcgcaactgttttgggctaatnatgacntttaaagaaaaccttatatcgaccagtatctacgctctcatgttagccactttgcaacatgaagtgaatttntaaatgtatttgacactcaaatcaatgtacaactcaatgaaaannaagaagaaaagggggctttaaaatatttgatggcactacacgttgtatagtaagaggcagngaaaaatgaaagnntnttaaannatctcacacgtttctccngggccaggnacgtnntgnatccatgtnaacttaattncattccanattncatttgtcgacgtcacacaacacacagcnaccntncggttccancagtttccctttncttgacacaagtcnganaagacacacactccaaaanggagnttgagnctagnctcacttcagtcatccacatagtgtctacagggcagcttctctcccaaagcaattctctgttcactaatccgcgaggcactgatggaactgtaatnaaaaccccaaatataa

SEQ ID NO: 709671 - DNA, 466 bp, Homo sapiens
cgggaacctctccgacccggcgccgccgcatgctagcctccagccttctgccgctcgccctctgcctgtggatgcacccggctccgagctcgtcagggatcccgctgcacaagttcacgtccatccgccggaccatgtcggaggtggggggctctgatggagtggacctgatggccaaaggccccgtctcaaagtactcccaggcggtgcctagccgtgagctgaggggcccattcccgaggtgctcaatgaactacatggaggcccagtactacggggagattggcatcggggactgcccccccatgtgcttcacaggttcgtctttcgacaactgggctccttccaacctgtgggtcccctccatccaattgcgaaacttgttggacatcgcgtgcttgtgatccacccaggaagtacaagcatgcgacgaagtccagcacctacgtgaagaatggtacctcgt

SEQ ID NO: 709672 - DNA, 118 bp, Homo sapiens
acaaactttcagttcagttctaaatttatgttagttaaaaaagtgactcaatctatccggaaaatctggtcaaggatggaggagaataagtacgaagtatatgaggaaactaaatgag

SEQ ID NO: 709673 - DNA, 113 bp, Homo sapiens
  misc_feature (97)..(97): n is a, c, g, or t
ggggtcggggaagggggcgcagaggggggcgcagagggggcgagccttggaagcgagcagtgtaattggcgggccgagtcgaggcgagtctctttantcgggccgatcaattt

SEQ ID NO: 709674 - DNA, 485 bp, Homo sapiens
  misc_feature (14)..(14): n is a, c, g, or t
  misc_feature (230)..(230): n is a, c, g, or t
  misc_feature (246)..(246): n is a, c, g, or t
  misc_feature (262)..(262): n is a, c, g, or t
  misc_feature (422)..(422): n is a, c, g, or t
  misc_feature (424)..(425): n is a, c, g, or t
  misc_feature (455)..(455): n is a, c, g, or t
ctcaatgcccaccntttaaacacaaacacacacacacacacagactttaaaatctgaaaaccaaaaatcattatattctgcctgctaatttcttcagctggagaataccaacacaatatcaactttctcaagaaatgaaaaatgttaccaaaaagtaacatacattatcatttaaacgacgcataaaatccaacttgcctttaagattcattcattttttaattgctatngttaatggtaaaaaanttaaccataataaatngtttagggtaaaataaactgttccaggttaaagcacagtaagcttataaactataaccttttatttgagtaccaaagcagagtacaagactatttgagtactggaggaataatacaaaaaaaactaaccatcactacaacctttaatgaaaacattgtgnanngatgcaaaacttctagaaattcattagttngccatatatgtgtatatgtatgatgcctcc

SEQ ID NO: 709675 - DNA, 601 bp, Homo sapiens
agaactcttattactctggggctatgatcccgagagccaaaaagaaaaaatcaaaataacaacaacaagaaaaaaacaaaaaacggcagggttaggagatacttgtaaaatgggaaagaagtgaaccttcatgtttcagcttcttaaaaacaaaaacaaacaaaaaaaactgttctatttggttctgtaaaatattagagcaactggttttgcagaaatgacaggaggacgcatctcaggcgctccagcttagaacccttttacaaatctacgctctggagctccctccaagagtcctctggggttttgttctgcttgttttccttctcacatacattggagcacaggaaaggaatgcaaactcgtattttcttacccggtgggactctgaaatggccgcaggtttctcctagggaatgctgtgtgccttctgcatccctcttccagatcgctttagaagtgacgtgctgtgtccctcctaccctgcgtctcattggtacagaacaactgccactcatttttctcccgcccttgagaagagccaaactttgagttttatgtctgtttgtcattgataaatttcaataaatcttttttatac

SEQ ID NO: 709676 - DNA, 313 bp, Homo sapiens
aagcttttaccgcggccgacgcgggcggtggtgctgcatgcagtgtgagatccggtggattgctgctagcttgctgtcaagtgccaggggtttgtctaggtcttggtcagtctgctgcctggatctgcgaccaggacgatcgatcgagtcgatcgatcagtcgcctagttgtgaggtcgtcctcgtggctcatgatcgtcctgatctcggatctaggtcctgtctggactgtctgtcggactatgtccgactgtttgatcggatcgatcgccatgtcgtcggtggacctgacagcctgatccggtgccggcga

SEQ ID NO: 709677 - DNA, 933 bp, Homo sapiens
gcgcttccagggaatttcgctggggccggtgccctaacgccggccttgcctgggtggccgtgtccccccacgggctcccagaggtggtcagtgtagaccgaaaagcggtgcatttttgccggcccctcttatatccgctcctggctggttaggacccgcgcatttcatgaccttggtgggatccccccggcccttcccacccacgccccccatgggctctcgcccctgcaacatatctgcggaacattattgttcaaaaaggtaaccccggggacccaaacgcccacaaatgtccgcgtgtctcccaataaacccgcagcccgcccctatgtgtaaagatgaacctacttctcgagccatttttgggggcttaattctgggcccaacggagcccccctataacacaacttggggaggcataacgtcctcccaacaccgcgccgcttgccgttgagagcgaaccttggggaaccatttttgcggccccaagcggtagaacttgtgtgcacgccagacaagtagaagatactctctccccctcgtgcaaatatctccaagagggcaatacactcgcttgccaccaccccaagagcagcggtcaatctttatggtcaggttttgccaagaggccaaaacaaccacgcggggcttaatcggtaaacaaagagagatgatagggagacccttgcgctcgtggggcgccaccttcataagttagacaggccctcgatgcccccttcttccgtcaacaggtcttggctaaaacgattggctggcctataatgtagcactccccgacgcagtttgtcagaaagtgagatattccacttgtttgaaatatgaaaccaccccggagcagcactataacgcgcccgcacaagcccctcacccaaagaaaaacatttataaatcgcaaacccaccccacaaaaca

SEQ ID NO: 709678 - DNA, 317 bp, Homo sapiens
tccccggctgactaccggggaaggggagggcctgacttggcacccccgacctcaccagctctgtataggcctcacaggggctgggagtgggctgcctctacggttggtgagcttggcaacatgattacagggtcgagagagtggataggcaaatgccataaagcacatttccagttcctgtgaaactcctctctccgcaaaaagtggaggacaatttgaggattgaaataagagcatgatatttcacaatgaaaataaaaccaggccacgcaagaaccactgcggcctgcccgtgacttggcttaccccgtcgtcag

SEQ ID NO: 709679 - DNA, 330 bp, Homo sapiens
gggcccaacacaaagctgtcagtaataaactaaaacatttttaaaaggtcgcccaacgaataatgggtggggcatttcaaggaaatgcaactgacccaaattttggttaaatgattttatttgaagggggattaaaaaaataataaaggggttttcataatcaaaggtggaaacattttttttttatagtttaagaatttaacacccatttgtggcccttgttttcaaaatccagttttttttgttttttttaaaaacctttgagatctagaataaaactgctccattctaaatgtttagttttagataagaatggaacacttgtggata

SEQ ID NO: 709680 - DNA, 205 bp, Homo sapiens
  misc_feature (93)..(93): n is a, c, g, or t
  misc_feature (147)..(147): n is a, c, g, or t
agcagacagccaagccccttccacatctacagggtcactgtcatcctcaccacagccagggtaatactcacctctgactgctaatgtggggtntggcgatactcccttagtcatacatcatttagcacatatatataaggctacgtngatgtgtcaggcacagtgcttggcacacagaatacagcgtgaattaaacaggcaaaat

SEQ ID NO: 709681 - DNA, 393 bp, Homo sapiens
gttaacgggccttcataatcattaattccaggggtgagaatatcatctgccggaacaagctccatcggtcacatacgcaagcgggggcaacttgggaggatagattgcctcaaggttgggctgcaataaataaagatgaaatcccaataagctgtaaaagagtttttacaacatttcctggtgtcgccatataccgggtcaaagaaatctggtgccaggtaaaagggtctcccggtgaagtttatagacttcacacacctccattaaccaatccagaagaatggctcgcatggtggggctgcagaagagggtgtggctcaagaaagtgctgatccgcttaagtatgtcttttcctggtataacatgatttaccagacttcctctctattggcc

SEQ ID NO: 709682 - DNA, 149 bp, Homo sapiens
tggcccgacttcagttcccgcaaatagtcaaaacgaagtcattactcaaaaggtggaagagagtgttctggcagatgaaactgaaagttcacccgctactcggagggtaagagggtctgtaccccttgtcccagtgtcgagagtgggtc

SEQ ID NO: 709683 - DNA, 462 bp, Homo sapiens
tgaggatcccgggaggccatatactttgctttctgcaagaagctatagagatacagaaggaaacatagggatggaagtaggattctacctatgaagagtatcaagcctttaagtcctataggggccctgtggccccttccttccattgaccagtttattcatccactgatgcttttcattcaacagactactactaagcatcttcgactatgctaagtcctgagcagacagtgaagaactagaaagacatggccctgccctcatgaagattacaagttaggcctattctccacacttgttctaactcaatctgctacatataccttgagtacccagtatgtgttaggtactaaaaggagctacaaagatgaaccagacacagtcttcaagaacttcagggatcagggaaggtttatcctgattgtaatccctccagaggttttgatcatttctctaatcact

SEQ ID NO: 709684 - DNA, 187 bp, Homo sapiens
tttttcccagtgtacagtaacccttgtaaaaggccgtaggtccctctggggaagaactggagaaagggtaacagcaaaacctttgagtgtcttatcaagatccttcctcagcggaacctggccaccccttcattcaaggggttctggatctgcagtagaagcccccgcgaatttagtagtagtaggc

SEQ ID NO: 709685 - DNA, 632 bp, Homo sapiens
ctaattaaaaaaaaaaaaaaaaaaaaaaaaaaaaaaaaaaaaaaaaaaaaaaaaaaaaaagagaaaaaaaaaaaaaaaaaaaaaaaaaaaaaaaaaaaaaaaaaaaaaaaaaaaaaaagaaaaaaaaaaaaaaaaaaaaaaaaaaaaaaacaaaaacaaaggaaaaaaaaaaaacaaaaaaaaaaaagaaaaaaacccggggggcaccaaactaaaacgccttgaagaacagccccatttaaaaagcgggcgaaatagcagaaaaggcccgaaccgaccgcccttaggaacagttgcaaagcctgaggggggaatggaaaaaagaaagcgtaaatataaagcaaaagggcgcgccaaatattggtggaatgagctaaatttttaaccaacagggggaagaagtaaaaaaacctgataaaccaaaggagttgaccaaaattgggcacacggatgttccagatggaaacaagagggcattattaaggaacaaggcctccaacgaaattgggggaaaaaaccgttataaggaacacaggccactagggggagaataaccttaaaaaaaaaaatggagcccaggtgccgaaagtactaaaaccgaaccttaaggagggccccctttggcggggccc

SEQ ID NO: 709686 - DNA, 127 bp, Homo sapiens
catcgaatgtagatctgcggggacaaggcctcaggctatcattacgggtccacgcgtgtgaaggctgcaggggcttctatcggcgaacgattcgactcaagcttgtgtatgacaagtgcgaccccga

SEQ ID NO: 709687 - DNA, 88 bp, Homo sapiens
cccgaaaataatcaattcttaagcattggagtgaagactgttatttgctttatatctgttagaaacagtgtcccagagctctttctca

SEQ ID NO: 709688 - DNA, 843 bp, Homo sapiens
gagatcgcaccattgcactccagcctgggcaacaagagcgaaactctgtctcaaaaagaaaaaagagcgtgggtggatcacattgaggctcagggttggagatcagccgtgaccaacagtggtgaaacccatatctctactaaaaattatagcaattagccaggcatggctagcgcacgcctgctaatcccatcttctggggcaggctgaggccaggcagaatcgctagaaactgggagtgtgagaggttacaggtagccagaagatcgcggccatctgcatttccaggcctgggcaaccaacaaggcgaaactctgtctcaaaaaaaggaaacacacacacggaaacacaacaaggcactgtgaccctatcttgacggcctctccgcgcgcactgggtcacacttcacaccggggcctactacacccacgttcccgcactcttaacaaacttcagtgccgaggggcccccccttagtgtgtgcgccccattctcctgggtaccgacacagcccacaaccgtggccccgctgcatactttccctccaattgcgtgaggatacaggggccacaagggaccaaaaggcccaatcaaccccgggcaacccctaccgtgtcggacacaccccccacggggcacaccaacacacacagagacccactaccgcactaacacgaaccccaagagcacacttcacaacaccaacgaaggagacacaaaggggacaaacacaccaataacctagaacaacacccagggagaacaacgcgacagacagaccacaggggacacgcggccaaagcacaaccggaccacggacaaaggctagaacaacagacgcgc

SEQ ID NO: 709689 - DNA, 285 bp, Homo sapiens
cattgagccccttgatgctaggatggagggcgatgaggcactaggatgatcgcgggcaggcatagttcagacggtatctattatccttagcgtcttgaaatgttagtcttacttagttttgttgtgagtgtgaggacaagggcgtacatggactaggacgcagattcggaaaatgattatcagggcgtgatctttaaaagtgataagctcttctatgacttggggaagtatgcgtcttgtagacctaccttgcgctgcatgtgccatgcatccaggggcttcatg

SEQ ID NO: 709690 - DNA, 234 bp, Homo sapiens
ccaagaagctagaggagagtgcagtcaaatcgtgactgcgctgtagtgggggactcgggtgggcgtgggtccacatggctctggtttcccgatgtcctcttgtggctacacggatgtcgtggtcggccctcagaatcatcagataagcgaagtcgtggcaaaggccgagcacccagaagcccaccactgagtcgtgtccaccaacatgtgcctcttgtctgaccatatggctcg

SEQ ID NO: 709691 - DNA, 469 bp, Homo sapiens
ctaattcttgtatttttagtagagacggagtttctccatgttggccagactggtctcaaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaaaagggaaaataagggaaactggaatttttggaaccaaaatgggggggggggtcccctttgggtttttttttaacccccctggtttaacccctcaaacgtggtgaaaagggcgcacacttggttgtgttatcccttatttttcctccaactacacagcgtata

SEQ ID NO: 709692 - DNA, 144 bp, Homo sapiens
agatagaatcgagctggtacccgatgagtaatcttggcgatgaggatccggcggcgagatttcctcatcggcaagattagtcatcggccaagatttactcatcggccaagcatcggcccagatttactcatcggccaagattta

SEQ ID NO: 709693 - DNA, 241 bp, Homo sapiens
cttaccgtttcgaaaagcgccggccggggcgaggacgagggcgagcacggcgcaaaggaacggcagccccctttccattttcccttttccgggtccgcaggcaaacgcgggagaacgaggacgtggggggaaatgcagcaaaaaggagaattttagcgatccgaagagccccaactccgcctagagctgttcaatcctcagcccgttttgaagaaaagaaagcagcgaggcaatgcctgga

SEQ ID NO: 709694 - DNA, 158 bp, Homo sapiens
aagtcgagtccttcccgggcttaatccatgccggtttggagctctctctaacgacagttcggccgcccaggttctctgggtcgattcggggacgccttgggttcctgccctgggcccggggaacagaacacacatctggctgttttgtaggaggtctt

SEQ ID NO: 709695 - DNA, 144 bp, Homo sapiens
gaaatggatggaacagggaaggaacaaagtttccccagaggaaacagaggaggaggaaccgggggacacaataccccatgactctagcggcacacgtactcaagcgaggcagcacgcacaattgacaggcacccatggactggt

SEQ ID NO: 709696 - DNA, 138 bp, Homo sapiens
tcgggaactgctggggaggtgggatggggtcagggagtggccagagccctgggcactctctccctacaccccttttcctgaactgaagtcacccaacacccaccccccgccaccttccagcatggaggagcaggactt

SEQ ID NO: 709697 - DNA, 342 bp, Homo sapiens
ctcaagggggattgaacagacagcgtacagaatggaagaaaacattcacacgctatgcatacagcaaaggcctactatccagaatctataagagacttagccaaatcaacaagcaaaaaataaccccattaaaaaatgggcaaagaacatgaacagacagttttcaaaagaacacatatgtggccaacaaacatattaacacatgcataccatcgctaatcattagagaatgcaaaacaaaacatcaatgagatactatctcacacgagttagaatgacttctgttaaaaataataaaaatatttccacattcaatattaaaatgttatatgagttgagata

SEQ ID NO: 709698 - DNA, 1426 bp, Homo sapiens
  misc_feature (263)..(263): n is a, c, g, or t
  misc_feature (267)..(267): n is a, c, g, or t
  misc_feature (289)..(289): n is a, c, g, or t
  misc_feature (298)..(298): n is a, c, g, or t
  misc_feature (431)..(431): n is a, c, g, or t
  misc_feature (549)..(549): n is a, c, g, or t
  misc_feature (625)..(625): n is a, c, g, or t
  misc_feature (773)..(773): n is a, c, g, or t
  misc_feature (877)..(877): n is a, c, g, or t
  misc_feature (881)..(881): n is a, c, g, or t
  misc_feature (922)..(922): n is a, c, g, or t
  misc_feature (976)..(976): n is a, c, g, or t
  misc_feature (1020)..(1020): n is a, c, g, or t
  misc_feature (1076)..(1076): n is a, c, g, or t
  misc_feature (1273)..(1273): n is a, c, g, or t
  misc_feature (1301)..(1301): n is a, c, g, or t
  misc_feature (1382)..(1382): n is a, c, g, or t
attataattatttgattagatacagatatcctaccgaacagaaacaacaatgcgcagtacactgagctaggaaggaggactccttactgtaatagattgacacgacgctacatagaaaaaatatagtaaacattagggacacgatattggcagtcccacgacgtagtttggccacagggagggcagtcgcatcatatatatacgatctagcagtaaagcagttaacgttaagtgttatgtagtgtcccgcgaggcgatccgcnttantctgcattctgattatgctccnctgtccatntagtccaagcgtgtgtagctagggtgagagcgttgacggtactattcgccagatatggcggagcatgagagtaactgatgtgtagtacagacgcgattgtgagtagaagaaccgactattagaattgataatncatacgctatcgtcatcgacgagtactatactatagcatacgcgtgatgatgagagcgatgatcgacgagcagatgatattcagcgcgatgtgttgcagtgtaagtgcgttatcgctngatagataccaaggtgagagagcacgcgccggatacaagctttgcgatgagtcgtaatccatgaagacgcgcgctnatgagtgtatattgcgccggccgcgagttattcacgagtgttatatgatacaaggtcactgtaattaattaaggtgagatataggccggctgctgctgattaagcgaggcactaagcggccatcgtatgattaatctacaacaggagnattcgagtgataaagtcaaatacgtgtactacggagcgatatacgtctgtagtataacaagagtttaatatttgcgctacatattatctgtagaaggtgtgcgntgtnccagtcgcacgcgaacagcaatccataaatcaccatgatantcatatatattcgcgagcagtgtggttaccagctaatattgatgcgctaggcgntggttcgcgtacatatgatatgacgagattgcgttgctcctcanccagatcgtccacccatcataatgatggtaagtcgcggatatcatccagagagtcntgttatatatgttatacacggctagagtgtcgattatcacaatttatcgcgccctcattcagagcagaagacgtaggctgatacctgcgtaaccacatctgacgactcaatagagcacgtccatagtatatacgcgcgagaagatagtgctatgacagcgcatattagcgagtataatcgaatttacactcattagnatatgtggatgtacggcatagtatgacnacacgtcgtgacggcgaatgtagcgtcatagagacgcgaaagcgtatagagaatgtgaatactgctcatcttggggcatantctctgaatgcatctgtacatacatgtgtatataatatgtgcag

SEQ ID NO: 709699 - DNA, 664 bp, Homo sapiens
tgacccccagtggctacgaatggggcctgccagaacacatgacaatggtgcaacaaccccaatggtgctaccttgccttcacactactgagatgtgtgtgcagattgcttgcttgtctgtgacctgtttctcttgtgccttccttcattgtgtcgccttgcccaaggtccgtcgttggaagctcacgaaggcatttccacttgtggcgttgtctcctgtgcaagttgaacaccctcaagagacaacttcggacagattacttcgcaaggccttagcaatgccttggggctggaaaaacccgccagcgagaagaacgcacatggtttccgtccaacgcaaagcccgacaggtggattggccacagcaatcttggtggccccctccatgtccacattccaaacaccggtttattccaccacgttcccagagaacgccggattttattcagttgggacaattcccaagtttcagcccgtttggtacgtcagatgacgcgcaaaagcggagtggatggtacggcgggaaaagatgtcggcgttactagagtaaacccacggtgtcccgctatttatgggcacacgggtgggaaaacgttcccagatggtatgggtaagaaactgggcggaaacgcgcctgatttgggtataaaatctgtgggcacccg

SEQ ID NO: 709700 - DNA, 915 bp, Homo sapiens
  misc_feature (454)..(454): n is a, c, g, or t
  misc_feature (457)..(457): n is a, c, g, or t
  misc_feature (582)..(582): n is a, c, g, or t
  misc_feature (629)..(629): n is a, c, g, or t
  misc_feature (650)..(650): n is a, c, g, or t
  misc_feature (661)..(661): n is a, c, g, or t
  misc_feature (693)..(693): n is a, c, g, or t
  misc_feature (734)..(734): n is a, c, g, or t
  misc_feature (742)..(742): n is a, c, g, or t
ggcgatcgctgcctgaggctgctcccggacaagggtccacgagcgtatcgtttggacttctcgacttgagtgtccgtcctccttgcgccgcacggctcgtgcgagtcctcagcgcagtctttccacagggagcccagcagtacttcctgaacatggacgagtgttagttctgccgctgcgccagttcgttagtcccagaagtcacccagctaggtccgtattcatgctagaaagcgacgtgcaaatctgctgatacgttcatatgccacaagaacgtgctctccgaaggatggataggacaagtttgggggtgccgaatgacaccaggtccccctctggagtcgtttgttcgcgaccgtggtcgaggctagggtaacacgttacacaagaactagcgagttcaagaagtagaagcgccgctcccgtggacctgatggtgaaggaaaaggagcanaangaggctgtgtcgtttatatcgtgtccagtaagggtcgcaacaccacgaatcatcgccctttgagatagaggagtcgcctcgatgacaatgcacagctgcccacgagtcgagtcgagacaagcagncgcgtataccggatccatggagaagcaacgcgcgcgtgtatgacgcnttgtgtcgcgaacgaagaggncacgagaggtnggaccaacgataggctcagaagggacgaatanattgtggcccacatttgttacacgtagggacaaagactganccaagaanttagcaggactcctaggggaaggatggcggcagaggacagagaggtaggttcatatacgtacgcgcagaagaaggtcgcgaagggtccctgttggagggcctattacacacgcgggaagcgaacttcggttgccacgtggagaaactcgacaatttgggccgggtcgacgggg

SEQ ID NO: 709701 - DNA, 831 bp, Homo sapiens
taaccatataccaatgatggcggcgatgtaacacgagaaagcacataccaaggccaccacacaccagctgtccaaaaaggccttcgatacgggataatcctatttattacctcagcaagttgtttttcttcgcaggatttttctgagccttttaccactccagcctagcccctaccccccaattaggagggcactggcgccccaggaccaggcatcatcccgctagatccccgtagaagtcccagtccttaaacacgatccgtattactcgcatcgaggagtatcaatcagctgagtctcggaccataggtctaatagaaaacaagccgaataagcaatagtaatgtcaagcacggcttattacgatgtttactgggtctctatttgtaccctcctacaagcctcagagtacttcgaggtctcccgtgtcaccagtttccgacggcatctaccgggtcaacattttggtagccacaggcttccgcggacttcacggtcattattggctcaagtttcctcactatcgtgcttcagtccggccaactaatatttcagtttagcatccaaagcgtcacgttttggctgtcgaagccgccggtctgatacgtggcattttgtagattgtggttggactattgctgtattgtctccatgctattgatgagggtcttagaacaaacaaataaaatggcgaaaaatgatcgagtgtgaaaagacaaagtgggaagagtgaaaaaagaaagagaggggggggaggataaaatcttcgggagaacaaaataatacacgaaagattttttaaaaagagagccataagggggataaaaaagg

SEQ ID NO: 709702 - DNA, 438 bp, Homo sapiens
aatgaaataaaaacttttaaaatgaataacaccacatattcaaaattcaatctaatataaaaagtatatagcgcaatatcttatgaatagcagctactcaatgaatgtttattctatttaattaaaaagtaaatgcaaaactttttaataagaagcatggccattatgactataacataaaaaacagagcatataacactaagagttatgcatgtaaaaagatacagagcttactgagaagttatttgaattaatcaaagcatattttcagttacacacagtgaaaaaaattatttggataaattcaaattttggtaattaatagtacctataaggcatattggaccagatgcaaaactaaacaaaaacaaaaacaacatgaagagaaacaaacttaagttatgtgttatcttctttttaaagtcttattttaggtag

SEQ ID NO: 709703 - DNA, 1191 bp, Homo sapiens
tcgccgccgtgtggtgggtgttagcggccttctttgggccgtgtggtttcctctgcgggtgcgtcccttctccccgccggttgtgggcgccgccccctcgtaggaggagctcccgcgggggtcgtcgtttgtcctgcctttccccgcggattttttagcgcctctgggcctccggcgcgggccggctgtatacgcaagtgtttcacacccccccgggggtccccccgctttgttggtccccctctttgggcccccattttttatagggggcccccccctgtttaggcaccacaccgttgtgcgcccgccacaaaaaggacacaggcgttgggtgaaaccccgggttccgcggagaaatttccccccgggagattttttgttgcgggagacccccaccggcgtttctccgcgcgaaaacgcgcgtgtgggagagtaattgagagccctcctctccccgctcggtctccccgcgcttgttgtttgttgtcccctcacaggagatagtaggcctctaatgaattatgaaaccccttctctcttcacccgcccgactctttgtaaaaaaatttatcaccgcgcccgccacacttttctaaggcacctcaaccacgactcttgtctggccacacacacatggtatatgccacataatagtgtataaaatatatataggggctcgagagagaaggccagagagaaatgagagtaaacactcttgggggagaacacccgctcggagaatattcctctcacaaagtcgcagaaataaggtcatacaccacgcgaaggctataaggggcccacagagtgtttcccctcttcttccctctttaattgtggcacctctcttgtgtttctcgggtacaaattaacctccccctcgggggtgcaccccccctctcgaggtggagaagtgacacctctcctcggagagaaagaagaaagagagtggggaaccggagatctgcactcgaccagactcttggaattgaggaagggagcttaagaacattggcgtatattccccgttttgttgttttgggatagggggcacacatattttaaacatgcccacataatatccaatacccgcttatattgctttggcacacacattttaaaagtttgatatttttttttttttataaatttgagagttggtttttaaaaaacccttttcccaccttttga

SEQ ID NO: 709704 - DNA, 313 bp, Homo sapiens
aaaaaaaaaaaatgatggggccccgaatgggcttaaggggaaaaatatttatgaaatatgggggttttttaaacccccaaaattataaaaaatgggatcccgggggggggtgtgtgtgtgggggtgggggggtgtgtgggggtttgaataaaaaaagcttatggtttgccagaccccttttagaataaacccccaactcctggagggggaggggggaatcccttttacggaccccctgttttacggtttgaattttttaaaatgggccccaattgtataatttttttttaataaaggggagaaaaatccctta

SEQ ID NO: 709705 - DNA, 262 bp, Homo sapiens
tgtctggaggatctctagagtcgacaggctccagtttagatatttggaggtcagcacggtgctcacgtgtcgacgtgaacttgtacaggaaggcatgcaccgcagatggtgaatacacgtcgaccaggctccatgtttgcgtgcttgggaggtgagcacggtgctccagtatctgaaggaacttgtcactagggaggctgatgcacgcagtggtgaatcacacgtcgcagctggaggacaatgcaatgcaatgatcagggtc

SEQ ID NO: 709706 - DNA, 356 bp, Homo sapiens
gccgtcctgccatcgttcaaattgaagggcgaaaatacttagatttttaccccccaattacaaaatctaagtatttaggcccttcaatttgtaggagggcaagcgtggaagtaagaagttctattttaagtactttcagtgctcaaaatatgcagtcacgtgtgttgtatataatagtgcataggtggatcagtcataataattgagtctaaggcttttattaagaaaacagcagaaagattaaatcttgaattaagtctggggggaaatggccactgcagatggagttttagagtagtattgaaattctacctagaatgcaaaattgggtatatgaattacatagcatgttgtcg

SEQ ID NO: 709707 - DNA, 743 bp, Homo sapiens
tgagttgcgcagaggttactccaaggcgaccccgtcttgtacattccggccggcgtcctgtgctccacgactgagcaataacggtagcccccgatgctcgctatcgattactgacccatagatctgctgccgctcagctagaaccgtgatagcctatctcgctcacgtcttctcgaatgctgtatccatgcaagtagcaggcagttgtaggtggattaagacctgaacccggcgtacgcggtaatcgttagcgactacagcgctgcggagtaccccacaataggatgaatgaatagcagttctaccgtacaacccgtaacgataacgcattcgtaatgtaactgagggataggatcgcgaactactaccgcattcctactactcaacttaaaactccgagcagccagcgaccctacgtactatctcgcacctgaaacataggtaacatgactaagcacccattaattccagtccgcaccctcgctctgccctaggaggcctgcgccccgctaaccggctttttgcccaaatgggccattatcgaagaattcgacaaaaaacgatagcgctcatcagtccccaccatcagtagccacgcatcaccctcgttaacctctacttctaccatacgcctaatcctactccaccgtcaatcacactactccccatatctaacaacgtaaaaataaaatgacagtttggaacatacaaaacccaccccatttcctcgcccacactcatgg

SEQ ID NO: 709708 - DNA, 399 bp, Homo sapiens
cttgtgtggtgttatgaacgtaggtgagagaagactgatgggtctgaaattgtacaagaaacgattgataaaattcgtcacatcagagaaaatctaatcattgcacaaagtagacaaaagagttatgttgataatcgcagaagaactttagagtttaatattggagatcatgtattcttaaaggtgtctccaatgaaaggtgtgatgcgatttagaaaacgaggaaaactgagtcctaggtttgtgggaccattcgaaatgttaaagaaagttggcaacgtagcttacgagattgcgctacctccataattatcagaagtacataatgtctttcacgtgtcgatgttaaggaaatatgttcctactcatgatcatataattccataacaccacacaatt

SEQ ID NO: 709709 - DNA, 400 bp, Homo sapiens
agcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggatttacctttgaactttcatagcactgcataaaccttttaaaaaaaaggattttaaaaagaaaatgctttatgaatatctgctttcctacagtagggtatgttaggggaaggaggattagcttttggcttctaaatgactgaattgctttaaatgtatgtatagtagcattttaaaccaaagaacccacagttatgagggcttaatg

SEQ ID NO: 709710 - DNA, 876 bp, Homo sapiens
ggagtatgtcaatctggtggaagatgtggacacgaagttgaacttagccactaagttcaagtgccatgatgtcgtcattgatacctaccgggacctgaaggatcgtcaacagcttgctagcatacaggcagctaacggtacgataaatggatcacgcacgaggacggcagaagcattgatgctcgttctcagccagctcgcacaattcgatggccagaatctacagtggcattgactaccttgaagcctgcctcatttcctcctctcctgcctgtgcaaagcagagcgagctcttctctcgggagagctgcggcatcacatcgctcgggcccattacccatggcgcacgctgcccgcctactcttgacaccagataacttcagactgactctatctgtacacggcaacatcatctgcaggctcgacgatctaaacgctccgagtcatgagactgacttctctccacctggtgctcatctgacggcgggagtgatacctacatagggcccctactggcgtaagatctcacttggctgccacaccgtgaccggcccagacacggacagaggcatgccgcagcccaaacggaagcccaacgacccccaccacagcccacccaccacccccgccctggcccccgccaaccgcaacacagcaccgacacgaacgcacaccgaaccaacaggcccacggcacgcatgccagcgtaccaagacaatatggaaaagacaaaacaccgcaagcaccgaaaccccacatactgccaccacaacacaaaccagtagccacagcaaaacccccgactcacacaacacgccaacacacaacgacactcccgacaacaaagaccgaccacacaacacaccccaaccccac

SEQ ID NO: 709711 - DNA, 737 bp, Homo sapiens
  misc_feature (671)..(671): n is a, c, g, or t
cgtaaaatacactgtgcggagccactctggagcacaaatgggggaaaggaccggcaccgttaaaaggtcccaagtgtcgaaaatggccccgaatttcctggggaatactgctgggaaagaggcagaacaacattgtgggcacaacgcgaacagagaaccccaccgcttttcagttggccccccccagtggcgcccactcacaccactcgcgacaaggtccacagacgaggttcccccccaaacgtgcaccaatcacgcccgacaattcttgtctgcgtccagcaccgttacaaacccgggggaagcgttctccccggatagaatcaagaaaaaaagccgttcggggcccccacccaatgttggggaggagagagagacgggtcctcgggcactcgcggagtaccggaggcggttacacggccgcgaacaccacagagggcaagagccgccccgtggattcgcccccccactccctcagggaagaaggaaaggtagcttttactcttcacggagccacccgggttatgcatgcgtctcttacaggtcgattcccgacgacttccgctaacacgccctcttggagcggagcgatggaacaaaaagagaggctttatttcggttactcaaatttagcaaggcggagccacatcattcttattgtttttgctttnttgagccactccacgagttatgaacgcaaccaaagttgggaacacttcctcggtacaacaatagca

SEQ ID NO: 709712 - DNA, 278 bp, Homo sapiens
gcctttgattctgaccttttctttggtgcagcgtagttcctgttgtttttccactcccaccccaactggaaaaactccattctttggcttacaccatcatcacctgaggtgggggggcgggggtgaacatcttctgggagctggggagactgcccccttgcataaggcatttgagagccacactttaactcagcctaccttacttctcagatcattttatagtctagaatcaacaagtcagtaaaaattgccaaaaaagcatcctatttctactttta

SEQ ID NO: 709713 - DNA, 756 bp, Homo sapiens
aaggctgagtgtgtaaatcaggacgaggcaccaatggcggggttaacttgaagctggtgtgtgtatccttacagcgtcaagggttccacactgttgggagtcgctgcaagaatcggacaggcgctgagcacctgtggctgacccgacatctcagggacccatattgtgaaggctgcgaaggtggagagttacctggtgtctgaagctgccttcaatgctcctggaggtgaactgagaggcaccagatatactgcggacctggcctacgggatgtatagactgtggggcagctcctggggccttggagtcaggtggcggatgcagaaggtcaacgcctgcagggcacaagatccccagcatctcctgttggacttcgatgctatggggtagatcttcttacacatattcccccatggaaggagcaactttactgtgcccatgctgacgtgactgacccgagaacctcacagagaatcctcgaggtgcttccatggcaggagagcagatgtgatactagagctgacatgtggacccaatgccacagggtaccgggaacctcgatcatgacaggctacatcagaactgtgcacagaacctacatcagcgtgaccccagacatcctggaaccaggggggacatccagggacaaacatgggctggaagtcaaagccagcggtacagaggagactggcagcaggaatccagactggcaggacaacaactgaagcagaggaagaagaacagaaggatcaggca

SEQ ID NO: 709714 - DNA, 1300 bp, Homo sapiens
  misc_feature (175)..(175): n is a, c, g, or t
  misc_feature (1300)..(1300): n is a, c, g, or t
ggcgagatcgttggtcatctgactgtctcctatatgatggccgcttgggcgcaggagcgcgtaattgcgagccgtgcgtccgcatatggcggagacagcgcgccgcagtagatcggtgagacgttgctccgggtcaccacgcactgcctgatcattggtcgcactgacgaatctnagcgaatcgcgtgagaagtaactgccgcacacgtatcccacggtgttgtaggtacaggaggacttgggatgtccaggactcgcttgtgaataggaccaccatgatacgaaggcttaacacttgatggaaattgactccacacgacgtgcaggcttctgagtcgcaggcgagggaacgacgtgccccgacatggcactcaagctccgtgggagaccaaccattgcacttggctacaaatgcactgagatcggttggcctcgtgactggagccaaccgtgtccattgcgcatcaattcaagacacctgggtgtgaggaagcatggcgcccgtttaggcatttagttcacgcaatcgtgatcattttgtcccacattgaccccagcggtatgggatgattggcgatgactcgcatagcgttcgttagcatagtattcgactacttacttggggaattcgatcctttgagtcagaggtcattttggagcccccttttggcctttggcaaagggttaccccaaaaggttggtgcacagttaccttgaactggcctttacttatagagttggatccgtctgccccgttgccctttcttgtcaacaacaacttccaccacttccattccctagcgccccgtgttggtggtgcttggggtccccggggaaagggagccggaagcccttgcaaacatggacacaatggaggaaccttggcatacgaatcaccggaattaacgcaacctagggctctcgcgcccctttgtggttggttaacctaggggtgttgatcacccgcacgcggcaatttttagcgaaaaccttctaattgccgcggtacttgagttttccagggtcaagaaacccagggggaagggcggagaaggcagaagaagatcagcccgaggtcgccaacacaggaaggacgcataccaagaagcttattttcaaggatttccgggcaccacctcctttgttgcacgggggcaagccagcgaagcccctgtgtggggcacgagtggtagtaggggctttaaggcaatttaggttaaatttttaaagcagaaagttaaccaggattcaccgggtgtgttaccccaagggctattcacccggagttcatttatccccn

SEQ ID NO: 709715 - DNA, 622 bp, Homo sapiens
gggctgctgctgctgtcgggggcgctgagaggacacgagctctatgcctttcctgtggctgctcatccctgctcggcctccttgtgcgcgctgcattgcctcagcaccattgtgccggccagtgtcccgacgtgctccgctgccagatcccgcccactacagggagcgagtcaagggcatgttctaccagcgcctacgacagctacctggaggaatgcctttcccttcgatgagctgcgacctctcacctgtgactgggcacgacacctggggcaagtttttctctgactctaattgatgcactggacaccttgctgatttttggggaatgtctcagaattccaaagagtggttgaacgtgctccagggacagcgtggactttgactattcgattgtcaacgcctctgtgtttgaagacaaacattccgagtggtaggaggactcctgtctgctcatctgcgtctccaaagaacggcttggtggttgggaagtagaaggctggattggcccctgtttccagggcctcttccttgagaattggcttgctctgagcgcgggccctgaaaagctcctcccagacattttcagacccccacgactggcatgccatatggacacggg

SEQ ID NO: 709716 - DNA, 540 bp, Homo sapiens
ctgggacacggaatggccgcgggcctcctccccctcggcctccagcatctccacagacgtccagtcaacctcatcgcgtgtcccccccagagctagagagatggggccacctggatggccacgagggcgaagaggctgagcgtcactacgcaagcggagcagacccatgacagggacgcggagggtggcgctcaggagcgaggcgcaggaaggcgcctacaccacaggacataccagatgaccagcaagcctataacatcactagcgagcgaaaccaaacacatcaccctggatggacctccacagaagacaggggggacacgcacagctaatgcaacattacagtcagaccaaccccccagacgacggaggcacaagcgtgcaacgagacgcgcaatcacaggaatagagaccccagaacggacacaaggacggcaacacacaagacggtacacgcatacgaaacgaggaaagcgcccacaagggatacggcaacaacccatgagcggccccccgcagccagagacacgagcacacaac

SEQ ID NO: 709717 - DNA, 227 bp, Homo sapiens
ctgccttcacaaggtcaagtaagatgcatgactgtaaatagactaatagaatacacaaacatgcatgtcactagcgagacctatcatagaggtgctctggtgaaaggtgagggctaacgctatacattgtaaggggggccaagtgaaaattggaagaacaaagtatgacaagtagcacgtagatatagcaatcttccaaggagtttcactgctaaggtccaggcatg

SEQ ID NO: 709718 - DNA, 84 bp, Homo sapiens
ccagggcaaattgtatgtgctccttactgggtttattataagtgtcacatgttttttataataaaacataggtgatttccaaaa

SEQ ID NO: 709719 - DNA, 360 bp, Homo sapiens
agcggtcaacattcatttgaaaagacttggttttgccttcttccagagaattgataagaactttgttcttcacaaaacctgttagatatttcgccagttgcatcatcatagaggattttccattgtaagattttccgtagatgatccaaacgccgcgggcttctggtttgccaaacgatgcctcccattttccctgaaagtcaaaatctttaaactttgtgctttcaatctcatccacagaaaagaagtcgtttgccattgatttaggttttgtttttgagttgatatattgcgtttttgttgacgttgtattctcgtgctatcgcggcgccctgttggccttgtgcctaattttctaat

SEQ ID NO: 709720 - DNA, 840 bp, Homo sapiens
  misc_feature (98)..(98): n is a, c, g, or t
  misc_feature (143)..(143): n is a, c, g, or t
  misc_feature (803)..(803): n is a, c, g, or t
agcgggagagccgcagcggcagcggcgcgtctgcctgcagagagccaggccggagaagccgagcggcgcagaggacgccagggcgcgcgccgcagcanccaccctccggaccgcggcagctgctgacccgccatcgccatggnccgcggggaaagccacagaggagggcagctgtgaagaaattcatctgggaactctcgagaagaacgagtttctgggcacgagccgcggtgggccgttgggtttaaagatcctccctatatctacgtaaatatattataggcgtgcgtgggtgggatcttcatcggaaacactccaaagtgagtgctgctcaccatcacgtgaatttaaagcccacatatcttggagcccgagatgggccccgccaggatttacacagatttctcagatccagaaagactggtaatttcctttcgtgcctaaatgagtccccagagcgtatgagggcgtatgtgctgagacatagttaggtgcccgggaaaagtcacagatttcacccagagggatgacactgagtatttgacagattgtgggcgatgtgcgccacgtgtgaccgcagaagaaacgaggagactttaatctactgtaacgaggagagcgcaaaggtctgcgcgattccagcttgaatgggtgggaacatttgctctgggatttaaactgagtgagaactttatgggtacacaagaggggcaaaccgtggcgattattataaagctcaaaccgaggttctagaggcgttcaaacctaaggcttcccaagaaatgaggtccttggagacttanccccgtgatgacagtataaccccaaatgtgctttccg

SEQ ID NO: 709721 - DNA, 188 bp, Homo sapiens
tgcacagcctgacattgagctgagtatcttgaacatcctcattcaatgggtgtatggcagtaagtgttccgattattatgaattctgtggtgtggatgaaaagcaaccatgcgttcactggtcaatagccgttctcgtatgtgtaattcaagacgtttatttttaatatcctcaccttatctgcgcat

SEQ ID NO: 709722 - DNA, 415 bp, Homo sapiens
  misc_feature (34)..(34): n is a, c, g, or t
ccagtgtagctctcagctcactgtaacctccacntttcgtgggttcaagcgatctcatgcctcagcctcccaagcagctgggattacaggcgcctgcaccaagcctcgttaatttttgtatttttagtagagatggggtttctccatgttggtcaggctggtcttgaactcctgacctcagttgatctgcctgcctcccaaagtgctgggattacaggcctgagcccaccatgttcaagcccatccagagaatttaaatgttcttctgagggcagagtaactgcatatttggggactatccctaatgaatgaccattggttttggtttccttaaattgggaaaagaaggcatgagccaaaatctagtacagaatacttgatcttctcttgagcttgaaggcaccaagttttaggt

SEQ ID NO: 709723 - DNA, 220 bp, Homo sapiens
tttttaaaacccccccccttttcccctccttccccccccagccattaaagggccaaaccattttggggggagcttggggtttaggggccccccccccccccaaaaaccctgggttttttgccccccttttcccaaaacccccccttagggggcggaacccctttttaggggggggaaagaaaaaaatgggtttttaattttttcccccctttggccccca

SEQ ID NO: 709724 - DNA, 208 bp, Homo sapiens
aattcaagcttctaacgatgtacggggacatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcaa

SEQ ID NO: 709725 - DNA, 1132 bp, Homo sapiens
  misc_feature (533)..(533): n is a, c, g, or t
  misc_feature (1132)..(1132): n is a, c, g, or t
ccacgcgtcgggtgacttagggaatgattttatttgagttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttcgtttctttctgtagtagcggtatttccatttacaaaatatagtaactctgggattactgaaaagtgtcaaatcctagaaaacgtagcatgcctatacatgatgttaacatcattctcgaacagttgtgggccgaagattcatttgatgaatccaattttttggaaatagacaattctgatgttctctttagaaataactcagtttttatcttttttcacattgaacaactcagtctagattggcttaagcctcaaagcagaacgtgtccatgtaaattaccgctggcacattttcttttttctaaaccaggcacaacgggtcancattgacggttcgataacagtggctgtccactggtcttctctgaaacgtgacgctggcttgaagggctgacatacatattctcctctaagtatattccaaacaagtgcatggcttcccgcgatggcacgttaagacctcaacatgtctgggaactgggtaacgcctcaccacaggtttctccatgaattgggctgcaaagggcacatagccgaatcatccaccgcgacacccgccagcacgaggaaccccaacacagggacacccgtgcggaccgacttcgggacaacttcacgcgtccgacgtcgacctcggcatgtccaaccccgccaaacgggccctcatgccgcactcagaatagcccctgccggcccactcgtgaccacgaacctctgggcaatccgtcaccaacgcgagcgcgcaacacctactactcgtcccgacagacacacacgtgctcacacctcggctccacacaccacaccgccgctctctcgcccacaactctctagaatacgacgcacacccctgcgcagcgccccggcacccgaccacccgccacaccaccaccacgcagttatcgaagtagtgttgtaactan

SEQ ID NO: 709726 - DNA, 197 bp, Homo sapiens
aatatgagagaaggaccatttcagcactaaaggcacacgcccagttcaactagcttagcatatttgaggaggggacaagtataacaactgtcacttaatgagcatagatagggatcaacttggacaggaaggctcgatgagaatataaaaagtttttgaggtgatggcaagaatttacgccccctgtctttcatatt

SEQ ID NO: 709727 - DNA, 1208 bp, Homo sapiens
  misc_feature (580)..(580): n is a, c, g, or t
  misc_feature (867)..(867): n is a, c, g, or t
gcgcggtgtgcacgaagccattagcaggagagtctctcgcagaggggccgtgtacgaggcggtgcgggacacgtcctgtcaccgggaacccagcggcaagtcgccgcacaggttccctggatgcacggtggcaggcttgcgaggagtcacggcttgcacatcaacgtagtgactccgcgcaggagaggagcaaggcgcgttcgtcggggcaccgcgtgcaggcgttacatggtccagcgtcgcaccggcgccttatagttcgtgctgatgctgatgtccttgcggggacccatggcagctaccttgtgaccgacgggggtaacggccagtggagtatctcccacagcatgggacattcgtaggtccgctgaagatagactcaatcaaggacataatatgaactctcggttcagacgcaacgctgagtcacagcaacgtattgtactgcgtctcttgtgggcctccagatggtctacttggatcaagggcattgattcccagcgggaatccatcggatccatgcgtgttaagagtaaggcatggacaccatgttctccttcaccgtgcttcaacacacaantgcaaagatcatggtagtgcccaaaggtgggactgacggctgacagtgccacgaattgcaatgttcgcataatgaaagagaggtggtaatagtcgtggcattgtaagcgtgttcgagtcaacgttgacagactgacatgaacgagtgaggcgttggtgtaataagcattgcacactggcttggtcaaactctctttgcgtggtcatttgcctcgaatgaacaaacctggcagagatcgtccggggaccttatagtatcacaggagcaccagtgggcgaaagccgcantgccatattttaaagggcacactttgacttcaggtcctatttaccacgtaggcgaaagctccctgatccatcacctgagcttcgacattaagaccacctggccgtttaccaggcgttagagacacggctttattcacacggggaccgacagtacaaagcaacggacattgttggtaaacaccggaaccaaggtgagggaaatagaatagggggcaacaatagcccgcagagatatctcttcggaagacaccgggagacatagacaaaaacaggggctacccaccactacaaaacaccgtagcaacatatactggcactacacgacaaacctctacaaacag

SEQ ID NO: 709728 - DNA, 114 bp, Homo sapiens
tactcggggcaattctggactggatggctgagcattggtccttcgtttttggttcgtttgtgtgagacagtcttgctctgccgccaggctgagtgcagagcgagactccgtctc

SEQ ID NO: 709729 - DNA, 306 bp, Homo sapiens
gaactaatcttgatgcagtctgaaaatcaagatcaagcaagagatgaaaactatacctttgaacatgcattaggtaaccaggaggcaacagagtagggactaataaggccagcaactcaggcaaattagcctattcatctgatatatatggcctccataaaactgccatggattccaactgtactcaaatatgatacaacttcttcaatgctgctttataaatctgacagaaaaccttatataaggagtcaagatgctgaacaccctaacaaaagcaaaaacacaattacggcctatgtggtgagt

SEQ ID NO: 709730 - DNA, 115 bp, Homo sapiens
tcctcggggtacgtgtattcaccagtgcggtgcttgcctccctgtacaagttccgtcgacacagtgagcacctgtgtgacctccaaatatcgtaaagctggagctggtcgagtct

SEQ ID NO: 709731 - DNA, 521 bp, Homo sapiens
  misc_feature (25)..(25): n is a, c, g, or t
  misc_feature (81)..(81): n is a, c, g, or t
  misc_feature (102)..(102): n is a, c, g, or t
  misc_feature (240)..(240): n is a, c, g, or t
  misc_feature (479)..(479): n is a, c, g, or t
  misc_feature (511)..(511): n is a, c, g, or t
tcagggggaatcatgctgcacagtnagcaggacaaccctgacggcccagacccgaatgcaactccaaaggaaatcctcagnctagggtaatacagcccaagntgctgccctcctacaatcatgggaggtttcaacccttctgggagaaaagcccctaatgcagcacatgatggtatagatttgatcccaggaaggcagagtaaacaaactatttaaagacatgagtcttggctgggcacnggtcgtcacgcctgtaatcccagcactttgggcggccgagacgggcggatcacgagatcaggagatcgagaccatcctggctaacacggtgaaaccccatctctactaaaaataaaaaaaaaatttaaaaaaattagcagggcgtggtggcgggtgcctgtagtcccagctacttgggaggctgaggcaggagaatggcatgaacccggaaggcagagattgcagtgagccgagatagnccactgcactccagcctgggcgacagagcganactctgtctc

SEQ ID NO: 709732 - DNA, 1007 bp, Homo sapiens
  misc_feature (46)..(46): n is a, c, g, or t
  misc_feature (205)..(205): n is a, c, g, or t
  misc_feature (275)..(276): n is a, c, g, or t
  misc_feature (278)..(279): n is a, c, g, or t
  misc_feature (281)..(282): n is a, c, g, or t
  misc_feature (285)..(288): n is a, c, g, or t
  misc_feature (366)..(366): n is a, c, g, or t
  misc_feature (383)..(383): n is a, c, g, or t
  misc_feature (421)..(421): n is a, c, g, or t
  misc_feature (436)..(436): n is a, c, g, or t
  misc_feature (550)..(550): n is a, c, g, or t
  misc_feature (714)..(714): n is a, c, g, or t
  misc_feature (720)..(720): n is a, c, g, or t
  misc_feature (728)..(728): n is a, c, g, or t
  misc_feature (730)..(730): n is a, c, g, or t
  misc_feature (765)..(765): n is a, c, g, or t
  misc_feature (768)..(769): n is a, c, g, or t
  misc_feature (777)..(778): n is a, c, g, or t
  misc_feature (780)..(780): n is a, c, g, or t
  misc_feature (798)..(798): n is a, c, g, or t
  misc_feature (803)..(803): n is a, c, g, or t
  misc_feature (808)..(808): n is a, c, g, or t
  misc_feature (812)..(812): n is a, c, g, or t
  misc_feature (819)..(819): n is a, c, g, or t
  misc_feature (826)..(826): n is a, c, g, or t
ccagtgtgtgcgactcagcaagtttaactctgaacgcagcatcagntttatcccgccagatggagagtttgagcttatgaggtatcgcacaaccaagaacatcatccttcccttccgggtgatcccgctagtgcgagaagtgggacgcaccaaactggaggtcaaggtggtcatcaagtccaactttaaaccctcactgctggcnaagaagatcgaggtgaggatcccaaccccactgaacacaagcggggtgcaggtgatctgcatgaaggggnngnntnnttnnnnggccagcgagaatgccatcgtgtggaagatcaagcgcatggcaggcatgaaggaatcgcagatcagcgcagagattgngtttttttttttttttnacaagaagaaatgggctcgaccccccatttccatgaantttgaggtgccattngcgccctctggcctcaaggtgcgctacttgaaggtgtttgaaccgaagctgaactacagcgaccatgatgtcatcaaatgggtgcgctacattggccgcagtggcatttatganaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacanttacanagtgggancnggtggagcagcccctgggctccctgggcagggganttnntgaggctnntnatctcccatccacctgtntgtcntggcntaangccaggntctgagntctgtgaccaaaggacaggatcgaggataccatctctttccaacctcctgtggcacacagatcgtggactgggaaggtgtaggatgcccctcacgttcatgtgctcccacaaaggtcagtaatggataccccggcgtcagtgcatactgagctcgaactactgtggccacactttgaggac

SEQ ID NO: 709733 - DNA, 172 bp, Homo sapiens
gtaagagccttttgcattctgccatgattatgaggcctccccagccaccaggaactgtgagtccattaaacttctttttctttataaattatccagtcttgggtatctttatcaacagtatgaaaatgaactaataggctgggcgcagtggctcacgcctgtaatcccagca

SEQ ID NO: 709734 - DNA, 237 bp, Homo sapiens
taatcgagctcgtcctctcttagcgtgccaacatcttcagcatataactcatatctacctggcagctgattagcaagggactacaacactgaatatcaaatattatgattttgagttatatgagcattttccttttcacaggaataatatgaagaaaattacctcagtacattcagacttcttttttttttttaatgagtattttctttaaattcttattgaggaggttatgggcat

SEQ ID NO: 709735 - DNA, 1051 bp, Homo sapiens
  misc_feature (46)..(46): n is a, c, g, or t
  misc_feature (205)..(205): n is a, c, g, or t
  misc_feature (275)..(276): n is a, c, g, or t
  misc_feature (278)..(279): n is a, c, g, or t
  misc_feature (281)..(282): n is a, c, g, or t
  misc_feature (285)..(288): n is a, c, g, or t
  misc_feature (366)..(366): n is a, c, g, or t
  misc_feature (383)..(383): n is a, c, g, or t
  misc_feature (421)..(421): n is a, c, g, or t
  misc_feature (436)..(436): n is a, c, g, or t
  misc_feature (594)..(594): n is a, c, g, or t
  misc_feature (758)..(758): n is a, c, g, or t
  misc_feature (764)..(764): n is a, c, g, or t
  misc_feature (772)..(772): n is a, c, g, or t
  misc_feature (774)..(774): n is a, c, g, or t
  misc_feature (809)..(809): n is a, c, g, or t
  misc_feature (812)..(813): n is a, c, g, or t
  misc_feature (821)..(822): n is a, c, g, or t
  misc_feature (824)..(824): n is a, c, g, or t
  misc_feature (842)..(842): n is a, c, g, or t
  misc_feature (847)..(847): n is a, c, g, or t
  misc_feature (852)..(852): n is a, c, g, or t
  misc_feature (856)..(856): n is a, c, g, or t
  misc_feature (863)..(863): n is a, c, g, or t
  misc_feature (870)..(870): n is a, c, g, or t
ccagtgtgtgcgactcagcaagtttaactctgaacgcagcatcagntttatcccgccagatggagagtttgagcttatgaggtatcgcacaaccaagaacatcatccttcccttccgggtgatcccgctagtgcgagaagtgggacgcaccaaactggaggtcaaggtggtcatcaagtccaactttaaaccctcactgctggcnaagaagatcgaggtgaggatcccaaccccactgaacacaagcggggtgcaggtgatctgcatgaaggggnngnntnnttnnnnggccagcgagaatgccatcgtgtggaagatcaagcgcatggcaggcatgaaggaatcgcagatcagcgcagagattgngtttttttttttttttnacaagaagaaatgggctcgaccccccatttccatgaantttgaggtgccattngcgccctctggcctcaaggtgcgctacttgaaggtgtttgaaccgaagctgaactacagcgaccatgatgtcatcaaatgccactgcggccaagtgtagcgcacccatttgatgacatcatggtggtgcgctacattggccgcagtggcatttatganaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacanttacanagtgggancnggtggagcagcccctgggctccctgggcagggganttnntgaggctnntnatctcccatccacctgtntgtcntggcntaangccaggntctgagntctgtgaccaaaggacaggatcgaggataccatctctttccaacctcctgtggcacacagatcgtggactgggaaggtgtaggatgcccctcacgttcatgtgctcccacaaaggtcagtaatggataccccggcgtcagtgcatactgagctcgaactactgtggccacactttgaggac

SEQ ID NO: 709736 - DNA, 545 bp, Homo sapiens
ggtttcatggtccatcattgactcggcctcccaacgtactattgaagcccccgcatacctacggaaggcccctctaccatctccacaacagatccatgagaatatttgtagtgcattggcatacaacccgtactatatcatggacatggattaccaagttcaaattcaagaagagtttgaagaaagttctgaaattctcctgaaggcagtttctctaagacgcgttgggaggcacactccacttttgacctaagcacgggcaaacacaaacacgagttttacctctttagtggaatatggtacacacgggcagggggtgccacccccagtttacttatcgtgtgtccggcaccacataggatgccaccacaacaaaactaatcgcggcggcttcacaacagcccacaaatgttcttgcgcgcttcttcaaggggtgcgacaccacaacatttacgggggggcaccacggagcaccctaaaaggaagcccaccctcgggtacacaacagaggcgtttcaaccagccaccaagccccccgttgttca

SEQ ID NO: 709737 - DNA, 984 bp, Homo sapiens
agcggaggggaggacggcgacagcgccggagcagtgtcctgtttcccagaggaacagttcatttcaacagccagggagaaagcctggatgctacaagttaggggaatggcggtcaactgtgtagtactacctcgataacgccaagagactactgagcagacatgacatcattgcatgggattaactgacgtagtatctttaaactacgcaaaagtggaacagcttgttgttcaggatccggcacatattgtcgcaaattcactgggacactgcttcatgcccgtggcttgcagttagttaatgatacgaacagtatggaatttctagagacgaaaggctggaacatgcaatatattcacaatggttaaagctgtctgccaagcatcagtgttaacgcgaatgaagcgttgataaggtaacttccagtggagaacgctagtgaaaggacgtttccaggacaacctggattttattcaatggtttaagaacattctatgatgctaactatcgatgggcacggagtatgatcctgtaagaggcacgacacagggcaagatgcaattcctcctcctgaccctgggtgaacagatcttcaaacctgccagacaaagtctcaccatagcgaaactgccaccgagagcaggtgcagtctatatctatgtccagcagctaaaccaggatccacacttctcgaacctcatcagccaaaagggcttcttccagctggctcagccatccaaaatcagataccgcatttacgaaacgccgggtcataccgcctttagtgaatcaggtacatctccattgaagagcagtgcccctggcaagggcgctgcaaaacggcaccgcgaattaccaacccgggcaacgtgcagcaccatctgacccagcccgtccagagaaacccgcacgcaaaataatcacccctgcagcactatggaaccatcggcatactccggaccaccacagggcaccagaaaagcg

SEQ ID NO: 709738 - DNA, 169 bp, Homo sapiens
atctcttccatacggcaaggcaaccctttaggtatttttgttttttgtctttttagggccacacccatggcatacgaaggttcccaggctagtggttgaattggagctgtagccgctggcctagaccacagccacagcaatgccagatctgagctgtgtctgcaatcta

SEQ ID NO: 709739 - DNA, 949 bp, Homo sapiens
tgaaagctgaacccattgattctggtgagggattagcatggcgagcaggcagaacccctctggcaggcgggtcccggactggaaaagtggtgttggtttggatgctgcgtgtctgtcaatatgctcctccggttcactgggtataaagctcatccgggacgcaggttctactataggagctcaagattgcatggtaggccaagatgtccgagccagcggaacaatatgtgagggcatctgtggaggcgtggttgtgatacctgtcttaccactgagaggagactgctacgttgatagctcatctccactctgtagtgtaacttgaggaattggtggctcaagggctccgtgaccattggcatgttggttctgagcaatgctgatccataatgtgcaaaaagggccgtgtgacgccaaggactctgtaatgcccatcttgtccaatctcttggttaaggctcgtagggttctctaccgtatggaactgcttcatgcacccttcatagggatcagacagagcagccgtcaaaaggatcgcttctcccatcgccatggatcagattgagttgcatcagaggatctcctgatcgtggtcactgctaccatcgggagtgcaacactaccagtgatcctgatcaacatgattactctggcaaaatttgggcaggaagatggaggtattgaagaagcgcaaggcatctggcggggggtcaattcaaaagcaaagcccaatgagtaggtgctggtggcgcaacaattgggtggggctttttacaggagtttaatctgtggggtaactagtgatacatttgcttatttaatttatttatttacatttaagtagtttccaattggttacacgatcgggtaactactaaaaagtttcctcttatatggaagtttttaaatacctttaggaaggcatataaagagggaaattgtggtggta

SEQ ID NO: 709740 - DNA, 351 bp, Homo sapiens
caggctctgcagtgcaagcgcaactcgaagcggtccaggccccggcttgtatgactcaggccgcctgtggccacactgattctcagagtaagtgtaatgacctccacgtcatcatttgtgtctttagctaagaaggtgtgttgtaactttacttccaaaacctatttcatgagccaacagagcattaggacctgcacagatcgcggctatcaggcccttccggttttcctgctccttcagtatctccttcacagcagcacactctgatcaattctgtgcgcccagattacctcctggtagtaccaccacatcatatggtccctctttttttgcatcttcccggctggcatc

SEQ ID NO: 709741 - DNA, 606 bp, Homo sapiens
  misc_feature (361)..(361): n is a, c, g, or t
  misc_feature (429)..(429): n is a, c, g, or t
  misc_feature (443)..(443): n is a, c, g, or t
  misc_feature (463)..(463): n is a, c, g, or t
  misc_feature (465)..(465): n is a, c, g, or t
agcttcgtttattttcaagaataatcacgctttcctgaatccaaactaatccatcaccggggtggtttagtggctcaacattgtgttcccatttcagctgatcagtgggcctccaaggaggggctgtaaaatggaggccatgtgtgtgagcctatcagagttgctgcaaacctgaccccgtgctcagtaaagcacttgcaaacgtctgttatgctgtgacacatggcccctccccctgccaggagcttgtggacctaatccaagcatcccttgtgcccagaacagaagcatgggggcaggcaggcagtcaatacacacaagcattgcaagtcattttgctgggcaatacagttccaaattncttctgggaactccaaacctgcaggcaattttcaccctgtaaaaccttgagtcgtacagacaagctgncctggtatatccanaaagctttttattcctcctngntcatatggtgattctgggcttgtggggacttttcttaaagcttcagttatgattcttttttcatacacttatgtggaactcctgcgttgattttgtgctccttccagtcttccctgacactttaacttaccaaactgttac

SEQ ID NO: 709742 - DNA, 308 bp, Homo sapiens
  misc_feature (6)..(6): n is a, c, g, or t
  misc_feature (17)..(17): n is a, c, g, or t
  misc_feature (65)..(65): n is a, c, g, or t
  misc_feature (163)..(163): n is a, c, g, or t
  misc_feature (276)..(276): n is a, c, g, or t
tccctnactccccactnataccccgcctcccctggaaagttccctgctgcagagttcctttcctntttcagccctaccttgggtggtgatttacctgaaaatcttcacaactgatcattatctccttctctttgagacctgactgaaaaaattaggtgtgcanacctgtaatcccagctacctgggaggctgaggtatgaggattgcttgagcctgggagtttgaggctgcagtgagctatgattgcaccactgcactccaacctgggtgacagangtgagaccctgtctcaaaaaaaaataaaataa

SEQ ID NO: 709743 - DNA, 753 bp, Homo sapiens
  misc_feature (139)..(139): n is a, c, g, or t
aacagccccccccaaaaaaaaaatgttgaaatcttcccatgtttcctcctccccgcagaaggtttgggatacaaaattgtttttttttggcctgaagaactaaaattcctccccgggctgggtaggaggaatagggggnattccggtttggtgtcatttcaatcagaaagacacaggccccgttttggggattttgtcaccctgctctgtctgagccagcggaatatgatcaagtggccatgtgaattccaaatatttttaatggggtccagttctctatggattcttacatttaatttgtagggaaatgccatttttcccccttaaacaaggcatggggctcacaagtctatggagacaggccaaaaagaatgtggagaagaaaactgataaatacacagaggtcctcaagacccatggactcctggtctgtacccaaaaaagctgttcgttcctcaaaaacaaaaacaaggcttggctgggaaaacaggccaatgccccggcaagaaaggttgagatcagatgttaggaagaactttcaggtaaagtatgagaactatggagtccatcagcagagatagtagtgaagtctctccccagggaaaattttaaaaaggttgaatcagctgttgtagagttctatttggcaatctcatggttaaatgacttccctttgagctctttaattattggcaataaacaacttctttaaaagttttaaataaaatagcaaccccccccagttcctcttta

SEQ ID NO: 709744 - DNA, 664 bp, Homo sapiens
agggtatttactcattaaagccacgctagagagcagtggcgccatatgcagagagtgtaagcgttgcttgccaggggtatgccaagcgcctgtcgcggcctctcgagtcgctgggactactggaagccgccaccacactcgactaattcgttatatgcctaggagacacccggactgaccgggtgcaccagactggtaaagagctcctgagctcatggtccgtcctcctccgcctataaagcgctggcatacgggcctaacccatgatgcgcggacattacaagaaaactcttagccttcccacgtactatattgtttgagacaagttatctcagtccctgaatggaatgcggtggccctgacacagatcactgccatgtcaaattgagagagtgacgccgtcctgctacctaatcttctggatatatgcgaccattggacgttgccccccacggcagcccatttttttttgctagtagagacagggtctacctatgttggcctggctgtactccaacgcctgggggcagcgattctcctgcttagggctcccaagctccgggccaaaacctgcagagcggggaacccctaaatctcggtgggggggcaccccgggggaaccccggctgggttgccttagtgggggggaaccatgaaagagcgc

SEQ ID NO: 709745 - DNA, 406 bp, Homo sapiens
ttaatgcttaattcaaaaaatatctgagtacctgcagtgttccccatgctacatactgggcttaaacagccaaaaagacacagtctttgacctcaaaatactttgattcttgtaagaaaaactgacaaagacaaagagaaggcaatgtgaaaacttctacagttgggataaccttggaggttacaggatgtggactcactgaaagctttctgctggacttgaacttgaagctgaagtctgaaggacagatgggtgttgcttagcgaagggaaagtaggaagcaaagacccctggacagagtgtagcaggcacagagggagcatgacaccttcgggagagagccgcaagcacctgggcccagatcccagctttagcttcattagccctgtgaactctgtatgtcagc

SEQ ID NO: 709746 - DNA, 155 bp, Homo sapiens
aggtgctcaaaagaaccgtgactggattgaaacaatgttcatcgacatactgcatgcaaaaggcctgtgaagagttaaataatgctatggcgccaccttctggcacttgatccttgaccattaggaatgtgatgaaatgataattaattggactc

SEQ ID NO: 709747 - DNA, 189 bp, Homo sapiens
gcgccgctgcactccagcctgggtaacagagggaggctcggtctcagaaataaggaaacaattgggattatattttgggtgagtacgtgtcatgctgtcatgttacttaaatatgtcaaaacctggagtctgttggctgtatactctcttgtttaaggcattcgcgtaaatatgggatttcttgacgag

SEQ ID NO: 709748 - DNA, 388 bp, Homo sapiens
tacgactgcagcacataaaaataatgaacacaaagtccctcatgctacctatatatgctatacacaccatccaaagcctaagctctgccagtcacttttctcctatcagtatgacatcatcatgacatgaatatgataaacataaaatcgtttctgtaaataggttattactaaatgttatataaataagttgatatgaattttttattgatagatgagctatgtttagtcttttggtcatttgttgtacactcagcaaattactcctaaggttcatataagttgatgaatagttgtttaattattttttttaccaccatgtatctgaccaggatgaaagttgtttatatttgagagtagtatagcatatttgatgtatatacatgag

SEQ ID NO: 709749 - DNA, 224 bp, Homo sapiens
acgctgggagaaaatgtctattttttgtattccttaaaaacaaaacaaaaatcacaagtctaatactagtccttggaaatactgtacaccaatcaaagccaccttactcatgcatcaagacggtctatgttctcttgacttctggatgccaaatgctcctaaataatttctgcaaacagattcctcttaaacacattatatgcatgagggcaaagctggccagc

SEQ ID NO: 709750 - DNA, 209 bp, Homo sapiens
tctcaagatctacgagacccaatcccctgtgcctacacaccaccttcgctgaaacgctgtgtcagctgcattgctgacatctcacctgcggctctatcagcatatttgaactgagaaccacggcctcacgtagcgaggacggtatgacgctggggtgagcttctgggcagcgtggcgttatccaatgagtaggcaagcatgatggagcg

SEQ ID NO: 709751 - DNA, 238 bp, Homo sapiens
cccccccccccccccccctttcccccttaaaaaggtttgggtttttcccatcccccccccctccaggggcggggggacaaggggtccctttaaaaaccccaaccccttttttaaacctgtcccgggggtttattttaccaatggggtttttgggccaaaaggggaaggcggtttgccccaaaaaaaaaggtttttttttaaaaaaaaaaattttttaaaaaaaatccccttttgggga

SEQ ID NO: 709752 - DNA, 256 bp, Homo sapiens
cgggagtttcgaaacccagccccgatcgacatggagaagccccgtctccactaaaaatacgaaatcagccagacgtggcagcgcatgcccgcaatcccggctactcaggaggccgatgcaggagaatcgcttgaaaccgggaggcagaggttgcggtgagccaagatcgcgccaccgcactgcagtctaggccacgagagtgaaactctgtctcgggggaaaaaaaaacaattaaaaacggtgtgggcacgagttg

SEQ ID NO: 709753 - DNA, 112 bp, Homo sapiens
ggtacctcatgttaactgggcatttttcaaactggggaacaatcactatgggcgcttaacaacatatagcggttaaaatgcctgccatgctgccatgcctaggctgtaagat

SEQ ID NO: 709754 - DNA, 431 bp, Homo sapiens
gccccatctctggaggaagatcggggtcccacacctcagaggattaccaccgtggcctctgctctttgcggccagctgaacggatgacaaacatcatccaggcctcccctgtgcgaccttgcagggcagcgaggactctggacggccccacctgaacccaggcctccagcaacatcctcccctcctggccccggagagcagagagggcgccaaggggaagcagaagcaggctttggtttttctgcaatagctttgcctttttgtttctcaagaagaaaatattcagccctgctcccatgggggaaaacagggaggacaggactgaaggctatttttgagatgctgcctcccccaaaggaagggtgggaatggtgtgaagagagtcctgccctcatttcctggaatagagcatgtgggtcaatagttaaaaa

SEQ ID NO: 709755 - DNA, 310 bp, Homo sapiens
  misc_feature (253)..(253): n is a, c, g, or t
cacatcatgggtatgatggatgtggcgaaatgaacatattatggattttgttgtgtcatctattaacctaaattatttacagggtgtttatcgatgccacatccccctcaaagggagtgcgatggggatgtggcttgcttcttccgggctctgccgctcaaacctctaggggagcatacagatgggcaggctgtggggctccgaccccacggcagtgtctaggggtgaatgtttatagctgatgccccagtgngtgtatgttacagggtacttttttagtttagccatccataggtggcatcaataaaca

SEQ ID NO: 709756 - DNA, 758 bp, Homo sapiens
  misc_feature (174)..(174): n is a, c, g, or t
  misc_feature (449)..(449): n is a, c, g, or t
  misc_feature (734)..(734): n is a, c, g, or t
acaagagatcgagaccagcctgctcatcatagcgagactatgtctctatacaaaagacagattgaaagctgtataatgtcactgtattactgtgaagatagttgtaacttatatgaatctctggaccatcctttgcgaactgcttctgtacatgatcagattctcactaacagnggttggacttatgatatttcatctttacactgatgccgaagcaatatgcattctatagttatacttgaagtacacttactaccatactgacttcacttacagtatagtatacaatatattatatgagatattctacactctattatagaataggctatgtgttacgcgagtttgcccaactctacgctaatagtagtagtctgagcatgtttacagtatgcccagctaatctgtgatgtgcagcattagatatacatgcatttttaacttacagngtgttcaacttacgatgtgtttatcaggaagtaaccccatcatatgcacaggagcatctgtgttgcgtaatatgactggcacagttgattatgatatgttcagacgtttctctcagcatatgtttatagtgtgagtagacaggttatgccctgtgacacgctgagtaagaatagtctctcctcacagcttatagtatacaccggaagatatccttacattagtggctagactatcacacgcaagatataccactgaagaacactaatgacagaattactgtggtntacagatagttagtagcttcacct

SEQ ID NO: 709757 - DNA, 175 bp, Homo sapiens
ccgtttacccccaaaaacacaaactggtgaagcattttggacaaccgtgtgttatcccagggcagttttaagtgtaacgttaaaacttaggcattttcctgtgtggcggaataaaaaaggatttaacagttacaagccccccaattcaaataaaatttaatcccagttcagatga

SEQ ID NO: 709758 - DNA, 238 bp, Homo sapiens
gcacggtttgcgcgggatacttgccggacgcggtttccgcggagagcatcacggcgtcggcgccgtcgaagatcgcgttagccacgtcggacgcctcggcacgcgtaggacgcggatgatcgatcatcgactccagcatctgcgtggccacgatcacgggcaaaccggccacgttgcacttgtggatgatcatcttctgcgcgctcggcacctgctgcggggagatttccaccgccat

SEQ ID NO: 709759 - DNA, 267 bp, Homo sapiens
tgacacttaagtacacgacatataatcactagtcatgtcattataaatactatgagtcaactaataccctgtcagaacatttcgtgcttgataactgtaatctccttgctatcttacctgcatcatatattaaccactgtccacctccacattatccctcttactgaagtcaagcactacacaagttcatggggacttagaggcaagtgtgacggctgaccaccccaatagttagcagagcctttcatctgacggtgcgttggccca

SEQ ID NO: 709760 - DNA, 217 bp, Homo sapiens
tgcggtgcttcaggagctagataaatcagtgcggcgggtgtggtcagctgtatccacatttgggagcgagtgggcagatcacttgaggcaggagttcaagacagctgcaatgtggtgaacctgttctataacatatgaaattagccgcgtgatggatgtacctgtaatcccagctactcaggagactgaggcaggagaatcgcttgaacccgggagg

SEQ ID NO: 709761 - DNA, 202 bp, Homo sapiens
catcttggaataattgtcttgttgtttttgtttttgagatggagttacgctcttgtcacccaggctggagtgcaatggcgtgatctcggctcactgcaacttctgcctcccggccccaggcgattctcccgcctcagccttccgagtagccggggttacaaacgtgtgccatgatgcccagctaattcctttgtattattag

SEQ ID NO: 709762 - DNA, 208 bp, Homo sapiens
tagctactgaacaacccatcgtaacctcagaaccagactgtgcagagccatcgcgtcccactctttatccttgctgcttcaggtgtctaatatttacctcatttgtgtccacctctagattacttcaggtttatctcctttaaaattagttactaccactcaaatgtatgcatacctataatcccagcacttagggaggctgaggagg

SEQ ID NO: 709763 - DNA, 83 bp, Homo sapiens
aattcaagatatctaacgatgtacggggacatgtcatgtaggttgtctaaaaataaaatgcatttaaacccgaaaaaaaaaaa

SEQ ID NO: 709764 - DNA, 684 bp, Homo sapiens
  misc_feature (510)..(510): n is a, c, g, or t
  misc_feature (531)..(531): n is a, c, g, or t
  misc_feature (548)..(548): n is a, c, g, or t
  misc_feature (578)..(578): n is a, c, g, or t
tagctttatcaggtcgaaggaggatacaatagaggttaaataacctgtttattttttaaagtgtcaatttctattctttctgggtttccaacatgtcaggttatagaatgcaacattaactgaagtgattgactaatctcctttctttctcactgaaattaactaatttgagacagagtctccctctgtcggccaagctggagtgcaatggcgtgatcttggctcactgcaacctccgtctcctgggctcaagcaattctcttacctcagcctcctgagtagctggggttacaggcgtgttttgccacgcctggctaatttttgtatttttagtagagatgaggtttcaccgttctggccaggctggtctcgaactcctgacctcaggtaatccgcccgcctcagcctcccaaagtgctgggattaccggcgtgagccaccgtacctggccttgttttaattcttttatcttggaaaaaatagacctgcagaaaatttcataagcacttnttttggatttccacatctccnttcattgctaacattgngtcatatctgctttctctattcagtatttntgctgaacatgtgaaaagtgtagagatcatgactcttcagtaaatccacattgtttatcaaagaacatggcaatttcttgcatatcacagtgaattttaaatttag

SEQ ID NO: 709765 - DNA, 177 bp, Homo sapiens
cactaggttgcgatagaaattgaaacctggcgcaatagatatgtaccgcaagggaaagatgacaaattgatgaccatagcataatatatgcaaggactatagcccctataccttctgcatatgaattaactataaataactttgctaggagagccaaagctaagacccccgtaaacc

SEQ ID NO: 709766 - DNA, 125 bp, Homo sapiens
cacgctctctctgtggggtgccaggcatttctacttctatgcttcccataaccactctgctggtcaccacctcttccacgagctcttcctgcaaatcctcctctagatccccacagagagagcgt

SEQ ID NO: 709767 - DNA, 185 bp, Homo sapiens
agatgctacgtgtcctggcatattaggtgtcgattgggtaggcagtcatggatcacgtaatgcagtatgtctgagccaagtcggccgttagtacaggactccattcggctggtcaaaagatgcactaaacctgatagaaacgacttccagaagattgccatggcaaccagcactaggatttgcta

SEQ ID NO: 709768 - DNA, 765 bp, Homo sapiens
ctattctcagcaagtcagactgtcgatgttccagaaaatgtctgacgttactctgaagggacgcacagttatatcgtgagagggccccgagaggagccctgcggagggacttcaatcacatcaatgtacaactcagccttcttggagagaacaagaagaggctcgcgggttgacataatggtggggtaacagaaaggaatctggcataccgattcggcaagtatcttgttagatcatggtaccaggaacgatgtatcgaagggtggttgcaactgggctcttccggttacaagatgaggtcatgtgtatgcatcacttctcccaatcaaacgattgttgtgcccagagagaatgggtcgtcgttggttgaaagccgaaatttcattggggtgaaaaatacaagtccgcctagggattagagatgagacccaggtgttgcgtagtcagtatctcaaagcccgagagagatgtaattacactccttgagaggaaatgagcagtttgagcttgtttgcaaaattcacgcggggtttgattcagcaaggccacaacagttaaagaacaacgaatatccaggcaggtttctggatggtactctatgtctctgaaatgggaagcgttgcaagcaggctgatgaaataaagatctaagagttacctggtacacgagagaagatgcccgatgacattatgacctacttgtgagtttgtagatgctgcataaaacggccctatcgttttgaactttcttctcacaagcaacagg

SEQ ID NO: 709769 - DNA, 177 bp, Homo sapiens
  misc_feature (158)..(158): n is a, c, g, or t
  misc_feature (174)..(174): n is a, c, g, or t
ctccccaatttttaaccagagataactttgttccttaaataacattcccttcccacttctcctttggaggtttccctttccctttcccatttttttacattaaggggtatgttccctcttgtccctttccttacctttatatttggggtccttttttntccagggaaaaccaancca

SEQ ID NO: 709770 - DNA, 130 bp, Homo sapiens
taaacatcattcggaagaccagaaagaagcttttagacatacatttattgcttatttggggagggcgggggggggataggggtccttggagggattataatagctgaaactctcattgaaaaaggggtgc

SEQ ID NO: 709771 - DNA, 146 bp, Homo sapiens
tgggtcacaggaaaaagtgggttttttagttgaattttttttaacattcctcatgaatgtaaatttgtactatttatccccccactcctaatgccccatcttgggtgttatatacagatagaaatgatcccaatttaagattcaaa

SEQ ID NO: 709772 - DNA, 320 bp, Homo sapiens
gaccccacgcctctcagaggcagaggctccatgccagcctttgacccacaacgagcacacagcccgtctaccagaccagcactcggactgccctgcagtggcacgcttgggcctccctggagagccccgccctgctcctacgctttaccttggaagcctgacaggcgccgactctcttgctcctccatcgatggacactgcattgcttctaatcgtacacttgaggagcgcaggggcctggtgagcagcagctaaccctgtaggcagcctttgcgtgatgagcccttcttcccttatactcccgcggggggtaccgagct

SEQ ID NO: 709773 - DNA, 272 bp, Homo sapiens
agcttctgggtatttgtctctttttctttctttcttgagacagggtctcgctgtgtcgcccaggctgaagtgcaatggtgtgatcatagctcactgcagcctcgacctccagggctcagcctcccaagtagctgggactacaggcgcgcaccaccacgcctggctagtttttaaatttcttgtagagatgggtcttgctgtgttgcccaggctggtctttaacgtctaggctcaagctcaagctcttgccttgccctcccagagagccggaa

SEQ ID NO: 709774 - DNA, 565 bp, Homo sapiens
ttgcacagccaggtcacacccgagttgcctgatttgaaggggatgaggccacagtgtgagatattcacattgcagtatctgggcagtgaccgtctacttgctgagaagagagccggtgcagccaagtgagacaggccctggggttccagccctggctccaccacccaccagctaggtgcccttaggcaacttactcaactgccctgtgcctcagtttcctcctctatgaggtggggatggtagcaccacctgcctcgcaggatgtgagagtggaagaagttaatctccatcttaaggacagatggcacacactatgtgagtatttcccaggagtttattcttaactgctctcttctgtgcagggaggctggctgtcttccagatcattcaggaagcccttgtggagctgagtgtggcatgtgtcccaggtcctggggtatgtgggtcctatcctcaagcagctctcaagagtccccttctccgtactttgaggcctttgcatgtttggggttggagccaccgttctgcctcgtaacggctccgactttgaatgagcctgtcgccc

SEQ ID NO: 709775 - DNA, 167 bp, Homo sapiens
tggtaccgggtgggagtacggaatgtcatagcaattcgccctcatcaggcagactgtgagaaagagcagcgatgtggtggacccccagcagtgggaaggccgggctacatgagggagccctgctttgccttgcaaggcggggacaggcgcacacgcattacacttct

SEQ ID NO: 709776 - DNA, 533 bp, Homo sapiens
gtggtgcagcccccccggggttttttttaaaccagggtttgggcccaattccttttgaaggcccccccaaaatttcggcaacaattttttcccttttgcaagtgcatgatttcccaggcccttcaaaaaaaacggccaatcccacaaattttggcccctggggacccgttgggaaccccccattttctggccttttggcaaaccctggattaaaacaagtccctcttggaaggaaaaactggttttaaaaactctggcccaaaatttaatgcccccgttgtgggggtcccttaccaacccattttcccctggtttttggccaaaaattttggggttttttgggcaacccacccaaaggtgggggttagaaaaaacggggggatttccaccaagttggggaacttttttttttttagcccaaaaaaaagccttttcccccagaccctttttgaaaaaattaactttttaaggggttcaaaaattaaggcccccccccagaaaggtcggggttttaaaaaaaattgggtggcccc

SEQ ID NO: 709777 - DNA, 162 bp, Homo sapiens
tgcgcaccgcgcgtctcggctgccctttgtacaccgcgccgtggaggggggctccgagggggcgcagcctcaaaccctgcctttcctttacttttacttttttttccttgggaagagagaagaccagtgtgtccgattctggccctatttatgtgtctcatc

SEQ ID NO: 709778 - DNA, 316 bp, Homo sapiens
tgcgggcgatctagaggatccctggcaggctctctacctcagcctcctgatagctgagatacagggcacccaccaccacgctgggttaattttggtttttaagtagaaagggggtttcatcaggtggaccaggctggtgctgaactccggacctcaggtaatctacccacttgggcctcccaaagtgctgggattacaggtgtgagccaccgcgccaggccctttggtgattttggaatggtaaggtggtcattcagatagcatcccacacgtttccagcaccacagatatagcatgacctttatttttggagatg

SEQ ID NO: 709779 - DNA, 983 bp, Homo sapiens
agcgggtgtggagaaataagaggatgcaacagcagaagagaagatgacgtatggcgagtgaagacgagactgatagtggagctggtagtcgtaacagtttcgcgaaggcaacgagagactaagctccacaggccactagtgtgttgctggaacgggacctgtcgtccgtccaatggtgaaagtcaagttcggccagagtgaagcacaagcagatttgcagatcaccatgagccgtcttaacagaaaccaagaaggtccaataggatacagtcatctctcagcaagcgtttccatagtgatgaatctgtgtcagcaatggaaaagcaatacctggcgtaacagtaaatctcacaccgacagacaagagaagatagatggaatcttcactcactggactttactgtgtttagatcttgaagaaccaagtggactgtagccccgtcacgaagtgatcagttcgtaagcgtgtgcacaatgattcagaccaaatgatacgagcgtaagacgaacattccaagaatatccacttatcgaaaactgttttagcaccccaaagcgggtctgtctgcatatcgatgaacagaatcgaggagtggatatctaccattatggaagaggacagaatatgtactaaaggtcttgtaagcacccgactacagggaaaaagggcagagatgtttcgtttgctcaatttaatagatacggatgacgagtgtagattattggtaggatacccagaagtatgttcatcctagtaaggggtaaggcttaagtaaatgtttcatattgggaagagtccaagaatagccacacagattgagcccaatggcccaccctggaggcagcacactgggagaaagcagaaaggcttaaaccaaaggtagtacaggggttaaagccccggaattccggaaaacaggggggggacacgcccgggcccggagaacggcagcttgccaacaagaaagcccatttggagagga

SEQ ID NO: 709780 - DNA, 338 bp, Homo sapiens
acgcagtgacgtgatgcacaagggagtcaggaagagacggcaacgtaaaggatgtggcggcatgtccatggtgccccctggacaacgtaaggagcgtgggatccgatggaaaggtggatctcagggaaaatggaggtccatgcctttggtgtaccgcctcaagcctgacccgatagattgagcaggaatgccaggtgcaccaaaaatggtactcacgtgggcatggaaatgggtcagattaggggaccattagtctcagaggggagggaaggtgtcatcagtgaccactcagggcacctatccctcagttgtggcaagtaaagggtcattgaagctta

SEQ ID NO: 709781 - DNA, 285 bp, Homo sapiens
ggggcctggtgaaggctcgccaaacgtcatcatgtcagctgctgtaatatactaaatgcatggtagctctgagccaggtcttatgaactgttgcccaattcaacagtgccagcgttccaactttgtgcaaacctaccaacatcctagatggattgcctgtggtggtaccctctaagaggcggacgatagctactatatcagttgagaatactaatcactttccagtatcacatgagagattgacactcatataatagacctagagtttgcacgctggagaaccag

SEQ ID NO: 709782 - DNA, 199 bp, Homo sapiens
ccacggtatcgaatacagaacatgcggctgcccaatctgctgggccacgagaccataaggaggtgctggagcaggccggcgcttggatcccgcgtggtcatgaatgcagtgccacccggtacaccaagaaggttcctgtgctcgctcttcgcccccgctctgcctcgagtgacctaggactgagaccgatccagccatg

SEQ ID NO: 709783 - DNA, 343 bp, Homo sapiens
tcatgtctataccaagtgagcagcttctggactcacaggggtagtgccccggtctgggacattgtttgcagcacatcagcctcgtgatcttggacagtctgcagaaatgtgtcttcagctttgacagccattgccaggagaaagccagtgaatatattgccgccatcttggagctcagtgcccttgtgacaaagggacaccagcagatcctcctgtacatagactatcctgtattatctcaaccctaatgggcagcgtttccgcaaggactgacgactggtgcacgaattcacagatgccgtcatccaggagcggcgccgaaccctccctaaacagggtgttg

SEQ ID NO: 709784 - DNA, 795 bp, Homo sapiens
gaccgtaacctcaacaccaccttcttcgagcccgccggaggaggagaccccattctataccaacacctattctgatatttgcggtcaccctgaagtttataggttcttatcctaccaggcttcgggaataatctcgccatgattgtaacttgactactccggaaaaaaacgaaccatttggatacatacggtatggtctcgagctatgatatcaatctggcttcctagaggtttatctgtgtgagcacaccatgatatttacaagtaggaataggacggtagacaccacagagcatatttacacctccgctaccataatcatcgctatccccaccggcgtcaaagtatttagctgactcgccacactccacggaagcaatatgaaatgatctgcatgcagtgctctgagccctagagattcatctttcttttcaccgtaggtggcctgactggcattgtattatgcaagactcatcactagacatcgtactacacgacgaagcgtactaggtgtagctcactgccacttatgtccctatcaataggacgctgtatttgccatcataggaggcttcattcactgatttccccctagttctcaaggctacacccttagatccaagacctacgccaaaatccattttccctatcatattcatcggcgtaaatctaatttcttcccacaaccatttctcggccttatccggaatgcccgacgttatcggatacccgatgcataccaatgaacatcaaaactgggggctcattcctacagcgcaatacacttccgatgaa

SEQ ID NO: 709785 - DNA, 288 bp, Homo sapiens
agaatatacaatggggaaaggatccctcctcaatggatggtgctgggaaaactgaatatccatatgcagaagaatgaaagtagacccctatctctcaccatatacaaaaatcaaatcaaagtggattaaagacttaaatctaagacttcaaactatgaaactactagaagaaaatgtaggggaaatgctccaggacattggtctgggcaaatatttgagtaggacgtcaaaaggacaggcaaccagagcaaaaattgacaaatgtgattatatcaagctggaaggctt

SEQ ID NO: 709786 - DNA, 1459 bp, Homo sapiens
  misc_feature (371)..(371): n is a, c, g, or t
ttatgattttggtgccggcggaggttgtagatgtgtagttcgcagcggcttgtgtgtagcacgtttgttctgtcacccctagactagtgttgttgtttccctgcttgtctgttgttgcaatatgctgtctggtgcgttgccgacggttgttgccctttgggtggtgctccgtgtggatcagaccccttatgctcctcctttgatcctgttttgtcgactgaatgatcatgccgactgtccacttttggtgccccccccttggttacgctccagcctgtgttttggtggggaaggtaagcttttgggtgggaaattcctccttatgtggacccacattttgtggtggggagggttccccctgtttgtgtgtnggtgttctagccacaatagccccgtctttgtggggtccccacatcgagattttctccgtctcccccccctctgtgttagttggcgagtctgtctctcgtgactgcgaatgctcttatgttggtggagggtgtcctcgcgcccccggcgccggtgataggtgttatgctattgttctcctccccccccactgcggttttatgggtggagcgtaccccggtgtattaggttttatataatagccaactacgtcttgttacatagacccctcgcactccatctgttggaggaaatctgttataaatagtggaagttgttcttttgtgacatcaaataaataatatgtttttgtccttctagtaagaacctctcctcgtagaagtgggtggttttgattaaaccaccttcgtattacatagaaaatattacccgctctgttgctctacatcaatattttaatatacaggccggtcttggttttagaataccatgttgtgcgtctaacaggggaggaaacaccccacaagactcggttgagccaacatcctccgcgtgttgttgtataacatagaattcgcgccacatcttccccagacatcgttgttatataagatagtgtgtgtggttattttttgagagttttgggtctcctttgggagacttatgaggtgcgcacacagtgttcaccctctgcctggggccacacatctgggtgtatttctgcccactcttaagttgtatagtgtttaatattaaagtttggtgtaccctctccacgagttttgatatgttctcttgtataataccccgcaccccactgcacttctctctcaagcccgcacactaaatattggcccacgcgagaatacgttctcttttttaaacaaacaacaaaacaaagactgtgtcacgccacgaaccacgttatccacttcacgaccactactggaatgaattttgaaatctttactatggttttagtctggggaaggcctcacgtatggcacttttcactaattcacctctaatgtaaagattgaagccccaagatgagttaaattcagtgctgtattgcaacccgtccgtgcca

SEQ ID NO: 709787 - DNA, 710 bp, Homo sapiens
gagaggctgatttaatctagtgaacatttcttttaggcagcagtaaagcccagacagtaatcctttctttattctcgatagtctgccggaacactcctctgtgcccagtagcagagcttccttcctggactgctggagaaatggatacattcttaaattttgcagatgacataatcttgggcctgtgcaggtgattcagtgacagttatctttcgttcatctgttggtctgcatgggaagatttagaggctcccttagtttctttagtggaacctcatcaacttatttgtaaattcttttttttttttttttttctccgttttgtgagacggagtcctcgctcgtgtccacccgaggcttggagttgcaggtggcacgatctgggcctcccgtgcaacctccgcctcccgggtccaagcaaattctccgtgcctcagcctccgtaagttagcgtgggcatacaccgcgtatgcagcaccacacccggctaattttggaacttttaagtagagacagggtttcaccagtgttgtggtaaggcgtgtcctgtaaactccgtgaaccttgttgatcccaccgtgccgtgggcttcccaaaggtgcgtgggatataccgcgtgttgacccattagtgcccggccctttgtcaattaattacattataaaatacctataggtcagtaaactcatataaatgagtaactaactcac

SEQ ID NO: 709788 - DNA, 305 bp, Homo sapiens
acatgacagggcatatgtcttttcgggatactggtgtcaatttatatatatatatatatataaatgggtattatatatgtatattatatataatatgtatttgatatatatgtatattatatataatatgtatttgatatgtatgtatattatatatataatatgtatttgatatatatgtatattatatataatatgtatttgatatatatgtatattatatatataatatgtatttgatatatatgtatattatatatatagaagtggcattgctatatctatatggcaattctatttgttgt

SEQ ID NO: 709789 - DNA, 85 bp, Homo sapiens
  misc_feature (2)..(2): n is a, c, g, or t
  misc_feature (9)..(9): n is a, c, g, or t
cncccagcnaccccctcctgccagtggccctgagctgagaagacagatctgctatctacagatcagagcacaggaggcagtgatg

SEQ ID NO: 709790 - DNA, 242 bp, Homo sapiens
aatcgactcggtacccactcggataccgtgtcatgatctcgggacgctcctcccatgcctattcgaaaaaggcatggaatcgattgccagcgagaatatttgttatcccgctaagctcaacaacggtcacgttgaggaccttgtgcagcgtggggtgaaacggatttttgatccctgtatccgctatgagcaggtcagcgtggccgacgccgacgcgcacttcaactgcccggtggttgcct

SEQ ID NO: 709791 - DNA, 754 bp, Homo sapiens
aaaaaaatttaaccaattttattgaaacgaatttcactgtgtaaaagttggtttgattcaaacatatatcttgaatctacaacttctctacatgtttgaatcaaaccaacttttacacagtgaaatgtagattcaagatatatgatttctctatggaaataaaaatatttgttagtgaatggttgagttttgattcctctaacttctcagaatgattctttagaattctataattcatagcaattttgacaagtaagattgcaaaatagaaatatctataaagattccacagtttgacattatggcttgctatgcagatgtgaaaataggttaaataatatgaaagatatggcagaatgtaaagtggaaaagatgacctaaacattttgagttgtattcaactcagttaaaaacattgtgtcagatgacagggtgggcttttactgtcaagacatgaatacgaactgatctggctgcctgatgagtgtttccacgcagcctgcatattgtagtgaccaaggcatcaaggacatcccgaaactggaaattcatatccatctggttatgacatactatcaactcagctgggcatatgaaatgtgtagtgagatattcacaggtaataaaaacacttaacgacaggcaaacattacacttagtggaatacgaaaacgttagggggtacagaagacagttggaccttgctgtccactatttattgaatgccctggatcagcatagcaatatcacatag

SEQ ID NO: 709792 - DNA, 322 bp, Homo sapiens
  misc_feature (26)..(26): n is a, c, g, or t
  misc_feature (28)..(29): n is a, c, g, or t
  misc_feature (34)..(34): n is a, c, g, or t
  misc_feature (231)..(231): n is a, c, g, or t
catttgctggctgcacatccgccggngnntcgtncgagcccacctgcctctggaggaaacagccagatgtatcagaggtcagtctgttcaacaactgggaccccaggccttctgtatgttcagcaaagagagctcgcagtgacctccccaaaggatggctccgtctccattttgggttctgataatgccactacttgtcacattggggtcctgttgcacacaggttatggngccacctgcttgacacattgtgatggaaccgacaccaaagctggggtccccttgatcatgaactccataaagtctttttccgactgcgctc

SEQ ID NO: 709793 - DNA, 550 bp, Homo sapiens
  misc_feature (78)..(78): n is a, c, g, or t
  misc_feature (84)..(84): n is a, c, g, or t
  misc_feature (102)..(102): n is a, c, g, or t
  misc_feature (114)..(114): n is a, c, g, or t
  misc_feature (226)..(226): n is a, c, g, or t
  misc_feature (409)..(409): n is a, c, g, or t
gccaagatggaggatcgctgagcccagaatttgagaccagcctgggcaacatagaggaccccatctctctctctcttnttttgnttttcttcaagagcattngtgagacaacgngtaaaagatacgaactttacattagataataatagtgtgttattgttaaatttcctaatgtgataattgaactgtagtttgtttttagaaaataacccattgaagtatttgnagaaaggacatgatgtctacaacctattatcaaatggttaaaaaattaataatagggccaggcacggtggctcacacctgtaattccagcactttgggaggccaaggtgggcagatcacgaggtcaagagtttgagaccagcctggccagcatggagaaaccccatctctattaaaaatacanaaattcgccgggaacggtggcatgtgcctttagtcccagctacttgggaggctgaggcaggagaattgcttcaacctggcaggcagaggttgcagtgatccgagatcgcaccactgcactccagcctgggtgacagagcga

SEQ ID NO: 709794 - DNA, 486 bp, Homo sapiens
  misc_feature (14)..(14): n is a, c, g, or t
  misc_feature (223)..(223): n is a, c, g, or t
  misc_feature (255)..(255): n is a, c, g, or t
  misc_feature (333)..(333): n is a, c, g, or t
  misc_feature (349)..(349): n is a, c, g, or t
  misc_feature (373)..(373): n is a, c, g, or t
  misc_feature (379)..(379): n is a, c, g, or t
  misc_feature (421)..(421): n is a, c, g, or t
  misc_feature (465)..(465): n is a, c, g, or t
ctggagcgactgantgacaggtaccccaagaagctagtgcagacttattcagtgtttccctaccaggacgagatgagcgacgtagtggttcagccctacaattcactcctgacactcaagaggctgacgcagaacgcagattgtttggtggtgctggacaacacagccctgaaccggattgccacagaccgcctgcacatccagaacccgtccttctcccagntcaaccagctggtgtccaccatccatgtcggncagcaccaccaccctgcgcttaccccggcttacatggaacaatggacctcatcgggccttcatcggcctcgtttcatntcccacccccaagggntccaatttccttcatggaaccggnttacancccggttcaattacagaccagtcaagtgggccagcgtgaggnaggaccaaggttcctgggatgttcatgaaggcggctgctgcagnccaaggaacgtgattggttgt

SEQ ID NO: 709795 - DNA, 335 bp, Homo sapiens
acagagtctcgctccgtcacccaggctggagtgcagtggcgcgacattcgcccactgccagctccacctcccgcgtcacgccattctcctgcctcagcctcccgagcagccgggaccacaggcattcgacaccacgcttggccaatttttttgtattttttttttttttttagtagagacggggtttcaccgtgctagccaggatggtctcaatctcctgacctagtgatcctcccatcttggcctcccaaagtgctgggattacaggcgtgagccactgcgcccagcctacagacacaacttctaaggccaccaaagagaactgacgggaaaaa

SEQ ID NO: 709796 - DNA, 489 bp, Homo sapiens
tcggcacgaagggaagaatgaatcaacaaacttgaaactaaatccatggagattatccagtttcaggaatagaaagaaaaatgaataaagcctaagagacctctgggacaccatcaagcatagcaacatactctaatagaagtcctggaaggagaaagagagacgataaagagaaaggagcagaaaaaaaaaatatttgtagaaatcgaccaggcatggtggcttacacctgtaatcccagcactttggaaggcaaaggtgggcagatcgcttgagcccaggagttcaagaccagtctgggcaacatggccaaaacctgtctctaccaaaaatacgaaaaattagccggatgtgatggcacatgcctgtggtcctagctactcaggaagctgaggtgggagaattgcttgagcctgggaggtggaggctgcagtgagccaagatcatgccgctacatgatgggtgacagagtgagaccctgtcttcaaa

SEQ ID NO: 709797 - DNA, 123 bp, Homo sapiens
tataacttaattcattggaatcataattttcaatttggtgaatcagagttgctttttaagataccagcactttggtgctgagtagcttacggggtcctctgcacacctccttgcaggtgaaag

SEQ ID NO: 709798 - DNA, 439 bp, Homo sapiens
ttaaactaatttaatacactattgagctttctgggctgaatttttaaatttttttcttacatttgatcacttcctaatccaaaaattgtagcactacataggacatttaattctattactaaataggctccaaattacattatacagttcagaaaccatttcaatgaatggatttacaaaaaaaaaaaaaaactgtcctttcaaatgaaatgcaatataaaatactaatacacttttcttccaaaagtggaaatgcttaagtacccctatacgaggaaaaaaaaaaatcgggcgggataattcaattccacaatgcataatacaacagttttaaggcccttattgatgacagcttcgataaaaactattaacaaggggttccaagcaccaaaatagatgtacagtatgagcaccgacttttctttatataaaattttaa

SEQ ID NO: 709799 - DNA, 153 bp, Homo sapiens
  misc_feature (12)..(14): n is a, c, g, or t
  misc_feature (72)..(72): n is a, c, g, or t
  misc_feature (131)..(132): n is a, c, g, or t
  misc_feature (136)..(137): n is a, c, g, or t
ccttggttgttnnngttcattctgaatccttggttctctttatactcaccaggtacaaattactggtatgtnttataagccgcagctactgtacacagcctatctgatataatcttgttctgctgatttgnncttnnaaatattaaaacgact

SEQ ID NO: 709800 - DNA, 788 bp, Homo sapiens
ggctgagttgggaggatgctctgtacccaggagttcaaggctgcagtgagctacgatagtgccactgcactcctggctggacaacagaatgagaccctatctcttaccaaaaaaaaaaaaagggttcaacatttctcaaaatttcactgaggctttccaattggccacctggaaccctggatattttattcttattttttcggagactattagtcctcaattggtgttggcccaggttgggacagaagtgggttgtggacgccaaggtattggccctattggtccttcccatccgggggcaacaaagagtggaaattggtctcaagaaaaaacgtttacccaatttattatacacttattgttgcctagtaattagacgctaactcacattttcaaacaactcctttccacaacgctattggttgtcccgcaacaacacttttttcccaccgtgtgttcacaaccaccttgcaaccaactttacgggcataatttttcaacacactacgctcacactttctattcaaccttgggctggcatactggacaaaaatagtgcccctttaaactaacgcggtgtagataccccatttagaacttctggctgacctttgggggggaggcctgccatacttctggactggactaccttggtgaacttcacctaccttgaaccttatacccgggcttccatcgaactcctccaagggcttcattggggcggcacattatcatttaaccatccagaaggatgggccaccaagcttgggggccaccttctcccagtg

SEQ ID NO: 709801 - DNA, 859 bp, Homo sapiens
ggtggaggttacagtgaggtgagttcaggccactgcacttcagcctgggcaacagagtgagatttgtatcgaaaaaaaaaaaaaaaaaaaaaaacggggggcgggcaggggaggcaaattagggcttggacaaagctgcctcagtgccacttttctgcccggcctcaaatgccattccacttaggcccaccgaggccctctccagggaaaagcctagtgtttcatgtggccgagaaccaggggggttgtgccctcaaccagctgtgtctactacgggagctgcgaagacacattcgggtgtgcggcccaccccctttccccaccgcgtgtctccagggtgggggccgtggcacccctggtggccccacgctctttcctcctctttagcccccatggttcctcctggcgacattgagcccgctattgtgggaaattacggggcaacaagcgtggagacgccagtaccaggtgccccgggatggagcacccttgaggcactcacagccgtcagattggcgcaagatctgccaggtggcggggcgcatacataacagggaaccaagcaggcctagggtcctcccacgcttggccccccaaataaaaggtggggccgcgaaaaaggaggcgctgcaacgtgttatcctggccccaccctgggctccccttgttggctgggggcataccaaggtctggacaggggggagcgacagagactgggacaagacaaacgcgggtcgactagaaatcgcagaccttggaaacgcacagagcgagaggatgttgaaaccagagagttaggcccagctggggaacaaagggaaccccatccacccgatacaaaaaaagtacccccatgtgc

SEQ ID NO: 709802 - DNA, 722 bp, Homo sapiens
cgacggggtaacaagttaatttttgggggcctccaaaagctaagggaaaagcaccccagtgggcaacaagcaacaggggtcagtaaatgtttatgactcaacaaattgccacagtctaagctgggctggggggaccatgctgccaagggtggggtgccaagagagagcaaattgaacccgggccccaaaggaagggggggcccaaaatagggagtgggggtaaagaggggggagttaaaatccagatggaaaagctacaatcgcccccagggtagcggatctaatgggcaagggctgggccaaggggttttttcccaaaacccaccaggaagtgggggttaaacttcacccctccttttacggggtgaacataaacctgcaaatcacagagccttccgtgaggagatcaggggaaaattggttggcccaggccctgtacaacagacggttgatagagaggcccttcccaaccagggttgagctggataatttggagggccccaaagccccgcggtttcctttgaaccaataggggcttttggcgggacactttaagatcttcgtccctcacgagtttggacaggggcctccctataacatggcttgcttccggggaaaaattttccttggaaggcgcgggttttgggggcgaagaaatgttaaactggcctaaaggcccccacgcaccccctttcttaaagaaaagaaagcccccctccgct

SEQ ID NO: 709803 - DNA, 1059 bp, Homo sapiens
ggtgtgcctactgaagatcctgatgtcgacatgggtccgccgcgccgcccgttgttaccggtatagtaagaacaagccgtacccaaagtctcgcttctgccgaggctgtgcctgatgccaatgattcgcatcttctggacctggggcggatgcatggccaaacagtggcatgagtttccggcgtttgtggcctacatgggtgtcgagatgaatatgacgcagcgtgtccgtctgaagccctggaggctgaccgaatttgtgctcaataagtacagtggtaaagaagttgtggtcaatggatggcttccatagtccggcgtgacgagctccacccgcgttccacggtcactccgacattcaacaagcatgttgtcctagtgctggggcttgatcagcgctccaaatcgaggtcagtgcgagagtgacctgttgtgaaatgccccatgggcgactgtaggccagaggttcacattgcggcaaagttatcatgtccatccgacaccaaagctagcacgaacaatggagcatgtgattgaggccctgcgcagggccagcgttcaacctttcctggccgccagaagatccgatatctcaaagaagtggggcgttcaccaagttcaatgctgatgaaatttgaatgacatggtggctgaaaagcggtcatcccagatggctgtgggagtcaagtgcatccccaatacgtgggccctctggtacaaagtggcgggcccttgcagctcatgagtgggcttccaattgtagcttgacaccccctcttaactactcacccaattaacagttctagctttctgtccatgctaaggacaagaagcataggaggaccatatcaatagacaagccctgagggacccctataaagccctgaggtcggggaaaaataggtcacccaaagcatcgagagtcatggtcgtagaaaagaggacttacacggcgcaaagtggctcatagcaattagacgtggatcaaagtgcgtgccgatacccttataggcagcgcacgagagtccttgtggataacgcctgtatcgcacgcttatac

SEQ ID NO: 709804 - DNA, 101 bp, Homo sapiens
cttatcggtacctgactaccatgctttaccagccttttggtgtgtttccagatctacaaggattctcttaatatttccaagtgggtagtcacagactgggt

SEQ ID NO: 709805 - DNA, 145 bp, Homo sapiens
  misc_feature (27)..(27): n is a, c, g, or t
  misc_feature (74)..(74): n is a, c, g, or t
  misc_feature (123)..(123): n is a, c, g, or t
ggaaggttcccgcagatagagtctgcntcccctgcccccttcttttctggattcctcgctgcccaccctcattntcccggtggaagcctcgcaacgaagggccggagccgcctttttgctccnggaatgcttcacctgtccgaag

SEQ ID NO: 709806 - DNA, 232 bp, Homo sapiens
tatctcgatgtcctgtctacaacagactgaaaaatgtctgagtaaagagagggcaggaacagctagagggcttcgacatggatgactctgacgctaggctgataaaagatatcatattactgcaccaggattcaaccaagagcgactgaggtcagtatgtgctcagcactctctccagattttcatggtaggaactcttgttcttcactcaagatgagacaccagaggctca

SEQ ID NO: 709807 - DNA, 121 bp, Homo sapiens
cgtacgcataaggtatcttcagtctcccccgcactgcatgcagaacccatgatgccccaacccattggcctgggccagcttgcactgcctgactgcgcctcgtgtcactggagccaatctt

SEQ ID NO: 709808 - DNA, 235 bp, Homo sapiens
tcgctctagacggatcccccatgtcgggatcactggtctcgaagctccgtgactcatgatccgccacctcggcctcccagggtgctgggattgcaggtatgagccaccaccgctcagccatgaacaggttctttccagttttgtgagatgccagtataacccatttgaattaattacacctacataaagacgcaacagaggcagtccataaagggtcagttcagcacagtcttta

SEQ ID NO: 709809 - DNA, 98 bp, Homo sapiens
tcaagcttctaacggatgtacggggacatgttttattatttaaaatcattgtcttaaatttttgttcaaaaaataaaaatttgaatacaatctaaaaa

SEQ ID NO: 709810 - DNA, 379 bp, Homo sapiens
gctcgactgtaaaggcatggaagtggcggctaccgtgggcggtggcggtggtgccaaggcgccggatgaagtgattgccaaacattgcaacgcctgccacggcaccggcttgctgggttcgccgaaaatcgggacgccgcagcctaggaaagatcgcgccgatcaccaaggcggcctcagtggcctgctggcaatggccatcaccggccttaatgcgatgccgccaaaaggcacctgcgccgattgctccgatgacgagctcaaaggtgcgatcgatgaaatgtccgggttgaaataagaccgatcgtctctgaaaaaaccgcttacgagcgtttttggttcgacgccgccggcaattttagttaggtagtaattcaac

SEQ ID NO: 709811 - DNA, 114 bp, Homo sapiens
acgtggacattatggatgtggactttgggtgagaacgctccaggcgcaagtgcaggcggccagatgggacatcctccagggtcagccactcatcaaggaagccactgtttaaga

SEQ ID NO: 709812 - DNA, 468 bp, Homo sapiens
aaaggtagagagtggtctcgctggggaggggaggcaggcagaggctgtccagctcactcgcatttgttctttccttgattctgttgtcacaggttgtccattaatctcctgaagcacccactcttgctctatcttcttggcagccgagaggttaagaaagcccctccatgtggcagactcctttagatcagatcctttagctgccggtccccacctaaatgaccccccccaaccttttcctggtgctccctgagtgcagaagcagtgggggaataagagtgcctcagcccacgattgctggacgtcaggactcacctccatcttaagagaacggtcagctccgaaattcggagactttgtgtccagattcctcaagctgtgtcaggaagtcttgtcttttcagttaagaggaaaccgggtcttcctgcatgggttctaataaagtctttgatctatttaaaaaaaaaa

SEQ ID NO: 709813 - DNA, 924 bp, Homo sapiens
  misc_feature (296)..(296): n is a, c, g, or t
ctgagttctcggtgaaggtatttcatttctcctgtcccctcccctccccaccccatctattaatattatcttttgaagattcttcgttgtcaagccgcaaagtggagggagtgcgattgcagaagggggtgctactcgttcagtgctacttcgggcggaggaggaagtaggggtgcacctcagtatatcccaagactgctggaaagcgagtgcctggggaaaacccagggcaaaacgctcagaaatggattcctgcacgaagcactagacgagatgacaactccgcagcaaacaantccgcaaacgaaacaagaacgacatgatgcaacttcaggaaagtaagaggcatactaaataggcttaactcctgcaaaagtgtgacaagctatgccttgcagcatccatcaatgtgggtgtagagactaaactcatccttaaaggggtcatactgctgatgtggacccaagccctagaagagccaaagtatagcatcactgatgctcagctatgtctgcgatggaacaagatgcaccaccaacctgatggcccagcaggcgagggtcaaacgaggacagaagcaaagcacaaaataccagagcatcacaataccaaaataccaaagaaaagaaaccgaaccacgaatgtagacgaaggaaaacggacaagcgccgcccgaaggagagtaagcaagagcagaggcagacggagtcgggcaacaactactcagagaaacggaacgaacataagaacagaaaacatacgagaaaatgggaacaaagaaagagaaaagagacaagagagaaacaataggccgcgatcgacgctcgtctgttcactcaacaagacaaaaccgatagagagagtgagacaaacaaaacaaagagaaaacacaaatagtgacacactcgtgtttcttgcgcctat

SEQ ID NO: 709814 - DNA, 751 bp, Homo sapiens
gaggtttctatgtagaaggggaacaaaaaaaaaaatatctgaattttgaaaaaccacaaagctacaaactgaccctctttttttttgtgaaacggagtttggctctgtgtttacccaggctggagtgcagtggcgtgatcttggctcactgcaacttccgtctcccgggtttcaagtgattctcctgcctcagcctcccaagtagctgggttcataggtgcccgccaccagaacccggctaattcttcagtttaagtagagacggggtttcaccacgtgggccaggcgtggctcttaaatgaccctctaaattttaaactgggatacctggctattctggccaaaagacaatttctagagtagtttggaatggggtcggatttcccccactcccagaaactctgaagccagtgtctagcttactaaaaaaagagtggtatataatattcaagatgctgagctattccataggaaacgctgaatgctgctgtaacgtgctcttaaagtctttcgtctatgtataaatccccttctaagtgatggaacctaggggaattcccgcgaacagacgatgcgaattggttgtatagactaacgcggtagtgctagtcataacccattccggttcaggaaaaagcaggggtatgggcacactttgtaacgatcggcggcactacccttgtgttgtccccttcgatgatacatcaagttgcacataacctcagtacacgtgacacttgcccctagcagg

SEQ ID NO: 709815 - DNA, 260 bp, Homo sapiens
gaccccgtcgcaggctacctgcgcaatatcactgctgacactctggagcactggatggaacctgtcaaagtccagagcattgagagctctgaccgtcgtctttggctccctgtccccgactttgtcctctgcttcctgtcttgtgtgcccttccttgctgttggatgatgtgtctctttcttcttccgtgccttctgcctctttgtcggtggtgtctgctgctcttcctctctctcctccttgttggtctttccttttgc

SEQ ID NO: 709816 - DNA, 226 bp, Homo sapiens
ccgagatcgtgccactgcagtccagcctggacgacagagcaagactccgtctaaaaaaaaaaaaaacccaaaaaacaaaagttagccaagcttggtatcacactcttgtagtcccagttactcaggtgagaggaccatttcagcccagaaagggtggtgatgctgtggtgagctgtgatggtgccactgcattcgggcctaggcaacagagtgagaccctgtctcg

SEQ ID NO: 709817 - DNA, 1010 bp, Homo sapiens
ggtaattatgcttggacatattcatgtatatggagttagtcagctgactcacggcatttaccctaaatatcaaatctgttttcaaaaattgcacattggccaggcacggtgacccacacctgtaatccctagcactttggagaggccgaggcgggcggatcacgaggtcaggggttcaagatcagcctggtcaacatagtgaaaaccccgtctctactacaaaaatacataaaattagctgggcatggtggtgggcgccctgtatagtcccatggcatagcttgcagagcgtctcaggcaggagatatctgcgttgaaccatggcgtaggtggcatgagttgcggtgcatgccgacgtattgcgaccatttgtattccagccccgggctgacaggtgcacatgaactccatctcaagaagaatgaaataaacaaaaattgggcgtcgtatccatcgttttgacattagatttagctgttgctggccttatttagctagagattgctggggagccatcggggattctaatttggttaaccccagaagaacggaaattcagcttgtatttatttaaaacccatttagccttttacttatatctgggtagaattccagtgatcatcctaataaggtatattcagaataatttttttccttcagaatacttagaatcagatgctatagggctcctaggagccagtgtgaaattcccgtaaagatcaactttggactgttgtaccccagtttattatttaaccaaagagggccattcccaattgaattggggtctttaaactggttaggtccctaccgaaaatactgctaagggggagatcatccaatgtaaaagagctggcgcccagacgctgtaatattcctagaaggtatcggttgccggcgggtgccacatttccgggataacacacaactgtatcctcctgattgaccaagaacaaagattggcccgcatggtacaggcgaccagccccttgtcgcggctacctacgcga

SEQ ID NO: 709818 - DNA, 355 bp, Homo sapiens
cagtgtccccatcatttgggggcccctggtgctgtatctcagctggtcctactaccgaacctttgcccagggcaacgtccgacttttcacgtcatttacaccaggtaatgccagtttctttcctgacttgccctgaggatcctagagggaggagacctcagtgctttccctggcccagagtttttgaaagcccagaacccccaactacatcccaggcatttttggtgaagcctctttgtaaaaatagtcttccaaaaaagaattttgtttgactcccattttcccccccaatggatccaaaacccccccacccatcagcagaaactaaatggaatcatcgggtggcatagcaata

SEQ ID NO: 709819 - DNA, 404 bp, Homo sapiens
  misc_feature (212)..(212): n is a, c, g, or t
  misc_feature (394)..(394): n is a, c, g, or t
taaagactgtgatgacagtggggatggtgatgatggtggccatggttctctggctagaatcccgaagtccagagccctcacggtttgatgcttgaattcattttacagcaaagcatgccctggtctgaagaagtccatgcacagcctgcatttaccccacgttgtgtgaatgttcgtgtgctttgctttggaaacacgaagtgggagactgnctcagactccactggaggaatcaaacggtctggcccatccccacgttccctcctaaaatccaaaacactccgagaagcatctggctccgggagtgtccgagaagacacagggatgtgtgagtacgtcaagccactatcccaggtgtttttcctgcctctcctgagcccctgagggcaaccgnatcacccgtt

SEQ ID NO: 709820 - DNA, 858 bp, Homo sapiens
tcatgttaatcctcttcttttgtcttgctattattatgtgtttgatcatttatcatttttcatatgtgtttttatcactctagtctcattcatcttagtacagtctagtcttttatctcatttaacttttttagtattttattactaatatgtaatttttattcacctacacttctaaaacttttgtgtggtgggggaggggatgtacgtgtatatgtgtgtgtatatgtaaaacattaaaatttctaatcccctccagtacattactttagggtaagaagtgcagtagggatctaacttttctttttccttaaacggttagcgtactggtttcaatttgtaacatttactgaataggataatgatagtgttatccttttatgcaaaagccaacatgctatttataattggcaaatttatgccaagtacgaatttcattttaaaaaaagatttattatggaaaatttcaaacgtaaacaaacagtagagaaaatagggaaaatagagtgaagccccagaatccccatctctcagcttcccacagtgatcatctcgtttcatctataatttaaccacctacttcgccagattattgataaaattcctcaggatcatatcatgtcatctatagataatatgaacatatatatctaaatgaagagaactcttttaaagaaatgacaatttacattagtataccgtaagaaaatacgtttaatataggtcaatatctagtcaggggtccaaattactctgatgtattagaaaaattgtgtctgtaaattttactgggtaataagggttggttacttgaaagttggtaacaagcaagttattggaccaataaattttccagat

SEQ ID NO: 709821 - DNA, 288 bp, Homo sapiens
tgctgaggtgcctagaggatctgtgtcatcccttgtgaagggatcgtccatctctaggaatagggcagagttagaaacccccaatttatagtcaggcctcatagaagaacagaaccaacaggatggcgggagatggcagagatttgtttaacggaactggttcataggatgtggggggctggaaggtctaacatctggagggcaggccagcatcctggagacccagggaagagctggggatgcaggctggaggcagacatttcctcctcctcacgggagttcaagcct

SEQ ID NO: 709822 - DNA, 187 bp, Homo sapiens
acgaaataggcggggtggtagagcatattgagtgtctgctacggtctaagcaaagcaggggtgaataaaagggaaaggaggcatactaattagtataatgatagggaatatattggggggcatgccaagtgtgggcatcactatggtcttagcaattaatgggatatggattactaaaataagttaa

SEQ ID NO: 709823 - DNA, 155 bp, Homo sapiens
tggacaaaaaaacttaaaaattttaaaaagggaccaataaaaaaaacaaaaaaacaacctttgggcggggggggaatattaaaaaaacatttttttgggaaggggttaaaatccaaaatggttaaaaaactacaaataaacaaaaaaaagcaaaa

SEQ ID NO: 709824 - DNA, 522 bp, Homo sapiens
  misc_feature (19)..(19): n is a, c, g, or t
  misc_feature (44)..(44): n is a, c, g, or t
  misc_feature (70)..(70): n is a, c, g, or t
  misc_feature (82)..(82): n is a, c, g, or t
caaaccccagaagcctttnccaggaaaaaaaagcaaaaggttcncaccacccaagcacttgctttccttnttcatttttccntccttctgtcacccacgtagaaaattaaagatagaaaagagtttctttagccaagtttgaaaccagcctaatttacatggacttgatgttcattttatcttgggcaatacttctaagaaggaagatttttttttgactttgttaagaaaggtggctgggcacaagggctcacgcctgtaatctcagcactttgggaggccaaggcaggcatatcacttgagccgaggcggacgtttttgagatcagcctgggcaacatggtgaaacctcgtctctactaaaaatataaaaattagcagggcatggtggtgcatgccagtaattccagctacttgggaggttgaggcaggagaatcccttgaacctgggaggtacaggttgcagtgagcccagatagccccactgcactccagcctgggtgacagagggagactccatctc

SEQ ID NO: 709825 - DNA, 915 bp, Homo sapiens
  misc_feature (629)..(629): n is a, c, g, or t
aaagagtatctcacaagtgccctgacttgttttcttcacataggtcactttcatacaatggaagtcctgtctcgtattcttcaatttacattagatatacctatcgtacatcaagtcatcgtcaaccacatatgtaactgatctctgatggaacgacaacccagctcgtaccggcaggctgtctcgtcgttgtgcgcgttactcttcatggcactgtctaactctgtttgggattggttgacgcgattgctatccatttagatagagattctcgagacactgcactatagagattaagaagcctatgctcagaaatatacagcggaagaagatggacaaaccagaaagaaaataactctatatatcccggagccaattcacactgtactgcttgttctatggctgtaatataagctctgagttctgatgactgatcaaagcgtgagtctcgcgattatgctaatgtggagtatgggcctatggaataaagagggcgccacgagggatgggaacaggattagctctaattctcttctctgccttctcgtgtggggtccctccaatgcacactatgaatctagatgtaaatctttcctctcccgggcctgatctgggagtgtactgtcgtntagataccaaatgcgcttttggtcgcacccctagggtataggtcacagggagagttcatctattgtcttgcgtgtgagcgcttggtttcttaaaccagatagaaagagcaccaaaatagaaggggtcgcggagggaacgccacataagaattgtgtgatctccttgcggacgccgtggtctcgaacccttggtctcgcccacgtggtccctcgcatcgtgtgaatgctttcggtgcccgaacttgggttgggcccccctgaaccccttggggcatccctctataag

SEQ ID NO: 709826 - DNA, 675 bp, Homo sapiens
ccagaggcagcatgcccaggtggtgctagtgggtgagctttgctgattccgatatagtgcccccgatgccagtacctgggtgtgccccatcgcttgggcatctatgcaccacaacgaaacaggccactgtaggaatgcaaaggaggaagtgagagtcggaattcgtggggtctgctggatgcttacgttgataggacgaggacttttctggttgggcgaacgagtgacattaggctgacgatcgagaggttgtctgcaccctgtggtggcgtctataagcgagggttctagagcgcttctttccgccaggacctttcgcgcaataccgcgaaccgctggttcctcagctgctgttaaccgagcgcccagttccggggctggtgctcttgctgggacatgctgtagagaactgctgtgagtaacgactggacccaggtgttggatcgctcacagagagagtctcgcgagatgacccgatagcgttaacatagggcacacacgcgacggacagagaagggttcacgggagagagaagcaggaagccccaggctgcagcggaagtgaggagacaaaaggcggttgtcctcgtgctcctgtaggaggagatggctgaatgtgagcaggcggctggctgctgagcccagtgccaagggagcccttcgctcatctgccaag

SEQ ID NO: 709827 - DNA, 762 bp, Homo sapiens
  misc_feature (38)..(38): n is a, c, g, or t
  misc_feature (73)..(75): n is a, c, g, or t
  misc_feature (79)..(79): n is a, c, g, or t
  misc_feature (81)..(85): n is a, c, g, or t
  misc_feature (101)..(101): n is a, c, g, or t
  misc_feature (138)..(140): n is a, c, g, or t
  misc_feature (144)..(144): n is a, c, g, or t
  misc_feature (148)..(148): n is a, c, g, or t
  misc_feature (160)..(160): n is a, c, g, or t
  misc_feature (169)..(169): n is a, c, g, or t
  misc_feature (182)..(183): n is a, c, g, or t
  misc_feature (214)..(214): n is a, c, g, or t
  misc_feature (220)..(221): n is a, c, g, or t
  misc_feature (227)..(227): n is a, c, g, or t
  misc_feature (236)..(236): n is a, c, g, or t
  misc_feature (243)..(243): n is a, c, g, or t
  misc_feature (247)..(248): n is a, c, g, or t
  misc_feature (250)..(250): n is a, c, g, or t
  misc_feature (252)..(252): n is a, c, g, or t
  misc_feature (261)..(261): n is a, c, g, or t
  misc_feature (267)..(267): n is a, c, g, or t
  misc_feature (274)..(274): n is a, c, g, or t
  misc_feature (283)..(283): n is a, c, g, or t
  misc_feature (285)..(285): n is a, c, g, or t
  misc_feature (295)..(295): n is a, c, g, or t
  misc_feature (308)..(308): n is a, c, g, or t
  misc_feature (312)..(313): n is a, c, g, or t
  misc_feature (319)..(319): n is a, c, g, or t
  misc_feature (321)..(321): n is a, c, g, or t
  misc_feature (323)..(324): n is a, c, g, or t
  misc_feature (327)..(330): n is a, c, g, or t
  misc_feature (362)..(362): n is a, c, g, or t
  misc_feature (364)..(364): n is a, c, g, or t
  misc_feature (367)..(367): n is a, c, g, or t
  misc_feature (370)..(370): n is a, c, g, or t
  misc_feature (404)..(404): n is a, c, g, or t
  misc_feature (406)..(408): n is a, c, g, or t
  misc_feature (417)..(417): n is a, c, g, or t
  misc_feature (419)..(422): n is a, c, g, or t
  misc_feature (431)..(432): n is a, c, g, or t
  misc_feature (442)..(442): n is a, c, g, or t
  misc_feature (452)..(452): n is a, c, g, or t
  misc_feature (468)..(468): n is a, c, g, or t
  misc_feature (579)..(580): n is a, c, g, or t
  misc_feature (604)..(604): n is a, c, g, or t
  misc_feature (617)..(617): n is a, c, g, or t
  misc_feature (732)..(732): n is a, c, g, or t
ttttatttttttttttatctaaaacaaaattaaaatanaaaaaaataaaatatattcaaggatactgcgttcnnntttntnnnnnccctccccggagtagnccgtccccccagaacaagactgaaggaaaatcgccgnnnccangacncccacagcaggncagccacangctggcacgcggnntccccgtgtctgtcacaacagactgctaatncgaggnncccagnccctgagcntcgtagntatnncnanccctttttnactgtngctactnacttttttntnctggttactnttccgttcacctnatcnnttatanangnnttnnnnttttttcaggttttttttctccagatgcctcngnttnttncctcctcacccctgccactcgaggacctccaggngnnntcacctganannnnccccgcttnntccctgggcnggtgcaaccnaaaacctgcaggtttnatccaggactccaggccctgagaaaggcagagctggctgagctcccccaggactccaggccctgagagaggcagagctggctgggctccggggccagggccctctgttgtnncaggtcccaagctggctttccagngcatcacagcccnaagccctgccccgtgggacagacccaggcacctgtgcctcagccaccctgctccgccctcactgtgtgtggcaacccttaccacaactgtctccatgggcaggttcaggtttcancctcgctccccagaggctcacgctcggact

SEQ ID NO: 709828 - DNA, 400 bp, Homo sapiens
ccgcttgttctttagagatattttttgcttatacaaatataaagaagcaaacgacagtcagctgtgatcctgcctgagacacccatctctgtgtagcctgttgacttccagtgacctggtggcttatgcctgtaatcccagcactttgggaggctgaggtgggagaatcacttgagccccaggagcttgagaccagcctgggaaacatggcaaaaccccatctctacaaaaaatataaaaattagccaggagtagtggcttgcacctctggtcccagctactggggaggctgaggtgggaggatcacctgggcccaggaaatggaggctgcagtgagtcatgattgcgccactgcactccggcctgggcaacagagtgagactctgtctcaaaaaaaaaa

SEQ ID NO: 709829 - DNA, 789 bp, Homo sapiens
agcgggtacgtgtgttaaaattcgtaaaaatgtataccaagaaacatatccattttggccgggcgtcgtggcttatcgtcctgtaatcccaagcactttgggaggccgaggacgggtggatcacgaggtcatgaagttcaagaccatgcctggtcaagaaggaatgactgggactagagtttgtgcaggctcctatttaccaagaaagtgaacatagaagttggacgaccgctgtcaatcttgcctggacagcaggaaacagtaacacgcgcttcggaatagcagccagagtatcagattgaccctgactgcctgcgttctcggctaaagtgaacaagctccagcctgataggtttaggatacactcagactctaaagccaggtgattaaactgacgactgtcagctcttctggatggcgaagaacgtcgatgctggtggcctacaagcttggtctaggactggcaatgtcaagcatacatgaatactgtacaatctgtttaactggtaaactgattttgcagcatagctaccttcagaatttaggtgtaatcttggaacgtggtatgtcgtgggatgcaagtattgctaagatatgttagccctccaggcttaaagtgattcagctttaagatgttaccccttccagaggtacagaagaaaacctatttccaaaaacaggtgcctttcagtggatagactccggggagaacttggtggcccctttgcagatgccaggttttctttgatctagaaaatggcttgcaggttggaaagcggataaatactg

SEQ ID NO: 709830 - DNA, 106 bp, Homo sapiens
tctgcacatccgcctgcttggagtggcgtctccaggcctgagtccaggatgcttgccgctgtgcaggataaggaagagggcgtggactgcgcagtgcctcacgccc

SEQ ID NO: 709831 - DNA, 343 bp, Homo sapiens
aactcctgaccttgtgatctgcccacctcagcctaggagttaagagaccagcctgggcaacatagactccacacaaaaaatttttttaattagctgggtgtggtggcatgcacctatagtcccagccacatgggaggctaaggtgaaaggatcatttgagcccaggaagatttaaagcggcagttgttgtggtgattgtgcccccgcgctttaagcttgggcaagaaggtaaacctgttttttgccaacaacgacacaaaccacccaaaggcgctatttctttttggtggggacaccagccataaagggggtgtctcctctgccccacaaagggcgacaaatt

SEQ ID NO: 709832 - DNA, 240 bp, Homo sapiens
caaagtaaaagtaaagatgcaggaaaaatgaatggctgggtatacattacttcatgtatatcaagcacagcagtaaaacaaaaacccacgtatttaacttttttttaggattttggctttggtgattttttttttttggatactggcctaacatgcttgtgctgtaaaattagttaccaggaaaatacctggagaggagggctagcttggttaaaggtcttatgaaatttccaggaacaa

SEQ ID NO: 709833 - DNA, 300 bp, Homo sapiens
gcaatggcacgatctcggctcaccgcaacctccgcctcctgggtttaagcaattcttgtgcctcagcctcccgagtagctgggattacaagtgtgtgccaccactcccggctaatttttgtatttttggtagagactggttttggccatgttggtcaggctggtctcgaactcctggcctcaagagatctgcctgccttggcctcccaaagtgctgtgattatgggcatgagccaccatgcccagccatagagagctcttaaaagcccagcaggaaaccttctgttctcagtcctcagct

SEQ ID NO: 709834 - DNA, 123 bp, Homo sapiens
gaaccggcccggactacgtaaacactgtgtggttttgggcataggtccatttgcttagatgcattcagtggaacagctttgctaggttccatgtcattcaatttatcattttcactttgggct

SEQ ID NO: 709835 - DNA, 222 bp, Homo sapiens
aggatcccggtggacagcgacgtgcagatcatctggactttggtgttgacttctctcacgcacggacggcgtgggttcgggggttgccctcgtggccggagatcctgtcgcacgggtcacctccttctgccccagcttggtcacctccccaccggagtttatcagaaggttgttcctcagatccctgtgaagagtgttggtccccatgtggcaggggtcctc

SEQ ID NO: 709836 - DNA, 471 bp, Homo sapiens
ccttctggactgggaacaacctggcgtgagctccatacacttctttttcttttgctttttcttttttttttgccacggagtctcactctgtcacccaggttggagtgcagcggtgcaatctcagctcactgccacctccgcctccccggcccaagcgattctcccgcctcagcctcccgagtagccgggactacaggtgcccaccaccacacctggccaattttggtatttttattagagacgaggtctcaccatgttggccaggctggtctcgaactcctgaccccaggtgacccgcccgcctcggcctcccaaagcgctggaattgcaggagtgagccattgtgcccagcctcttttcttaataaattaacacataataataataaccgcggcagacagcttcactgttcatcgctagtccctagtacccatcacaaagacgggcacatattcggtgctcagtaaatat

SEQ ID NO: 709837 - DNA, 846 bp, Homo sapiens
acaccacagataataagtcctcatcgatttagtaccgaaccactataatttttcatataacccatcatgccacagttctaaattagcgtgtacctagcatcggaacagtagtgaaataaatgatttacaaagagatatttacatccatctggtttacacttaatatgcacaacgcaccacgaccttcccagggtgacaccgtcttagtctgcagcggggctggtactaatcaacgcgggcgctgtccccgcacgcagtctgggctggaactggagtctgacttctagcttgatcagagctcctgatgtatgttttcagaaatggcttgaagtgttgtgtcaaaatctgatcatccatatgctaggctacccatatgtattacaactaccgaactttctaaagaaaaaacgagagatatgtaattaaactccttcccttccgtactctctaccccaaaatactgtatctacacctatatctatacctttaacagtcattctccctattgtgattctttctcatttttcttccttattctaaatgtaaccctctttactcttctttcctcttaagtaaaattttattatatctttctgtcttctgattattgtttccctcccacaagttctgttacgtatgttaacccttttacgttttctttgtttgtctttatcgcccaccagcattccacctttattcacctatctgtcagtcgctcgcctcatacaccctccccatactttgccaattatattaattgtcctacattgacgtcccgattaagattttaatgacattaatactaacgcagaaataatcgcttagtcattataatatacatataat

SEQ ID NO: 709838 - DNA, 552 bp, Homo sapiens
cgcgagcgcgatgccgctgccgcccgcgccgagcgaaatgtcagacagcaccagttccaccgggccgtgctcggccagccagttcaacgcggcgtcgccgtcgggcactgcatcggcccgcgcgccgagcgccgcgaactggctgaccaccgtgtcgcgcacctcggcatcgtcgtcgaccaccagcacgcgcgcgcccgggcgcaccgccgcaggcaggccgcgcacggcgtcaggccggccggccggcgccgcgcaggccggcaaccgaagctcgacgcgcgtgccgcggccgacctcgctgtgaatccgcagatcgccgccgctttgccgtacgaacccgtacacgctgctgagcccgagcccgctgccttcgccggccgccttggtggtgaagaacggttcgatcaccttgtcgagcagcacgggcgcgatgccgcacccggtatccgtcacgctcagcacgatcgtcgacgggccgcccgatgcgtccggcgccggctcgcgtcgcgcggacagcgtgagcgtcccgccttccggcatcgcggccgc

SEQ ID NO: 709839 - DNA, 308 bp, Homo sapiens
acggcttctctaggagtgatatgaagcagcgccagggtcctttgagtttgcagactgtgagtcgtgagtgttctggcagagcagtttttgttgattttactgtatgaggttataggtgctaagcatcgtgaggtatctcatgccagttcgggtcttagctattgtgtgttcagatatgttaaagccagttctcgtagttcctgtgtctgtgtcagctggggtttttacaactccggtgagttttctgctttatcagcggagggggtgatctacaagtattctttacgcctggttctattgacttgggt

SEQ ID NO: 709840 - DNA, 794 bp, Homo sapiens
gacgggggcggacgtggccgatgtcccaccccctctgcctctcaaaggcagcgtgcagattacgggaattgatggaaaaccaggacttgctgggctcgccaacgacctccaactccccctccgaaccagaggcatctggccactcctatgcccagcaaaaactccgcctcctccccctccaaagacaattcgcaagcagaccatcggtggactctgggatcgtgcagtgacatcgcagggtcttctggaaagagtgtgtgccctccccaatctccatgccctctccttctgtgtccccctgagtctgctgtttacctcatgtgggcctgtgatgtcaccatttcgtgcgactgttttcttcacaaggagttcagttctcaccatggagtgagtggcctttagcgtcatggcgcacaggtgggtctgggcaggtagatcatgggtccgggatgtgccatcgtagttaccagagtggggggcctctgagtgttgtctggctcttgaagaagagtctgagtctgtgcccaaaacatctttctgtttgtgtggccaagtgatgtgcatttggaaagagctcaattgtctgagctcagccaagtaggagaggctaggcatcactctgtggaagctgtgtagtgatgatggttaagaattctcctcactgtcatgcgatgttgtatccagccctcttgttccagccggggggtggcaccgtaggtgaggtgggtgtcacacttacatcaaaccatggagtttaacctcccaggggagtctggattcccggtattgaacag

SEQ ID NO: 709841 - DNA, 202 bp, Homo sapiens
gcggccgcctactactactactgctcgaattcaagcttctaacgatgtacggggacatggtggcgggcacctgtaatcctagctacttgagaggctggggcaggagaatcatcacttgaatctgggaggcagaggttgcagtgagctgagatcacgccattgctctccagtctgggcaacaagggatgctccgtcccaaaaa

SEQ ID NO: 709842 - DNA, 160 bp, Homo sapiens
agcggggaagagagagagagggtacatgcaagcccgatacatgcaagacatgcacgcccggtacatgcaagagtatgggcccccgagtacatgcaagttattttgaatgatgagccttcgtgcccccccttcccccttttttgcccccggtacatgcaag

SEQ ID NO: 709843 - DNA, 361 bp, Homo sapiens
agcatccggccgagagcctcgctccacacctccatttgctggagcacaaggtcttttgcctgaacacttcctttgacctgatgcccctgtggtgctgccccacagctgctcctgctgctgctgcagccccagctaaggttgaagccaaggaagagctcgaggagtcggacgaggatatgggatttggtctctttgactaatcaccaaaaagcaaccaacttagccagttttatttgcaaaacagggaaataatcgcttactcctctacaagataacccccactgaaaaagattactttgcctgccctgtgaaccatgtgactctagaacaaagccaagaaatttaaggggggcccatacat

SEQ ID NO: 709844 - DNA, 529 bp, Homo sapiens
taatgcctgctatacatcattagggacgcttcgatctgcgctattgtgctgatcagtttttggagagccttcactgggttattcctcttgattatatcaacgagatttctttggattgtccggattggagtggagcaccgatacaggccaacatatcacggagaatgactattatactccaactggggagttccgtgtggaccgtgaaggttctccagtgctgttcaactgcctcatgtactacatgtgttactattgctttggacgggctttacacagaagccaagcgtcctccaggctttgaccgtctccgacatgcttagattgtgaagtaaagactttgagcttaatgtcctggaggaagcttataccaccgaacattggctgctcttgatattctatgtatagtaccccgataatctatgcttgtcctcgacgtgcctctcacgtccagctctcatatgcttcgcgctgatctcttcacatgtatgacgtttaagattcctaaattttccttgttttatttgcc

SEQ ID NO: 709845 - DNA, 129 bp, Homo sapiens
gaaagcacagtcagtcagggaaatatttacactgagaccacgcaccccagccctttcccaacctgctctgtcacaggatgaactccagcctcattagcctggcattcaagaaccttccatcatattccc

SEQ ID NO: 709846 - DNA, 313 bp, Homo sapiens
ccccagagaggagaggacgagtgctgctggtgcatgcgagttttcttcgcagcagcatacatgtcaacatcactgggagagcggagcacgtgctgtgcctttcgagaccgattcatctcttcccggcccttgaggctgtcagagcggcccatgcgaatctctgagcgtgaactgtcactctccagcaggtcctgaggaaagcttctggtcgagagtcgccgtgtcccaggttctggggcatgatactgctggttgctctcaaagagctgaatgatgttcctcacattgactggtttgacttccacaggggaca

SEQ ID NO: 709847 - DNA, 340 bp, Homo sapiens
ctttactgaaattttatttccccaatggtgttggaggggcaccagcaaaatccgtgcctttttttttggagtgtgtgaaagtccgtggtcctgagtatctcaccaaaatgtggcaatttatgtgatgttctgattaagaccattgggacaaaaacaaattcaaatgtcctcaaaaataatgcattgtttagcaaagtgcattgaagttatgggaaatggatcccttaataatgaaccctttgaaaaacccctttgccccatgtcctcaggcccttttgagggctgtgtcatggggcatggtccctcaaatttgacccaataaattttttcaaatatttta

SEQ ID NO: 709848 - DNA, 136 bp, Homo sapiens
atgatagactaaacatgaatgcctctccgtgtcaatgagtaacatggtggcctgggagagagctttaggacaaaggtccattaatgtatagttttcccgcccaaataaataagcatacactatattatacagtatg

SEQ ID NO: 709849 - DNA, 779 bp, Homo sapiens
cagacccatttaggttcaacgagtggttctgccactcagtagcactgagcacacgtagagtccagatcttggtttccaatcaaaggaatcagggctccttggaaagatggctgattctaaggctggggcaggaaacatgcaagatgagcctggagcttctcgtagtgacaggaagtaaggaagcactcaagtgtgccccccacccccacacacccccaccattgatggagctatgtcagaggggcgcagagacaactgcaaggcttctaatggccaatgctggaacaatgacagcaaggaataaataaagtgatatttaattataacccaaagcatactacagctgttcatgatcccatactgacataaataaattgttgaataaattaataaatggagaagaaacaaaccttccaggcagaagaattccaaataatgtatgtagatgctgcacactgagagagataaagcatagctccccactcctaagtgtgggctacacatagtcactttctgctcaagagtacaggatggaaaaaacaggaaaaaaagagtaacattccaatcacctggcaccattcaggtgatcgaggtcctcatcaacagtcataaatgggccaggcacggtggtcatgcctgtcatcccagcactttgggaggcgaggcaagcagccacttgaggcaggagttcgagaatagcctggcaacatggtgaaacccgttctataaattaaaaaattagccgagtgtggacacactgtattaagtacttgggaatg

SEQ ID NO: 709850 - DNA, 251 bp, Homo sapiens
caccctcttgcagcaggcggcattacccccattttccatgattgagggctgaggcccatgtgcggggaagagcgcgctacgtatcaggcccagatccttatgcccttgtttcccccctcccaggcccatgagtcgtctccttggtactcaccggaaacaggttgaaagtcgcaggtaaggctgagcctatgatagtgctgggagatggaggatgaaaattcgggcacatgaggctttagggtagaaggcag

SEQ ID NO: 709851 - DNA, 871 bp, Homo sapiens
  misc_feature (55)..(55): n is a, c, g, or t
  misc_feature (64)..(66): n is a, c, g, or t
  misc_feature (73)..(73): n is a, c, g, or t
  misc_feature (83)..(83): n is a, c, g, or t
  misc_feature (87)..(87): n is a, c, g, or t
  misc_feature (89)..(90): n is a, c, g, or t
  misc_feature (98)..(98): n is a, c, g, or t
  misc_feature (102)..(102): n is a, c, g, or t
  misc_feature (104)..(104): n is a, c, g, or t
  misc_feature (155)..(155): n is a, c, g, or t
  misc_feature (207)..(207): n is a, c, g, or t
  misc_feature (260)..(261): n is a, c, g, or t
  misc_feature (263)..(264): n is a, c, g, or t
  misc_feature (267)..(267): n is a, c, g, or t
  misc_feature (272)..(272): n is a, c, g, or t
  misc_feature (312)..(313): n is a, c, g, or t
  misc_feature (316)..(316): n is a, c, g, or t
  misc_feature (323)..(323): n is a, c, g, or t
  misc_feature (329)..(329): n is a, c, g, or t
  misc_feature (332)..(332): n is a, c, g, or t
  misc_feature (354)..(354): n is a, c, g, or t
  misc_feature (363)..(363): n is a, c, g, or t
  misc_feature (460)..(460): n is a, c, g, or t
  misc_feature (462)..(462): n is a, c, g, or t
  misc_feature (694)..(694): n is a, c, g, or t
  misc_feature (764)..(765): n is a, c, g, or t
  misc_feature (804)..(804): n is a, c, g, or t
  misc_feature (808)..(808): n is a, c, g, or t
atgtatgaatgtgagaagaatgaaacactacattaacagataacaagacaaatcngacggtgannncggacanagcttttgtncaangnnggcttgcnggtngnggcagggttcagcgccatggggtggccacagaggacacacaggggtcagcngaggacatgtggggtccgtggccgcgaacgctgctgaggaaaggccccagancccctggtgtatacagtccccgaaagatgacggacgatgagtgctatgtgctnntnnggntgggnggtgagcaagccattccacaggggacgcacagcctcaggnnttnggccccncgggcngcnggcagtctttctccgagttttntctgccgcnctggaaagacccgccccaggctcaacctccagtcgtcagacagaaaccaagaccctctgtcttcaccctcatgaccaaagtcagccgcctgtccgancntcctgctccactccttgctgctggctagacacctggtgtttcaaggctaagacccacctggactcctacgtccacgttaatgattttggcagaaggagggcagcgtggagtcctgcagcacaaaggtgcggtccaagaacaggaagatgcttctgatcatgatcatttgtctgcagtggtcctgccagcacgtgttaatcttctttaaaaataaaacactatctagtgagtnttctctaaacggaaggatctgtgcctggacgtggtcttcacaggcctgacgcattgccttgtagagcatnngggagactttgtaagaacagagattttccacagcctggnaganctcctcgaggttgttcctgaaggaggtgctgctctgcacggcccgcaccgcctcgtgcagctt

SEQ ID NO: 709852 - DNA, 260 bp, Homo sapiens
ttcttttggctcaataatgacgtagctcaccattgcgtttttagcaatagcaattccctgcatgcagttcttcaatacactacactaatatagttttgtaaaaagaattaacattaaacttttggttgtgcaaataaccaaaaatttatatcattgttaggtaattgcacaactttgtacttgtcaggctaaaagacaagtcatgttatattgtaatagcttagtgcagcagataaaataagctagctgactacgtaatc

SEQ ID NO: 709853 - DNA, 325 bp, Homo sapiens
cccccccttttccgggttttttaaaagggggattaaaaatgttttgcccgcccctttgaatgttttggggggggggttgaaaccttttgggttttggggcctttaattgtggagacccctggggggggggtttttggaaaaactttttgtttgttcttgaattaaaagccattttgggggggttttggttttttttggctttttaatttttcgccccccctcccccctggttttttggcccggggttttcccctggctttcccgaccggggtttggttttgggccccttccccccttttggggattaaatttttttaagggttta

SEQ ID NO: 709854 - DNA, 247 bp, Homo sapiens
gcagatcaggtgctggcagtcttatgtctggtgaaggactgacttttcataaaggcttcctcctagctgtgtctccgcatggtgagacggaaaaaacaagcgtccctcttgtgtctctctgctctctctgtctatcctgtgtctctctcccttcggtctgcacctacagtctaaatcactctggtctggcgtactcctctagagatcggacccgccggtcatgcaaggctcgggcactggcgcgtcg

SEQ ID NO: 709855 - DNA, 446 bp, Homo sapiens
tgcctaagatatctagaatttctgaaagagaatgctttgcagggtaccaggcttcctgttacatttggagaggcaggctcagtagcttcagaagagtaaaatgttttgtttacaccagaccagagctcagatctcagctctgaaagatatgggctgaaacagctaccttggaagtcacttttcagtcaaaggatgacattctggcagtctgctgcactcaagggtccatacttaggtttagaagtgactactaaagctgtaggtgcagccaaggatgggatgtggagtgagggtcttggctgacctattgatcacaaatagagggtaacgctcagcagtaaaaccctgaaatacatcaagatgtctgatttggtcatagtgtcagaattggagaaaagctaaaaactccaaggaactaaactactgtcacagtccaaaaaaaaaaa

SEQ ID NO: 709856 - DNA, 571 bp, Homo sapiens
aagtgtcactttcgaatgatcggtcggccgtgtgtaacccctgcgcccccggtaccgggggtgtctcatcaccagctatttattagcttcctgctcgtccctccgcgccccgccctggcagccccacatgttgtacatatcatcttccacccactgagaggggactacaaagcacgtggttgtttcccaccttattaaagccacacagccgggcgtgaaaaaagcccgggcggcaaccaccctaaaagcccgccccctttcgggggcaccacgttggcgaatacctcctgagaggtatgcaggagtgtcttataagcccgctccttgcccccatcggggatccccccttgtctttctgaaaaatacccaggtttacctggttggcataggtcggcgcaacaactctgtcagttgcctgtactcattcctggggagcgtgggccccccgggagaaaatcctccgtctgcggccccccgggctagccgggtaagtagtggccgccgggtggggttcccccccttcccccccccctgggcaccaacaagaggaaaccccccccccaaagaaaaa

SEQ ID NO: 709857 - DNA, 413 bp, Homo sapiens
tttcgaatcgagctcgctaccgattattcgtgttccctgcggtgtcttctgttaaaccagcctgcaatacgagaatgggccgtaaggagagagagtccctgtccgcagcatggcctggaatggtcgcccgcgcatgggttccgtctagaagagatatccttatggaggatctggaacatggcacggaaggagaatcagaacacgctctttgagctacagggtgcgaggaagtctctggaagtaccacgtggagattctgcggacggtgaaggaggaacgctgagaagccatagagagtaggccaaagagcagcaccagaagctgtgggaagagcagctggctgctgccaaggcccaacaggagcaggagctggcggctgatgccttcaaggagctggatgatgacatggacgg

SEQ ID NO: 709858 - DNA, 938 bp, Homo sapiens
  misc_feature (695)..(695): n is a, c, g, or t
gaccttgcaggcatgtcctgtatcatgtcccagagtgaaaatccgtattgcctttaggtttctcatgaaaacttggagcatgcttatgcatggtgtgggtcacgatgaccatgtctctctgccgaattgatctggctgcatctccctgtggcgaggactcactctgtcagagttctggcccggatagctctggtgtccgtcaatgagctctcactactaggaccacattgtctgaactggagagagtccctaaggagactccaataataccgttgtgggttaatctgggtagacgacaaagaatccctttcgcatgcacccgaagggaagagcactggagggatcagggcaagtgggtccttcggactagaaaagtcctgggggtcttgcatttttgcgcgctcttcaaatttcgtcgtatcgtgggtctagcaagacactcggacaaggtctgtgcacggtcgcagggctctcccaggaatctgcttcggagaggtacattcaatgccagagacacctgtgaagcatcgagtccgggtgtatccaggataatttcccactgtccttatcctactaagtctagcacctggcgtacgggaccttcgccagacgactacgtttctacaaggctgtgtcgctcgcctttgtagttacgcacatgatccatcacacggactcataagttgagctcttgncttttcgagtaagtcctaaataatgcgctctggacggttcccagtgactttacctgaagtaacccaatgtgaggcgttccaaggtcgacatgtgtcctccgtatgtggacagtgctctgaagcccttaattcaagcttaggaagcggacccacggataagtccacaagcacataatcggggggggtgcaaggactcaggaagaccctaaggctaacgggtcgggtttaaccggggcaaacgca

SEQ ID NO: 709859 - DNA, 168 bp, Homo sapiens
agaaaaaaaatttaaacattagcaggtatggtggcatgcgcccatagtcccagctactcaggaagataagaagggaggatcatttgagccaggagtttgaggctgcagtgagctgtgaccacgccactgcagtccagcctggatgatacagcaaaatcgtgtcgaatg

SEQ ID NO: 709860 - DNA, 501 bp, Homo sapiens
ttacgacgcccagacggagtaatcccagtccccgtgcacagcaacccttgccaaagtcatctgctgctccccgtggggagaggactgcggctcagtactagtcgcacagtgccaccagggagaagagaagtcatgagatgcagcgctcgcctgcctgtgtccaataccccatcttctcgctatgccctttagaagcctgccagtgtctatctcatgtaggcgtctatggatactctcttatcttgtgatcttcttcttatcgtctatgcgtctcgccctccatttgtgggttctatacagaaactgcagtttggagtgcagaaggtccgtgcactgtcatcggatgcgaagttgtctccgtgcaggggccctatcctggcatttcatcttcctacgtcgagagaggtcctgatctatggtgatgcaatctagtgttgagcctcacctgtcggtttccatgagcccggggctattttcgtcatctcagttttgctgggcccc

SEQ ID NO: 709861 - DNA, 373 bp, Homo sapiens
aacaacagagcagagaacttgcgaaatagccactcatggacgagtggaatcctgataaaaataaaaaacttgggtcacaacacaggcctctggccaggcacggtggctcatgcctgtaatccagcactttgggaagccaaggtgggtgaatcacttgaggtcaggagttcaagaccagcctggccaacacagtgaacacttgtctctattaaaaatacaaaaaattagttgggcatggtgatgcacacctgtaatcccagctactcaggaggctgaggcaggcgaatcacctgaattgaggaggcaccggttgtagtgagccatgatcacgcaactgcactccagcctgtgcgacagagcacgactccatctc

SEQ ID NO: 709862 - DNA, 143 bp, Homo sapiens
gagtacagctggggtaacgtgcactgtatgacgtatgtagcatgatgttaactttgctgtggtctaaacgtgtttacgctgtcaacgccggatgcctaagttgaccaaatctgtttattgaagtgttctgagctgtatcttga

SEQ ID NO: 709863 - DNA, 268 bp, Homo sapiens
acgtgtgtcaccagtgaatatctattggcaatactttaatcatgcccatacttcatttaacaagtataatcattagtttgtttcaatcaacaacatctcatgagctcatcacgagtcattataacctgtcattttggaaataactgggttcatgtttcaacagcatgtgtaatctcacacatatttcctagcaagaaaatcagactctgtaattagacctaatgacaagtgtaattcatgctgtagatttgtagactcaggtggtgtg

SEQ ID NO: 709864 - DNA, 148 bp, Homo sapiens
tctgtacagtcgcgatctcactctagctcgcgttgcgctcaggcgcgcacttgtcaggtagatgcagcgtcgtgagtctgatgtagctctcgtgccgtgaatctggcgcgcgaaaggacccctgtccaaatgcacggagcgccgccag

SEQ ID NO: 709865 - DNA, 431 bp, Homo sapiens
tttcactctagaggtcccctggccaggctctcttacctccacattggctattagctctgggccctagcactgggcctggttggaaactggacaatggaaatggatggagggggcaagggaggaaaagctggcggatcagttgtatctctcccttaaaataaagcggctccttgtgggctcctcttagtccttcctgggtgagcagctctgctcagactttaggcctatcagggctgaaagcaggaaggctagagggggagggagtcacgattctccaaggggtagtttagcttcaagggcggtatgtgtccggcaagtccggtcagtgtacactgagctcccatgatgtgcaagatgctggcagagggggtgggtgccctgtcagccaccaaagctggccatccccaacattgccatcccagtttttggga

SEQ ID NO: 709866 - DNA, 415 bp, Homo sapiens
  misc_feature (222)..(222): n is a, c, g, or t
ttagtatacctcatcagtgtcattcctttgtgtgatttcttaatgctgtatttgttcatctcaaacctagatgtatacagctctgagttataaatcaactgtataccgtgcatcacgtgtcattcctgttgtgtgatttcttacatgctcatatttcgttcatcgtcaacacctacgatgtatacacgctctgacgttataaactggttataacagctcctngttactcattatttagttatttacattcaaacaagcttttagacaaatggtacgaggtaaccaattcttgtcatggtgaaatctgattgagtaaccaagcagttttactactctggtgctgcttcataacaaaaatgaaaagctgcatgcatctacaggaggcacagattgcagtggaggcacagattgcagt

SEQ ID NO: 709867 - DNA, 819 bp, Homo sapiens
ggttggatgattgatgagaacattcgcccaacctttaaagaactagccaatgagttcaccaggatggcccgagacccaccacggtatctggtcataaagagagagagtgggcctggaatagcccctgggccagagccccatggtctgacaaaccaagaagctcagcaggacagtcagcagctggcagccagcacactcagacctagacctcagccttggcacagccagaggaggcacaacctggccaaaccaccacacttgggctccgcccgtcagcctaccagtatggaacactataatcggccacgtgggagccagagccttattcaagtccatcatctggatacatgcccatgaaccacagggtaatctatggggagtctatgccaggagatctgcagattctctggagacgcagatgaacggtgcaccaccgatccagtctcatctacacaccaatgccacggggatgcctggcatcagagtcatcagaggggccatgtacacaggctctgcggctgagctccaggagcaacagtgtccatgtgtagaagccggagccaggagccggagcccacggacaacgcggagatagcgccatacacatacccagcgccacagtctggatgactcctgataaccccaatctccccaaaccgggcatcagaggacagaggatgtcaaaaggaacatagtcaatggccacgaatccaccagcctcgaagggtacatccccttccttcgccgggacaggcacccactttctatcgatggggtctcagtcctggtcctgagtaatgaagaaagaggatcagactg

SEQ ID NO: 709868 - DNA, 420 bp, Homo sapiens
  misc_feature (299)..(299): n is a, c, g, or t
atattattaaggaccatctaacacgagggtgtatacgtcctgcaatactacgagtaatatcaacctcttggcctctgaatatgaggaagaatatcacagggtgggtgtacacctcgtgctctattatgcggagtcatatctgtctattatggggagtaatatcactctctccctttcaggatattaataacaatttcacaggctgggtgaacacagccggcaatgctgaaattattatcaacctctccccatcttcccctcctggctcttaggacccccatcgcaggggctgaggacancgcagaggcggggactgagtgccagcccctcttccctgagccccttcgtcagggctgagagaattttgagcgctagccgtctctcgatcgctggctaataaagaactcctgaattagtaaa

SEQ ID NO: 709869 - DNA, 350 bp, Homo sapiens
  misc_feature (64)..(64): n is a, c, g, or t
  misc_feature (269)..(269): n is a, c, g, or t
  misc_feature (285)..(285): n is a, c, g, or t
  misc_feature (334)..(334): n is a, c, g, or t
  misc_feature (343)..(343): n is a, c, g, or t
gttgatgccaagttgaagattcctagtctctggatccaaatcagagggccttctctacgtccantcatccagaggtggcccctttcagaggtggcaccttgacgagggtctttttagagctcaaggatgggtcagcagattcctgtgttcaagctcagtgggggaaaacggtggatgaagtgaaaaaggagtagagacgacccagaaagacccagcttgcttctaagtccatccttccctcatctctaccatatggccacttgggggtngttgcccatctcagtnacagacactccttgcaacccaattttccaaccaccaagttgggatgatnggtaatgtnccaacaa

SEQ ID NO: 709870 - DNA, 129 bp, Homo sapiens
gcacatgcatgcacttgccatgccctgcccttgcttggacccgctccggcgacgctccccgctcccctgtcatttcatcgcggacgtgtgctggcctgtggggttggggggctgggcctctcaccggtg

SEQ ID NO: 709871 - DNA, 568 bp, Homo sapiens
ccacgcgttcgcggacgcgtgggttacggtttgtatacggatatgaggtaactcaccatcacaaaaatgaccaaaaaacgtttctgaatgttttaaacactttagatactgtctgatatatttatgacaggattatagtcattcgttcggtattgcttcgttttaacaacatatcctttgcttattttccttataacgagttacaaacacattcattcttaaggaatacatgtccgtcttagctttactctcagtcttgagtcttcattattccacactttcgtaagcttaccttgttcagttcataccaggcctgccttacacaacagcttctggcataccagacctaacgcaacatggcctgtagtccgtaaccagtaccaacctgcaccagtaacgtacacctgacgcacacacttatggccccacctctctccttaaccatatctatccacttatgacactttctaccgcttacacacgggggcactactcaccttcgggcgcgacaaacgcgcaaacatgccactttgggacctcttcttttgcaacaccacatctcttaaac

SEQ ID NO: 709872 - DNA, 921 bp, Homo sapiens
  misc_feature (649)..(649): n is a, c, g, or t
  misc_feature (651)..(652): n is a, c, g, or t
  misc_feature (662)..(662): n is a, c, g, or t
  misc_feature (664)..(664): n is a, c, g, or t
  misc_feature (666)..(666): n is a, c, g, or t
  misc_feature (669)..(670): n is a, c, g, or t
  misc_feature (682)..(683): n is a, c, g, or t
  misc_feature (699)..(699): n is a, c, g, or t
  misc_feature (710)..(710): n is a, c, g, or t
  misc_feature (713)..(713): n is a, c, g, or t
  misc_feature (740)..(740): n is a, c, g, or t
  misc_feature (749)..(750): n is a, c, g, or t
  misc_feature (753)..(753): n is a, c, g, or t
  misc_feature (756)..(756): n is a, c, g, or t
  misc_feature (819)..(820): n is a, c, g, or t
  misc_feature (825)..(825): n is a, c, g, or t
  misc_feature (827)..(827): n is a, c, g, or t
gggcctaatagacctacagggagcgcaccccaatggccaaacgctaggcgaaaggcccttcccagtatcaggcaccgcaccgctaggtcccacgtggcgcccctgccatgggcttccccaaagagcacagtgacctggagggggagctcaaacctaggggccccgaatgtacaagaatggccgtccaaggagcctggtcaatatcgcgcgctccatgcctcgccgtcaagccgtctctaacatagacgccaggaccttgtgagcatcttctgcccttgaggcctgctccctaaatgagtagggcttacacgagggactctagcccttgacgtgtgaaaagcggagctatcaaggaacagagttatgtggaagccaccatcgggtcttccctagcctcaggcagagaagggcaggaaggagagcctggcttgcatgggctggtgtgctagaggactcgacctagaagaggaccagtcctagcctggaccacggcagattctgtgccccatgcctgtccagcctgggcagcaaggctgccaaggccagagtggcacaggccaggagctcttcaggcctccctatctctgtctgctctcacccttggccgtgctctcatccccagggggtcaccagcacacgcaccgggctntnntgcatgtacnantntanngacactagtttnnacttccttgtgaagantgatatactanttnttgttaagcgtgtactgtatttatgtngtgaggagnntgnctngcttgcagtgcgcgtgcacgtggagagctggtgcccggagattggacggcctgatgctccctnncgtancntggtccagggaagctggccgagggtcctggctcatgaggggcatctgcccctcccccaacccccacccacactttaaccagctggttgaaatag

SEQ ID NO: 709873 - DNA, 196 bp, Homo sapiens
tgatagtctagaattatacagtacggtagcattaggaatgccatatgcgataagaatgggtacaatgaggagtagccataggcggccatgacgttcaggtaaaagcaggcgggtatacggttactggcgagtagagcagctactgtctaggccaggcccctatggcactccgacctacggaatttaggggggctat

SEQ ID NO: 709874 - DNA, 449 bp, Homo sapiens
  misc_feature (8)..(8): n is a, c, g, or t
  misc_feature (40)..(40): n is a, c, g, or t
  misc_feature (74)..(74): n is a, c, g, or t
  misc_feature (79)..(79): n is a, c, g, or t
  misc_feature (119)..(119): n is a, c, g, or t
  misc_feature (131)..(131): n is a, c, g, or t
  misc_feature (142)..(142): n is a, c, g, or t
  misc_feature (157)..(157): n is a, c, g, or t
  misc_feature (185)..(185): n is a, c, g, or t
ccgtattnccatttacctcaatttctaggctaaaagagtncactggaataaaattttccaaatcaaaattcctnatagncttatttcccccagtagtctaggcattcctatgtgattantgtgtctctctnccactgttttntaagtcaaatggacntgagaagtattctgacattcatatggcntcccagatatattgctagtccagtcatagattggagtttgcatattgtaatgtaagtgtatgtccaacactattctaaatagtttatgactgaagtttaattaaataaaaggttgtaaaatgtgatgtgtatgtgtatatactgtatgtgtactttttaaaataggcctatgtcccgacccttttgatacaggtttgaacttgaaattacattatataaacatatactttattgttctaaataaagaattttatgcaccatcat

SEQ ID NO: 709875 - DNA, 449 bp, Homo sapiens
  misc_feature (355)..(355): n is a, c, g, or t
ctcttcccccttccatcggcaagcatagacttactcccttaagcccagacatctgttgagacctgacccctagtccttggttaccagtgtgtcaggccatttggactttcccgtgatgccccttagatggcccctgtccaaaaaacagtggttccctttttagattgtgggtcttcagaaaaattctgcccttttcctttcccttcctgaaaggcaggggcggcttgtgaaaaggtgtttaaccccctgcttaatgtgaaatgtccacccccccttttaactttccctgttcagagcctcaaatgaagacttccttggggtttataggggcctttttatttttgggaggcccctnaaaaagggagttttaaagttgttgtatactgtttacgattgtttgcccctgtcccgcccgaaaaaccctgattgtttatgggaaggttttttta

SEQ ID NO: 709876 - DNA, 131 bp, Homo sapiens
  misc_feature (86)..(86): n is a, c, g, or t
  misc_feature (89)..(89): n is a, c, g, or t
  misc_feature (128)..(128): n is a, c, g, or t
cccgccaacatgcttctccacttcggccgagggaacagctacaatggcttcgattagtcttttccctatacccaggggggcccacngantttgcacgtaagacgctaggacctacagagtttctctgnctt

SEQ ID NO: 709877 - DNA, 500 bp, Homo sapiens
gcacgggtctgagcagcatcatggtggcacgggtctgagctgcatcatggtggcacgggtctgagctgcatcatggtggcacctggcaaaagcaaactcgaaaccactctagaagaagcacatacgctcaaccgagctgcatgggactccgatacactcctttttagccttgtaagcactcagtacccactgtcctcccttcaagatgaccatctagccagtaaagtcccacatgggacagtagaacagggtcctgtgagtgagttacttaccacaatgggtcatgaaaccccactcgtcccacaaatggtgtacaccctgagaatcataacgaaactaaagagaatactaagcaactagcacaaagcggtgtggaaacaaggcaaagaagagctggtgacttgcatctgccttgctctttatgaactgtcctgaaacagtgagacccaggtaagaccaggcctgcacacactgctgaccatttcaccccagtcctgttg

SEQ ID NO: 709878 - DNA, 192 bp, Homo sapiens
cagtgaggatctccaggattctcgcacagaggatacccaagtgtattttcaccacctgacattggccgtgttgataggcctgttgaaggcccaaaagtccatcgtcagtgtgggctgcttgtggacatttgggggcacttctgggaaaatttctatagattatctcgggatgttgggttcaagtttcttctt

SEQ ID NO: 709879 - DNA, 308 bp, Homo sapiens
gcacgggtctgagcagcatcatggtggcacgggtctgagctgcatcatggtggcacgggtctgagctgcatcatggtggcacgggtctgagctgcatcatggtggcacgggtctgagctgcatcatggtgggaaaagattgaagaccctgtctatggtatctactatgtagaccacatcaacaggaagacacactatgagaacccggttctagaagccaaacggcagacgcagcgtgagctttctggctttacccctatccaatcactgtctgtcgttgcctaaagagctggccctgtgtcaggatct

SEQ ID NO: 709880 - DNA, 105 bp, Homo sapiens
ggaaccgtctgacctttcctgcccgccttcttcctggtcctcatcgccctccttccctccgcttcctttcctttccggacgaggtcaccgttccttcccttccct

SEQ ID NO: 709881 - DNA, 854 bp, Homo sapiens
agtcatcagcagttattatcgacaattttttataatataataaaacgtatgttggtacaagatcataattgactttacccagctggattgaaaggctccacagagggaagtgagagctatgaagaagatccctacttggtagttaaccctaacttcttgctcgaagattgagatagtgaaagaaactgaccagagctgaggaactgtggcacagaacctcgtggcctgtagcctggctggagctctgctacggacagaagtgtttctggaagtgatgctttcaggatttgccctcacaaacaacaatagatttgatggtcgctatctgtcacatatatcactaggtataatatcatctcttgactatacactacatcggtttgttcaccctgtccaacagcatcttaaatcccatcattgggtaatttatatatcattcccccatctgttaactagaaactaactaagacataaattatataacgtatgtatttttcttgtgaattctgtcgacttacattataatgatatattgtctgaaacaggatgaggagaagagaaaactcgcacctgataaccacataacacaatcgaataataccgtatcaaagcgtatacataaaaagataattgaacatgaacaatcgaaatatacaaattaaaaacagtttattaaaagttattgcgagccccatatatataagctgtcgcccgtttctaatcgcacttaacagacaaacttctactcgctcctaatctagtaatatgtaatatttaactaaatcaaagaactattggtatgattgcatttagtccacccataatactgatatactcctcctcatgtttatctc

SEQ ID NO: 709882 - DNA, 919 bp, Homo sapiens
atgcctgtgggggtgccctccagtcgtcctgggacccgagggcccccccccccgcccgtggtcactttggtcccgccacttcacagggcctggtttttgtgaccccccgcggccttgtgtaaccctcgtggcccaccacttcagagatcaatttcttcctccgttagagcgggcaatgtcctgcgctccctcttagaggcccctcttccacgtctccgctcacccatggtgccggcccacaccgctgctttccttcttggagagggctacccctacttctccgctatcatctcgcggcgcggctatcattgccggtgaggcatcagtcgggtccgtccctcctatccgccccgccgggttatccccacggcccaaattcgggttctgccccacccaaggggcccccactcggctcgctccctgccaacagccgcgcaactgcgctccggtgataggccacacacgcggcgctgcggacaaacaaatactggccgccaccctcctccccggagcagtacgaagaccttctgcgagcacgctggcaaacacctgcggggagtggcacgccgcctccgcgggtaaaaccccccgcggctcttctacgcgctggcccccaccagcgatgcgatttgtgcagagaatctttgacgcatgtcaggcggcaggtctgggctccgccccggattctttgggtgctctcccggctcttgccacccgcgcttcggcctcccgcccccggctttctctcctgaagtgcgggccagcaggaatgcgctgccgctcctggcgggcgccctcgggcatagtgcggaggctccctcccggctgccctgtcgtgccctccgtggcgccttaggagagggcgttcttggcgcccccggggctctgaaaaacagccccccccaacgccaacataaca

SEQ ID NO: 709883 - DNA, 162 bp, Homo sapiens
tctgaggatccccggtagcgcggacttatcggcataggccggagactacagctccgatttgagcctagcctgggaacctccgtgtgccgcggagcggccaagaaatagcgacaacaacaacaacagacaaaataataataataataataacaacaaaagtgg

SEQ ID NO: 709884 - DNA, 560 bp, Homo sapiens
  misc_feature (419)..(419): n is a, c, g, or t
  misc_feature (422)..(422): n is a, c, g, or t
  misc_feature (429)..(429): n is a, c, g, or t
  misc_feature (442)..(442): n is a, c, g, or t
  misc_feature (445)..(445): n is a, c, g, or t
  misc_feature (480)..(480): n is a, c, g, or t
  misc_feature (482)..(482): n is a, c, g, or t
  misc_feature (485)..(485): n is a, c, g, or t
  misc_feature (491)..(491): n is a, c, g, or t
  misc_feature (493)..(493): n is a, c, g, or t
  misc_feature (551)..(552): n is a, c, g, or t
caagtgaacaacacagcgaaacgaagtaccccctacacgagaaacacctatgacccccatgccgacagaaatgttcatgcgttcgatgagtgatagcgaacttgtgaatgtcctagcagccgcgcaagccgtggagcgttttacgcctgtagaaagcgagttgttgtttcgtcttaccgccctagtagaagactacgagcacgtatgtgaggcactggagcagcgcagcgatgagcagtgatgacaacggacaacgcaccagcaccagctaacccacacacgagagaaaaacccatgttccctatgaccgtcaccattaccgaccaggcccaattaaacgctgtttggcggtgcttaagccgccagcaggtgcagccccgcgcaacctgtgcttgacgatcaccggggtccgactcgantcnatatggntagctgttcctgnggnaaatggtatccgtcacattcacacactacaccgantnaantgtaantngggtgctaatggggactactactaattgggtggctatgccgtttcagcggacctgttnngcactgat

SEQ ID NO: 709885 - DNA, 1023 bp, Homo sapiens
gcagagagggacactaccttcgcatttcctggtggctgcggtcttctccctgtcttgctctgagcccccataacttagctttgttttggagtgttctgtctgggtgcctcgagtaccggaatctgtgaccgtcgtggtggatgccttctacgtggaggatggccgatctgcctgcgggttgacacagtcgctatacgaggtgatctagctaccgtagccacgattcgttgctggaggaactcgagagttgcggaggcgtattcatagtagacatcatcaaggtcccatccccgtggaatagacgatgtgcaagttcgctcgaaggttacttcttcaaggcccctgcagctggtgctcatggaatcaaggatgagtggagcctcgatctacgagccagccacggtgaaggagaactggatcgacccccgtgatgaggtccccgcaggagcacctaccatgcgcattccaaggagcagccattcatgctggagacagtcagggaggtacaaccgcgaaatggccggaggagctgctgctgagggcaaacgtcgaggacctgcgctgcgccatgcccaggtcctggctttggagcgagtgcaggtaccgccaggctctctcaaagaccaatctctcgatgtgcatcattctcaagccatcagaaaagttctccaagccatcgcagtgagcactaattgtagcctttccactgatggcgtggaggggccgatacccagtcgcactgcgcaagtgtgccttaggcccaatcaatatggccctaaacagcggagtaagcgaacaaattccgaggaaaacaggaaaacactgtaagtgtgacccaggaatccaagtcgggcagcgttaagtacctgaggaaaacaccggattggcgcaacaccgtggtaaaacaactgcttagtgcaagaaaagagggcagcaccacttatgactgccatagtataacacacacataaaagcacgacacatcacttcacgttctgatcgcatacctctttcctgttaaag

SEQ ID NO: 709886 - DNA, 418 bp, Homo sapiens
tcccctcggcaaccttaatatcgattgctcaaattcttgggccaggatgagcacagtggctcatgcctgtaatcccagcactctgcgaggccgaggtgggtagatcacttgaggtcaggagtttgagaccagccagaccgacatggtgaaaccctgtctctactaaaagtacaaaaattagccaggggtggtggcaggctcctagtaatcccagaactttgggaggccgaagggtggattatttgacatcaggaattcgagaacagccgtgccaacatggcgaaactccgtctctactaaaatacaaaaattagccaggtatggtggcatgcgcctgtagtcccagctacttgagaggctgagggagaatcgcttgaacccgggaggtagaatgcagtaagccaagattgcttcactg

SEQ ID NO: 709887 - DNA, 601 bp, Homo sapiens
gatttatcctgtgtataaaagacacggtgacacaccacgcacacgagagggttctcgtctctcagaggctctctttggccagcacttccctccacaaaagttcccgggagaagcttgagaaatgccccccgaatatggggtgtgagatatacaccgtgccaaagctgtggcgccaacgcgccaccaaagaagctttgcgtcccttacacgatgtgagaactcggtttctaacaccgccgaagctgctttccaccacgcgccggcaccctgtaacctcccgcgggtggcgcctcggggttggctcccactgagacccagagttctaatgggggaccgctccacgaagagaaccgcgcgttcatgcccagaccccttcagaccgcaggctccccagaagtgttggcccgcccgcggtcctcccagaccctcgggaggggcctgtaaaatggtgtgaaaagagacccagaatggcgcgcccccaactgacccctccagggaccaagagatttggaccagaatcccccggaccggtggcccgctgccccaccagaagccattagaaaccaaccctgctgggttaataaattgcctccattctcgt

SEQ ID NO: 709888 - DNA, 747 bp, Homo sapiens
aggaaaactatatttagtgggcaacaactatttttatgactgggatgggggagtatatacacgtatagcaatctgtacgcattgaacaacttggttcaacgatcggtggcgggcattcccagagcgtgccataatctgaccagaacaaggccgaactctgccttgcgagcaggctagcatcgatgaagcacaattcaacaaaggtgttctagtaaccgtattctccggtcattcatacacgcgatggcgaccttccgcagattacggacacgcacagcacatgatggcatatccctttaggaatcagatcacgaaaggaacacacgacaagaacaacgttcacggaccgcgtcggcggcagagcacaacaacgggcacggcgaacggcacgaaacagacacttggcgccactacacaactaagcggagcgttcaagacgatacctcactttcctggcttgacgccaaccccaagttgctgctttctcccgcggaatgaataccgacaaaggcagaagacccgtgtattaaggcaacattcaagggaaaacaatcacaaaggcgtcgccaagtggcctttgggcgaaattcccaggctttacccaacagattccccttgacacaggaatcggggaggtggcacgttcgcgtcgtggaacttggattgttagtcgatcggaacgggtggtcggttcagtcaaccgcaacgccacgacttggttcgaacggacacgtgcggcaacacaca

SEQ ID NO: 709889 - DNA, 316 bp, Homo sapiens
  misc_feature (13)..(13): n is a, c, g, or t
atctcgctttggnttgcccagcgagtgcagtggtgtgatccctgcttactgcaacctccgcctcccaggttcaaatgattctcctacttcagcctcctgagtagctgggattacaggcgtataccaccgtgcccagctaatttttgtatttttagtagagatgaatcttcaccatgttggccaggctggtctcaaacccctgacctccaatgatccacccgcctcagcctccccaagtgttgggattacaggtgtaagccaccgcgcccggccagtgtatagcttcttgagtataggttaggcagtggctccagta

SEQ ID NO: 709890 - DNA, 100 bp, Homo sapiens
tttgaattaaattaactgttttaattctaattaaaagggatataaataagtaccgtatataaacacttctctttctctcctccacaatggcacgtggatc

SEQ ID NO: 709891 - DNA, 1190 bp, Homo sapiens
gggcgaaatgagacagcaaacaccactcttcctaaaatgttcaaaagctgctcttcgcttcaccttggggcctttgcatttgggagctgttgtttcacatcaaagaatatgtgctgaatggaatcccagtattttgctgtcgtttaaagtattattcgtctggatcttcctcagttaacttccagacgctttctgagagaatgggggcaggagctctagccatctcgtcaaagtaaacgcagcggttcggctgtagcgaagactatgaaagaaggatagtggcagtcgccattacatgaacagaacggatcttacctatcagaagtctatttggagtcagtctccaagaacttgaacggcaggtgctcaccgagcaatgggataacaagcagtagtgtggaatatacgtggaatatctgacatcagcgatgtatttacccaggaaggtcttgaccagcgggtgactcggtaacgtgcacggtggctggaacacaacgtgtccgagtgaagctcgagaggtggcagtgcccgggagaaaacatgagggacaaggacgggctcgattgtcgggctcaagacaggagcagactgattgaaaccgtgggacatcgaaaggcagacagccctcaagagagctctggatagaagccaattaagacggaatagccgtggaccttagaatcccttattcaagcactacatcttcacagcgactaggccacgcaatatagcctagtgccatccgcacgaggtaaagtttcactacagaactaaaatgatagcagaaggtatgaccctgaaagaacacgactaaggtggccatcccgatgatcatacaacaataggcgaggtctttacaagaaaaacggttagcatcgagaccaatggactggtgcacagaaaattcgcaaaccatgcaaatggtccgcaggccattcataggaccccccgagacgaatagggcgcgcctaacccctgcacttaaacaaaatgcacaatgccaggggacctagcaaagagcgacctcaaagggccaggagtgcacgagggagacaaacaacgtacatccaacgaacacacaaatgtcacgacagcaagacaacaaacccagtacagcatgaaaatgcacaaaacgacaatgaacaaccgacagaagtgaccacacgaacaaataccctagataccgagac

SEQ ID NO: 709892 - DNA, 316 bp, Homo sapiens
aggtataagatccgatcagttcatggtggtgttgggtacggaatgtggtggtatgggtgttatgttggggttgtgttcggtggtgttgggtttgtgtacgtggttgttgtggtaatggtgtaaggtttactcttgttcagtgggtgttggggttggggtcacgtggtggtagtggtgattggtgttgtggatggggtctgtgttgcggtgggttgttggggttgggggtcaccgtagtggtagtggtgaatggtgtcgaagtaggggtcttggttgcggtgggttgttggggtcggggtcacaatggcacgtagat

SEQ ID NO: 709893 - DNA, 482 bp, Homo sapiens
gatggatgaatggaataggtggaatagaattgaatggagtggagtggagtgaatggaatggaatggtaattggaagaatggaattgaatggagtgagtgagtgaaggattgaaggaagtggcagaagcgcaatgcgaattggatggactgcggtgcaatggagtgaagtgcaatgcaatgcaatgcagtggcgtgcagtggaatgcaatggaatggaatgcaatggattcgaatggaatggattcgaaacgaatggactgcaatggaatggactcaaatggaatctactagaacggaatgaattcgtatggaatggaatggaatggactggaatggaattgactctaatggaatggatcagaatggaatggactagaaacgaacgaactcgaatggaacggactcaaatggaatggaattgaatggaatggacttgcaaggaatggactcaaaaggaatagactcgaatggcatgaaatcaa

SEQ ID NO: 709894 - DNA, 524 bp, Homo sapiens
ggcccctacccacatcctgccaccacccgaggggaccgcaagcaaaagaagagagacagaacaagtcggcggctctgaggtaccgcagcggaagcgggcagagggtgaggcctggagggcgagtgccaggggctggaggcacggaatcgcgagctgaaggatcgggcagagtccgtggagcgcgagatccagtacgctcaagggacctgctcatcgaggtttacaaggcccggagccagaggacccgtagctgctagaagggcaggggtgtggcttctagcgggctggtcttcagctctggcagccttcatcccacctgacatctaccattacattccaaaccccatctcggcacgggtgcagtggcttaatgcattgtcaatcaccagccaacttttcggcgaagcgcccaaagggcccacgcgcaccgggcattctgccttcgagcgccaccgaggtcaataccagcctgggcaacatagtaagagcctgtctctattaaaacacacacactcaacccttct

SEQ ID NO: 709895 - DNA, 455 bp, Homo sapiens
gccggttcagagggcaaaacacgatatcttactagacacatttatatctcagtgtagtgtaaatattagactagcaaatctaaatgtttaaatttagggaggtttttttttttttggctcaaagggttaatttaataacaacgggtgaaaaacaagcatccggtattaagcaaccaataaattaataatttccccaggccatcccattaatacccatccctttagattctccaaaaccaaaaagttaaaatctttaaaagagcaatacttacttctcatatccaggtccataatctagtgctgaactatgtgtcctatggagtgccacctctgggtctgctgtaaagaagggcaaaccaagagcgactcgtgaatgggacaaattggcaatgtccctcccgggaggttacaaaaaccgttccatatatcatgacgcacctctttccaaataaagc

SEQ ID NO: 709896 - DNA, 360 bp, Homo sapiens
ccggtaggactggggagccagactgtactcggtagctgaactggaccagtctggtaagggacgttggagctaaagtatagcagacaggtcgagctgggtctgacatgttacgggctgtacaatctgtgattgtggtccaggttggagctgtgtccttaggcaatgtctgaacagctcatggtgcttgagcctgggtcccctgggaagagaccagacaaagggatcgggtcagacaaagggatgacgaaccgcattcatcagaaaggtggataaagcctgggtctggtcgaggtacgttgagcagatctagcaggcgaggtttcaggcgttacggtgagacacaggtatgtatttttgggt

SEQ ID NO: 709897 - DNA, 164 bp, Homo sapiens
ataataatctgtgatgatcttttgtatttctgtggtatcagttgtaatgtcaccttttcatttctgattgtgctcatgtgaatctccttggttcttaggtaaacttgctagctatcaatttaattatccttcaagaccactgttgattcattgctcctctgggg

SEQ ID NO: 709898 - DNA, 1136 bp, Homo sapiens
cttgggaccaccgctccctcagctccgagtccatggctgatgtgctgagcatgagcgggcggaggacccgggcgcgggcgccgggacgcacgctggggcatacctggagtggcggcggcgaggcgagagttcggcatagcgcggtgagctgtggcaacgggaagctcctgccagtggctgatcgaccagatcgacatgcggcaagtacccctggtgctggtgtgggaggaactgaggcattcgaagacgcatcttcctgcatccccttgtgaacgcaccgctggtcaagcaggactacaaccgcgaggaggacgccgcgctcttcaagggcatttggtgcacttgtttacacggaacagttccgatgaagggcatcgcactcacgcctggaccacatcccaccgtggcaaggaccgcggacctgctgggattgcgcctattgaaacaaggacgcaactgacctttgagggaaacctgggttgagccgtggacgacccacgtcattggtcacgattcgttccagacccccggttacgccacaggtgctacccagggcagttgctaaccccttgagggggcatgcccaacagacacaagtgaagtcccgaatgcgcaagccattcgaccacgtggcaagggaaacccagccagacattgtttcgcaatggaaggccacaacccgcattgactaacgccgagtgcaagcacaaacgcccccttttagccccgtatatacggattcccgcccaaggatgcccaaagtcgaagggattcccaacgacaaccgtttagcaagatcgaattggcgccaacgcccgtacctccgggacccgggaagaggtcctaggccagcgggtgaaacttagcggttagccccgtggagactacaaggcacgcactagacccacggcgtaaaacaattctcacccagtaacacccagagttgatattccccccaaacttgaaacgtcattaatggggacacccccgcccgccgaggcgcgcagctccaccctaggggaccactatgggtacgcaaaggcactttacgggctaaaaaatgaccattgtgtacttaggcaccacaggcaggcgacacccagccgaaacccaccatcattgtcataatatgccct

SEQ ID NO: 709899 - DNA, 111 bp, Homo sapiens
accaagaccacacgtactaaaggttgaactcaaagatatgtacagggtataaaacaattaccaaggggaccagttaccttcactacaagttcaaaactcagcaacaagttc

SEQ ID NO: 709900 - DNA, 244 bp, Homo sapiens
gatgacaggggcggagctcacacagtaatgatacatgtgggcatgatgctcacagtaatgctctggcagtgtggctggagctcacacagtaatgctctggcagcgtggcggagctcacacagtaatgctgacgggtgtggagctcacacagtaatgctctggcagggggtggagctcacacagtaatgctctggcagggtgcggagctcacacagtaatgctcactggccgactgtcatctcag

SEQ ID NO: 709901 - DNA, 1013 bp, Homo sapiens
ctttcttgtgcatattcaatacttgctgaactggatatcatgaaaatatttactatgaacaggaaaatctgacatatagcccttattgatatggtatctattaatgaatgattcttaatggggctcattaataagtttaagtatgcacaagcgatctttagaacagtttaacctgcaaacacttttaaaagataatgcctacttgatttatatctataaaaagactgacaaggtaattaatatttggaaaacatttaatgcactaactttaaagaacattgaaaattcaggtggatgaatagtcttacaaaagacaagtgtgctttatgttatacctatagctttggtcccatcttgtaatgtgatcaaacatgttatctgtgataagaacatattttcggataagagtatatgatatatatatttgtagtcgctatagaaagggtctaaagaagcatttgaggaacaaatatttggtgtaccctttatctagtaatcagtcctttagagtattcttagtagctacatttggttgattcatcatatttagcagtatatatattgttctattcagtgttcacatcttgtgccccatttctcacttgtgtcaccagctgtttgtgccattctcaagtgtaaagttgcgacctattaaatcttgcagtttaaggtcggcatgctgctaagaaaattggcctttttctgttttagctagttaagccctactttcccttgcgaagaaaagtttatttggcctccttgtatgcatttatggaggtttcgggggacccaaagtttttggcactggaaaccggttttaccggacaattacttggacatccaccaacccaaatgttctttccaaaaagagaaacaaaacccacagatagaaaaacaaaagggggggaagaaatacgagggggctagaagcccgattttaaaagcgctaagagtaaaaaacagagcggaaaaggaaacgtattgacggacttgtagtaaacaccaccaatttg

SEQ ID NO: 709902 - DNA, 222 bp, Homo sapiens
ggaccggacatgctgatctcacgggcaaaagcagcactttagtcttcagctccaatcttttgttcatttcttattgcttgaaaaaaaaagcaaacaggacacatttgagaatctgtccttcctatgtctatctttatctctgtctacagactctttggctaatggctttcccactgtcttcatggcccaggttaagagcgttcgcgttgagatcaggcatgt

SEQ ID NO: 709903 - DNA, 435 bp, Homo sapiens
cttctgattcccaggctggtcttaaactcctgggttcaagcagtcctcccacctatgcctcccaaagtgctgggattacaggcgtgaaccacccacctcacctggctctttcttctttcttaaaattgaccattcttagtagaggtttgtcaatctttccaatcttttagggaaaaaatcagcttttgatattgttaagtttctccatttttctcatgctttctatgccactgatttctgtatttgtctttatttcccttttttggctttgttcttttttccctggcttctgggagtgaatcttaggtctctgctttcatgcctttacacgcacttagttacagagttctaagtattgctttagctacaccaacaattttgatgttatattttcattattattcagttggaaatattttttcttcttcgtcgagc

SEQ ID NO: 709904 - DNA, 232 bp, Homo sapiens
  misc_feature (96)..(96): n is a, c, g, or t
  misc_feature (138)..(138): n is a, c, g, or t
  misc_feature (144)..(144): n is a, c, g, or t
  misc_feature (173)..(173): n is a, c, g, or t
  misc_feature (189)..(189): n is a, c, g, or t
ccaactcagctcctgagtagctatgactacaggtatgtgccaccacgtctggctaatctttttattatttgtaaagtcgaggtttccctgtgttgnccaggctggtcttgaactcttggctccaagtgatacttctgncttggnctcccaaagtgctgaattaagcagctcancatccacacgggtganctcatacatcaagccaataccgtgtggcccaagaaccccaaca

SEQ ID NO: 709905 - DNA, 477 bp, Homo sapiens
  misc_feature (13)..(13): n is a, c, g, or t
  misc_feature (19)..(19): n is a, c, g, or t
ccaggccaggccntctggntccagaataaactggagtctgatggttttcaactgcaacactcaacaaatatgttcagtatgtctggccaactaccgtaaaagtttatagaaattttcaatttaagaagtaaaggccaggagcagtggctctttcttctttcttaaaattgaccattcttagtagaggtttgtcaatctttccaatcttttagggaaaaaatcagcttttgatattgttaagtttctccatttttctcatgctttctatgccactgatttctgtatttgtctttatttcccttttttggctttgttcttttttccctggcttctgggagtgaatcttaggtctctgctttcatgcctttacacgcacttagttacagagttctaagtattgctttagctacaccaacaattttgatgttatattttcattattattcagttggaaatattttttcttcttcgtcgagc

SEQ ID NO: 709906 - DNA, 167 bp, Homo sapiens
gtggtatggggtactggactcattgatggtgacgacgatgtgggcaggctgctgagtggctgagcagctgaccaccatgttgccatctgagttctcgctggctccgagtgtcgctctgggatgttggcgaatggggctggttgtggccggtcagcagacgaggtgcc

SEQ ID NO: 709907 - DNA, 210 bp, Homo sapiens
ggcttttctccaaaacaagaagttttattttccccaaacccaatattgttgctttaaataatgtgggttttggggctcttccaaattaaaagaatgtacccccccatataatgtttttttttgtttttgaaagccccacccagcttagggagggtaatgctaaaaaattggtttaaggaaataatctttttttatcccctcttttcccca

SEQ ID NO: 709908 - DNA, 421 bp, Homo sapiens
acagttttctttatccaagtccaccagttgatggacaccgtaggtagattccacggtttctgctatcgtgaatagtgctgtgattagcatacaagtgcatgtctctttagtgtaaaattatttattgtcctttgggtatatacccagtcatgagattgccgggtcaaatggtagttccattttaaattctttgagaaatctccaaatggctttccacagtggctgaactagtccacattcctacgaacagtatataagtattcccttttctcgtgcagccttgcaaacatctgttatttgtggactttgtaataatagccattctgattggtgtgagatggcatcttattgtggttttgatttgcatttctttgatgttgacataatcaccaaaaacgtaaacatttcagttgctattggt

SEQ ID NO: 709909 - DNA, 870 bp, Homo sapiens
tcggcacgaggttgaaactgagctggccacgatgggaagaggggaaagcccagggttacaggaggcctcgtgggtgaaggcagaggctaacatggggttcggagcgaccttggccgttggcctgaccatctttgtgctgtctgtcgtcacgtatcagtcatctgcttcaccatgtctcctgctgctgcctttacaatgactgtgccgtcggaccacgctcgcggttgtcaccaccaccacagtccactcactgctgtgctgcatgccccttatcctcaggcctccaaggtgttgccggtccagctaccctggaccaagctaccagggctaccacaacctatgccgtctcagaccagtgtatgccagcgagtcagcggcgctacgccaatgcgagtacccagcatcttaaccaggccagtcccatgggtcccaggctggtctattcaacgagaactctggactggcagtgacgcagcacgagcctctatccccgtccgagttcacgcactctcgttagcaacccgtctcatatcaatggatgccccgcaaggtgggtctctgggcattccctggttctctctggactgcctggttgggttagtgagtgtggtgtgtgcgatgacgtggatgtttctggtcgctggctctccgtatgcgtccccactgctgctgcctgttgtgttgttcatggcatggggtgtaccgttaggcccccaatgtgtgctgtggtgttttcctgcctgtatattgtgggttccttctgtttccgacatggtgggggcaacttccttgcctgagatgttctggccccggttttgtacgcgcaccgggatctggtgctcgattcgcgcctctaaacggggggggggc

SEQ ID NO: 709910 - DNA, 929 bp, Homo sapiens
tccgcctctttttgaacaacacagaggtttacaggaccaaaaattcacccattggaactttcttccaacatcatgactggtttttataaaacacctccccctccttctttcctctcccccaaaccaaacaaagttctttatatcgccccgcccttttccccggaaattgtcctatctgaacagcacaaacaaactgttttcacacgggcgccaagtacaccccctttcaaaggggttacataacccccctcgaaccgagttgtccccccgacttctgtgatagacacgctaaccccttgctacataaccccacacgtgtcctccagacaacttgttcataaaccccacctatagattagctaattattgcttactacctaaccctcctccaggatatttctgatctgactcatcccctcgaatattttcgtaaacactacaccccccctgcggcccccttccaaaccgccgctcctccccccctcaccccctcacaaggcagtgttataactctgtcgttgagccctcccacttttgagtacagatagtaatgaccaagtgtcaatggcaccatggtgtctcctcaagctctctctgactacagaaagttatctcacccgacaagcccacgtggtatccacgtctgggtgtatcaacaaaggagacataaacccttctctcccggtggggcaacctggagaaaaaatatattgttcttgcgctacgcgcattttcatagtcaaatcccgcttaatatcccgcgccgcagtattgcataacgactcctcgcgagatcaccctccctcctttgtgggaagcctacggaaccagcggtggaagtttactacaggtgccccgacgtaatgagtgcccgctactcctggcgtgccccggggcaacccctttttcccaaaaacgcccacaaaaca

SEQ ID NO: 709911 - DNA, 362 bp, Homo sapiens
  misc_feature (6)..(6): n is a, c, g, or t
  misc_feature (38)..(38): n is a, c, g, or t
  misc_feature (335)..(335): n is a, c, g, or t
tatttnacacactcacaccactttttttgagaacagantttcactcttgtccacccaggctggagtgccaatggtgtgatcttggctcactgcaacctccacctcccgggttcaagagattctcctgcctcagcctcccgagtagctgggattacaggtgcctgccaccttgcctggctaattttttgtatttttagtagagacggggtttcaccacattggtcaggctggtctcaaactcctgacctcaggtgatccgcctgccttggcctcccaaagtgctgggattacaggcgtgagccactgcgcccggccattcatcttaatttttaaanaatctaaccatgaagccttggttatct

SEQ ID NO: 709912 - DNA, 1060 bp, Homo sapiens
ataagggtgtctttggggaactaagatgctatgcacagtgcattacatggcacaaagggcgtgtatctgagatgtgcttagtccagggcaatggtgcactataggccctcgtggactctgaaatgtgtgtcgacgttgtcgtgaatcctaggtgtcttacgcaggttccacaggggtccactaggaattcgtatctgctcgttctctaaatagtgaagatagtagattcacggtttgcctcgaatgtaatactacagggttagctcgtacactactggttgtccactggatgcgttacgaacacgtacatccactctcgttgaaagcactagtactagcatgtctgtgaacatttccactggcaatctcaggagtatctactggctggttctttggtcagaagacgccacgatttatcctaacgcacacgtggcattgttgtgatcattcatttatcctccgggtggtctgtcctggaggctcgggtcgcctccactggtcctctcactcttacgtgttggccctactggtctcgcacttgatgcatctcttgtctcgatctgtggtgtagtcttggcggacttcatggtccccactgtctgttggttgcctctttttgtgcccctgtttcctggtggcccaggtatagaggctgggaaagcgcccaggtagtgacctttccccagtgtgtggcggagggtgcctgatcagctggccatctgactgactactgatgaagtgcaggatggacactgctgacattcctggtgcgatcttgtgaccagggggcagctttgcatggacgatccgtcaggccgacaagagagcttttgtgcaaattgtaaaccggagttaccggttaggcctgaggggaagtgaagtaattcagttcaccgtgccaggttgggggccaacgcggcgtgaacagctggggagagagcacgccaaatagtcattcgcgttggaggggaaccagacacgggagggaaccgtttaaaaccaccgttggaggaacacatgggggcgagcggcggattttcgccaaaagagcggcaccagc

SEQ ID NO: 709913 - DNA, 461 bp, Homo sapiens
  misc_feature (1)..(1): n is a, c, g, or t
ntagaggatcccggcccggtaaatgtcaggaaatgtgcgctgtacgtggtccaggatatcagtggaagaatgagtaggaagggaatgaggatacgggtgagtaaggatgcttgggttgaagggaagcacttctggtaacactgaatttgggattttttataaagagggcattgagttattggattctggaaaggagagaaggggagcttagtgcttgggaggagaggagatcttgtagattatgagaactgtggacggtggtattctggctgaaagttagtttcctgctttctagagctaagctggctaccacttctagtgctttaaagcaggctggccaccctttgactgtgttatctagttgtttagagaggtaagctacaggggcaaaggaaggaggatttcctttctgttgtcctaagacaccgagggctattcctcagctttcagcagtatagaga

SEQ ID NO: 709914 - DNA, 318 bp, Homo sapiens
tccaaattggaaaagcacccatttattaaaaccagtacaagagtatgaaaagggggaaaagaggagggtaaaagagggggagaaaatggggccggcatcaaatgtcagttagggaaacacaaaaaggcttactttttaaacatttacatttaaagggggaacatatagatagaccacttaccctttaaaaaaaaaaactcaagagcagccatgttgggcggaaataaacccaagaaacacagggaaaacccccccaaaaacctaaaagcccagggagaattcaatttcgcatttccattcaaaaatcgggctacaaag

SEQ ID NO: 709915 - DNA, 546 bp, Homo sapiens
ctgtaaatcactggacatcttcaccgtgggaggttcaggagatggggtggtcaccaacagtgcctgggaaacctttgcagagataccgatgtctagagaacagcagaagcgttgtgaaaacaccgatgacagatgtttgcagaaacatcatctttagcatttctgcccgtgttacgaccagacaggcctggcttgtgaatgcgagcctcgagggattcgttaagttccgtgtgtgatcccaacggaggccagtgccaggtgccgggccaatcgtggttggaagaacctgcaacagatgtgcacctggaactattcggctatggcgcccaggtggagtggcaaaccgtgggtgagtgccatctgcagaggaatctgatcgaatgccttcatgcaatcaccggtcaactaggccagatgcacacatgtttccaggtgagtgtatgctcggacagtgtgatcggtgcttacctgggcacatggggctttaccaacttgccagccctgacagtgcaatggacatgccgatgactgctacccagtgactgg

SEQ ID NO: 709916 - DNA, 172 bp, Homo sapiens
tactctcacctggacacagtccgtcccgtggtttcctagctctccaagctcgatacaagacttgcatatacaggactggctgggcaggtacaggggctggagggcctggagcttggcggtccccaggactgcagggtacatggtatgtcgtgtctttctcctgacagaaagt

SEQ ID NO: 709917 - DNA, 926 bp, Homo sapiens
ccagattgtgttaaatatagctttagcttgtgtttttacatgtgcctagtatactggtggaggcccttacttttaacgacaaagttacgggtactgtgtgtaatttgattcaggtatggagtgtatttgtggattcccatccatgttatctgtatgtcctcctcatagcaacagagtagtcttcaacatgatggtaataggatccatactatgaatggccaattgtctagaaatgttttatcacctattattatgctaattaatttttctgtttttcgaaaagagatcatttggatagcagctatgtatgcaaatggtttattggagatatgattgctatgtatgcatgacatagttcaggactttcccataccacaggccaagcagtaacttaaattaggatctttaatttgtcaatgatacaaaggctctaaggtgtcatgtaatttaatgctgcctgtgaaacactgtctgttctagatttttcacccagtaattttcgaaatttgggtaatgtaaacctattgatatatttattgtatgttggctagcagttcatccttctgcaaaatatgcattcagagacaatgtgaagcttgttttaatgaagacttaaaccatttgtgtgcatttgtgtttttcatagtcaaatacacccaattaaaattcgtgaacctatatgttttcatcattaacttccgctaatataccagaacatatacctttttcatgtaaagttggcaatgggatatggcagttttatttttgaaaaatatgtaacatgactttaatatttttatagtctttcagaattagaaacataggaagggataatgtgtttaattagataagtcaactttttatgtgtctgtagtggtgtactataatagcagattataaagcattattaaatgtttctactattt

SEQ ID NO: 709918 - DNA, 315 bp, Homo sapiens
attcctgaatgcagtccggcggagagcttgcagtccactcatttgctaccatctacggctttattccaccacgcccagctaatatttgaggggaagacagggacagggcttcgccattttgaccaggctggactcgaactcctgacgttaggcgatttgcccactgcagcctcccaaagtgctgggattatagctgtgagccaccacgaccagccccagtggtgacattattaatacttggtgagccccttgccctgcaatagtttaatagttagagaggcagtctcaggagtcatattgccaggatttgaatcc

SEQ ID NO: 709919 - DNA, 973 bp, Homo sapiens
  misc_feature (754)..(754): n is a, c, g, or t
gagagaaggccggaggggtctggtctgtagtggcgctgttgggcccttggggattgtaagctgtgttttggggtggaagagcgggagagggtcggattcgtcgggatccccgcaaggcatgagtgctgccagagagtctcacccgcatggggtgaagcgtttcagcctccccagacgagatctggatctagcacatgtgggaggcagcagacttggctaatgaacgagagaaacacaaaagttctggagactttatgggtgcggaacagaaagaacatactgtcggtcttgtataggagatcacaaaatcaaatctcacttccgaaacgggggaagcaacgaccacgaacacattacggaagaacttgagtctcaatatcagcaacagtatgcgacccgtaacattcatcaggaacgatatcgggggacatttgtggacctggcgtcagtgacggtaagaagacccttgatcgcagaagggttgattgtgctggagcctgctggcatgcatgaccgatgatgatcaccctgatcctgaaaggtcccaagatgattcctgacaggcgattcagaggtccagagccaaggacgactctggtgaaagaacttccaaggctgtgagcacccctgatgaagtggggggatccccaaaaagccaacaaagttgccacaagccagtttcaactgcttgcttgggtcaactccgtggtgtcaataagtccccaaagcctcagctctggttgaacagtgaacncttaattgaacaggccaggggagcaggtactaaccacgaccgtgtttataactaaagagggcgtttaatattacaagagtgtcgcggccacgcagggcagacgttggggcaatccactgggagagacgtgtaataaaaaaaggcgttaatagcccacaccgggggcagtggcaccacatactaacaacagcgagagtatttgatgtggccattgtgata

SEQ ID NO: 709920 - DNA, 614 bp, Homo sapiens
aacctagaactaaaaacattgaatattcaggaaaactgaggaatgagattaaatggaggtcagaataaaagaatgttaaaggttttgtgggaggaagagagtggagagaagtgaaattattatggtagtctcatctggtgttcaaaaagtagtaaggtaaaaataattatcttgaggtgaaaaccatgggttttagtgagggaaatagttaataccttgtttacaggtaatggtagagaagtatgtatctgattatgagaaggaactaggagttctgtatctccccagacttcttgtgcaaaatttagttaaaacttgtgctagtaaactcgttctggtcctgtttagaaaggaagaggcaattataagtactagggcttcaggagagtgcagctgctatacataaaacctgtaacagtgtatgaggcctgtatctggcaaaccctaggctttcttggaagaaaactttcttctatttgagtatattcatgtccaggatacagaagatactttcgatgtgtaaactttctttttctcgctcattctctctctttcccttttttttttaatggagtcttgcactccagcctcagcgacaagagcaaaacatctca

SEQ ID NO: 709921 - DNA, 1238 bp, Homo sapiens
tgagctggggtgagagaggaggtggcgagcaggtgtgctgctgggcagctcctgtcacctgctggggccggggcctgggcgggagtgcatggggacgtgagtggcgcaaggtgccgggacatggggcccgccagccccgctgctcgcggtctaagtcgcctgccctgggccagccgcctgctgccgctgtagctgccactatatgctgctgcttctgcgcgcgcagcccgccatcggtgagcctggccggtgggagccccgtgcgctggccgagtgccccggggtctgtgcccatggtggctaggactactgccgggcgcctaaagcccttcacctggtgaccttgcggcacacggcctggtggagaaccagatcccacagcagcctctcgacgctgtctaccagggaacacgcaagcagacgtgcattggcgttactggcaggaccacgaatttgtaaccccctggcaagctttgccaagaactacggcaacaggttgattaacgccgatagcataccagcaaagggccaaatccccacaatgggaagcagccatgggtagccgtggagggtttcccacagggaaggccgggcaagattggtggcccaaacacccacaagcaacaccaaagcgtaacgtagaccccctttcccggattgaccttgacaccatggctgcaataccagacggaagtgcaggcccataggctgggtgccttgaacggcgcctgccggagcctctatgcaaccgcgagacgagcacattgtaaccaaaatggtcgaacaggattcgcaccacggatgggcactcagagacgaggcccagagaagggacatggcgcaatacaccacggagacccgaataccatggccaccgcgcacagcacccaagcgacgaacgcctagtagagaatcagagacaacggacacaggacgaggtaagaagaatagagcaagccagacccgcacaacaaacgcaaaccacacagcccaacctgcgaacacagagcaagaggaaagaccgtcacggccgacgcatggaccgcccggagaaccacgatgaacagaggaggcaagggtggctaatagaaaaagcggaggggatcagtcaagggtgggcagcgaccaagacgcggcgcgcgggcgggacggggcgtagagagaggccacagcacagcgacaacacgcagcgacggcagccacctactcgcaggaggggtccgtgacacacacaagag

SEQ ID NO: 709922 - DNA, 149 bp, Homo sapiens
cgggtccttccagctaaatctcctgacaaagacgtggccctaaggaccgctaacatacccagagaagcgggcctagacctgatggaaagacttctatttgtatatcttttatttattatttttgtgtttttgtttttttgtatttttta

SEQ ID NO: 709923 - DNA, 370 bp, Homo sapiens
aaaaaaaaaccctgttgtagattctgggattcattgatgttcctgtggctcattcattgacactgctctataatattccattgtccattctgtagtttatgctcctttagaaatacttccatgatgtgatttttatgagtaatgctgccatgaaaatttctgtacatgtctcctgatgcatgtgtacaaagctttcctaggagtcggattgctgggctgtaggagatgtgcatgtttgacattaaaaggtagcaccacaaaccttttcaaagtatttgttctgttttgccttcctgccagtgaggtataagaagtggttgttgagggccgggcgcagtggctatgcctgtaatcccagcactttaggagg

SEQ ID NO: 709924 - DNA, 319 bp, Homo sapiens
  misc_feature (163)..(164): n is a, c, g, or t
  misc_feature (184)..(186): n is a, c, g, or t
attgaggcctatacccttccccgtgccagtttggtatctgaaagtaagataccaacctggtaaattgcttctctccaccagggtcaaaaagccaaatagattatgtatgtaaaattgtaaagtcctcccacagatgcacttgccacattacagagaacttgannaccccccccccccccccccnnnattgtcaatttccacatgcagatctggagtccaggtgtcctggctcctggccctgaactttttggctgggccaaggggcttttcggtaaagtgctttggtgctttggaataaaacaggatgaacatgaatcat

SEQ ID NO: 709925 - DNA, 464 bp, Homo sapiens
gggaacgtcactcattaactgatgtttatttgagctgtcatgtgataattcccactgagatagagttatctaccatcatcaatcctcaatatttatgaagaatctcagctgtttgtacttcactgtaaatatgggtatctttgtcatgacttgcctgatgttccagaatctttttatcttctcccttgacactgacacatagaggcaaagagaaggaaattttaaaggccctagctaacttgggtaacttggtataatggaattgtgtttttgcatcctagcatctattctgttaaaggtatctcagtttttcctttggacacctatttctgtcccattctatagacaacaagattaggtgggccaagggacccaggcctgattaacaagcatgtccctcgtagtcccagctactcgggaggctgaagcaggagaattgcttgaacccggagctggaggctgcg

SEQ ID NO: 709926 - DNA, 158 bp, Homo sapiens
cgggcctcgtagtagacatttgcagttgtttaataacaactgcaaaatgtctactccgaagatgcaaatgtttttccttggcagatcctctctgcgcttgggattgacacaaaggctcaaaactgcaaaatacaaagatcaagtgattgttccccgct

SEQ ID NO: 709927 - DNA, 327 bp, Homo sapiens
  misc_feature (24)..(24): n is a, c, g, or t
  misc_feature (31)..(31): n is a, c, g, or t
  misc_feature (64)..(64): n is a, c, g, or t
ccggtccacagaatatttgaaaanatagagngccttgccttgggccagcatgtatgcctaaaancggaagggataccagagaagattagcatgggcccctgtgcaaggatgacatgcaaatttgtgaagtgttcccatatttttgaatagataatgaatggatgctgggctaaatacctaggtgatgggatgatctgtgcagcaaatcacccagggcacacgtttacctatataataaacctgcatatcctgcacaggtacccctgaacttaaaataaaagttgaagaaaaacctaaaagaaggatggaggagggactttatcattc

SEQ ID NO: 709928 - DNA, 152 bp, Homo sapiens
cgcccagagttatccctcttttccaactatcacggctgcctaaaaattgtctgctagatggattatttagatcaagtgtagagaagatggaaatattgagcaactggtaccgaataaagattgtaggatggtttcatacaggcaaacatcag

SEQ ID NO: 709929 - DNA, 122 bp, Homo sapiens
ttgccgggctcccccgtcctccgtctcggttccaagctaccgtagccgggccctcctcgcgtcgctctccgcttcccacgatcctccctatgcctcctttaccctcctccccgtgccttcct

SEQ ID NO: 709930 - DNA, 424 bp, Homo sapiens
  misc_feature (6)..(6): n is a, c, g, or t
  misc_feature (12)..(12): n is a, c, g, or t
  misc_feature (39)..(39): n is a, c, g, or t
  misc_feature (95)..(95): n is a, c, g, or t
  misc_feature (205)..(205): n is a, c, g, or t
  misc_feature (236)..(236): n is a, c, g, or t
  misc_feature (306)..(306): n is a, c, g, or t
  misc_feature (394)..(394): n is a, c, g, or t
ttttanccccantaaatttgattccccttcgatgaaaancaaatccccgggaaaaatgccacctttccccaaaactgaccacaaaattaaatttnaaaactgaatagtccttggccctggcacggtggctcacacctgtaatcccaacactttgggaggctgaggagggtggatcacaaggtcagaagttcaagaccagcctggnccaacatggtgaaaccccccatctctactanaaatacaaaaataagccaggtatggtggtgcatgcctgtaatcccagctactcgggaggctgaggcaggngaattgcttcaatctgggaggtggaggttgcagtgagccgaggtcgtacccctgcactccatcctgggttgcagcgcgagactgtctnaaagagaaagggggatataggtaactggca

SEQ ID NO: 709931 - DNA, 113 bp, Homo sapiens
gttttaaagagcttcaaagagactggcctggatacagtgaaatagacagacggtaatacgagtcaagtccttctcttagaaaactaaataccggttcagaatgcctacaggca

SEQ ID NO: 709932 - DNA, 875 bp, Homo sapiens
cacccaggccacactcacctcatctccggcggccacgcggtattactccagggagtactcaggtctcaatcacatcgaaagccttttggatactaatgaacaccgcattttatgaacagcatacactgcatccgagccttgcgggaagaagccattaagttatcacgaagagcagcggctttaacaacttgctgaaagcccttcaagagaaaggggaaattcaacaactaacagctctctgggaaagtgctgtccaggatggaatcactctcatcaccagcgaggaaggctttgcacctcctgccccacccgacgaacccaactaacgcgctcgaccccccacacaacccgctgcggagacacccggccccgtacctccaacaacggcgggtgaggcggaacgagctactgtagattatatacgacgcgattaccgccgtgaacttctatcacaactgccggcagctccgccggtgcgatccctgcgcactaaacggagccccccggctcattccggatggcgtaccagtgcccgtagcttcggatagtcggtagccggtgggcggatcaagtcacccttctgccggatcgccccgcccattcccctctcccccgcggagcggggtcggcctgcgtaacacccttaccgagatcgtggggctagcacaccaactagttaaccaacagatccggtagcagcactaatcctggcgcctccctgcgaccccgcggtacccccgccgcccggctcgccgcccgacaccgcccacgccacccgcagcctacacccgcgaatccggacgcctaactaccccccacaactgtcctcacccaaccgcgcagacgaggacggcggctcgcccgcctcccgtgcg

SEQ ID NO: 709933 - DNA, 236 bp, Homo sapiens
  misc_feature (89)..(89): n is a, c, g, or t
  misc_feature (117)..(117): n is a, c, g, or t
  misc_feature (165)..(165): n is a, c, g, or t
  misc_feature (169)..(169): n is a, c, g, or t
  misc_feature (180)..(180): n is a, c, g, or t
  misc_feature (183)..(183): n is a, c, g, or t
  misc_feature (221)..(221): n is a, c, g, or t
tcgggctcgctaggctccgggcccagctcctggagcacatggcctggcaaatggcgtgcaccgaagcgggcagctcgagccccaccgtngcgtcgaggacggcaaacaaaggcccanccgggggcagaccaggtaacgaaagccaagtgcagtgagcatcctccnatgngccgccagccnttngtcgctcgccccgaagcgcaggcccccagacgcctcgnacccccgtcggtcgc

SEQ ID NO: 709934 - DNA, 223 bp, Homo sapiens
  misc_feature (50)..(50): n is a, c, g, or t
  misc_feature (52)..(52): n is a, c, g, or t
  misc_feature (56)..(56): n is a, c, g, or t
  misc_feature (152)..(152): n is a, c, g, or t
tacggagcataccggagccttacctcggagccttaacctacgggagcctnancctncggagccttaaccctccgggagccttaacctccgggagccttaaccctccgggagccttaaccctccgggagccttaaccctccgggagccttaancctttatactgatagttagtcatcttcttgatgcgagccacagcctgagccaactgttccttctctccagt

SEQ ID NO: 709935 - DNA, 145 bp, Homo sapiens
accgtgcgttcagttcagtatcactctttgatgttgtcatccttcatcttttgcattttctgttttcttctgcctttaagaatctctgtaagcccagcttctggcccatgttgaggattgtgggccacaaacagcactttgacag

SEQ ID NO: 709936 - DNA, 259 bp, Homo sapiens
gagacactgactactgttcagggcattccagatggattatgacaaaaggaaactcgtgaaagctttcacagagagatttgcctgtaatcggtctgtggattgaacatcctgaatacggagagggttatccagcttccaggtgaccaaggaaaaacatctgccagttctctggaggttggcatgtaaggaggacagcttaaggttcatggatctaaatgacctaatacgtgggattcttgatagttcgtctctaacccgg

SEQ ID NO: 709937 - DNA, 1015 bp, Homo sapiens
gcttctcttctgttttgggcgtgctcgcgccttctgcagagatgtgggcagctggctcaggatggccattcgtggctcagcacagcaacgcagcccagactcagactgggtgaagcaacacagtggtgctggacagtgccagtgagatgcctgtctggacacgtgatcctgagatgtgggagttgctgcagagtggagaaggacaggcatgtgtcgtggcctggagctcattgcctcagagatactatgggtgtgagccagagctgtggtggatgactattcgagctgctgatgccatgactgccagggacttggaacagccatttcgaccgtggcatccgtgagacacgcggggcagtcaattgctccagcccatacatccgtggctcccagagaccaaacctgagccagtcgtacgacgagagccgtatcttggagatcattcaagcgaccgggatcgatgggagctgggcacgcatgaccggatagactggtgccaatcctgcgacgccaaacgagactgaccacttgtactcgaaccgttgcgacagcgggcactatcacgccaacggtccccaatccatttcgctttgccgaacagtcgtatatggccgccctaagtaaaggcattcgcaaacagaggacatagtgcatggcatatgttcgaaaggttgatacggtcaatggatacgcaaaggcacacaagaaacacattggggccgttgcagactatctcggaagtgtacagcgcgacgtcgcaacacatgtggtcgaccgacgctttgaacccgttggggccatcgcgtaaccgtgttcgcgtgcagacaggcgagcccccagcaaggtggcgcgtccatagttacagaacttcacgccgatgggagacagccccgaaggagcgggaccaatgaattgcgtcctagcgggcgcacctcaatgtattggaccgttacacagcagcaccggtacgagctggaatcaacagaatgggatcgttgggctgaactttgaaaag

SEQ ID NO: 709938 - DNA, 219 bp, Homo sapiens
  misc_feature (107)..(107): n is a, c, g, or t
gaagattccctatgttaggaataacatgttagggaaccctggaggcaggcagatcacctgaggtcaggagttcaagaccagcctggccaacacgacgaaaccctttntctactaaaaaatacaaaataaaaatacaaaaatattagccgggcatggtggtgtgtgcctgtaatcccagctattcgggaggctgagtcaagagaatcactttgaacctgg

SEQ ID NO: 709939 - DNA, 1060 bp, Homo sapiens
caattgggtgcgccagaggcccaatatcgcagtttgggatgggaagttagaagtaacttccggaatgtggcagggctgtgaggtgcaggaagattgtttagcccgtattacacagagtgtaagcttccctacttttttggctattgactccagggcaacaatgtgggaaggaaggcctacaaagactgtgccatgtgagccaagcttaaagttccgatttaaaatgccccgccagttttggaagagcggagtgccgagatgagatgaatggttgtagcgtgtaagatgaagattttgggaaggcaccagagaccccccgaagtatgggtttaccgggtgatgatcatatggcataccagcaccgggagcgttttattgtcgtcagaggacccaggtgggcacacttacgccaagccttcttgggaaggaacggggccgaatgataccaggttattgtccccaaagaagagtcgtaaaatgttgtggacgaacccaatgaattttgcaagggaagaagaattctttaggacttatgtttattagcccggacagggcatagtttgataggtcctcccaatactgtctggctttgcgcccagtttgagacccagattcccaccaggagttattatcaagggtctatccaccaggaccctattgagagagtactaggagtaaagcgcggggaaaatagtgagccttttaacggttcacagcaagagtactttggtggaaatggtgtggtatctttgtaaataagtataaaagagttgatggtttgctgattgagcccgagttcacgagagaatttaatcgatgatgcaacccacattggtccagctgtatcacagtgctccatcccagatggcccagtcggctcaaggggccaaggatcaggctgctgagggaataaatattcaatcaaggtctttgccgaaacaccagaagctcccagaaggggagcctatattagaactaaccctgcagacttttcaagaagcactccgtcgcccttttgcagcttccttaaaatattttaaaaaaacactgtattttacta

SEQ ID NO: 709940 - DNA, 1020 bp, Homo sapiens
gatcgattgcttagcttgtcggggacggtgaaccgggacccggtgtctgctccggtcgccttcgtgctccgtaatgcctaggccagtatgcgtggagtgcatctccatccacgtaggccatggggtggctgtccagatggacgatgcctggtggttgagctctactggctggaacacggcatcgagcccgatggacagaggtgccaatgatgacaagaacattgggggaggagagtgactcctatcaaacaccttgtttaggctggaggaccgggcgctgggctggacatgtgccctcgggcgtgtgctcagtatgactgtggatgcccaacagtcatatgactgaagtgtgcgcacggtggggaccctaggcgacagtgtcgtctccagcccctgaggaagctcaatcacaggtcaaggaaggaatgcatggcgcaatactcttatgtcggcccgagggcgagctaccaacctcactgggcagggggagatcaattggagccttgtcgtaggaccagtaattcgacgaagtgtggcctgaagcgaggtgcacctgggtcattcagtggcttgctagggtaaccatcgagctatggtgggggagaatggttcccggggtcagcgtccctggtcctggacacgtctctcgaggtgaattagtggctacgaaagtccagtgctggaggtcgtccatggtatcgcaagcacccacaggtatccacaagggaagtgagccctacagcgtccaatgctcaccagccacggcaacctggaactactccgaggtgcctgaatggtcacacaatggggcgctgatgagcattggcgggaaacgtggaatcgagggccaaggaactaacttagacggactatgagccagatgggctgcacaacaggtgccggatcagaggctcgcagggcgggagatcaacacgggccacccggacatccggggaaagccggttggggagccgacggcggacaacacctgggcccacgaggccgcgcaagcggcgcgcg

SEQ ID NO: 709941 - DNA, 1223 bp, Homo sapiens
caagctaatcagccagggtgaggccgcagacactgcacggagttcgaaggagactgcccctgaagcagggccattcgtagatcgtgagtgccattcaggtctccgatgtggtgcatcatgtggtcctggtaagagtccagatccaacgctcggacaaaatcacagagcggatgtggatttgattcattcgcttgccgcgcatctctcccatgttggaaccaatagtcaaaagcattctgcggatggaagaggtggcttgcacgattgtgcctcaggggctccattagagagagtctggccgtggggtcgtgacgaaagaacgccggggacacttcctcgagcaagtagagctgggtggggaattcgaggggcatctgaataggtcctctgggttgttgcccatggtgtcagaggtatccaccgcaagggtgaactacttgtgtcgaccccatttcagtttggaatggtccccgcgtgggcctctaaactggagaagtttcttctattaacaagaaccatatcctgcttcgattagactcaaaccgcgacaaggctcaatgctagggggcttgcgccacatagatcggcatttgagtcacttcagaatctcatggtccggacatagacatgtagcagactcgattccctgccggtgcggacagatcaccgcgaatacgcgctggcgctacctcgataccacacacccgcatcacttggagcagccaacgccaagcccgccggcagtgaaggcagatctgcgccccgccgtatcacctcggcgagcgtagtaagaccacacacctgggggcgcacgtgtcgggcagccgccccaaaccgctacacccacggcacccgcacacggatacaaccccaccacgaggcacctgcagccatcgtcaccacaacacctatggcaggacgccgagaccccactcaaccctaagacccccacgcgacaaagcaaagcaacgcaacgtcgcacgggggcaaggacccatccgcccgccaacagcgctgcgaccggcttccaggccgcaccgcaccttcaccgcactggccaagcgggacaacacattccagggggcgtatcacaacacagcacgcggaggcgcaccagccatcaagccccagtgagcggcgttcgtcccacacacaggcgcgcactgcgcgcccccggcaacacatcggctagaaccacgccatcgccgccgctcggcaggcgc

SEQ ID NO: 709942 - DNA, 244 bp, Homo sapiens
tgtcctgtacaaaactgtgctgtgactgtgcggtaggcctggacatggcaaagagaatacagcgaccccttctcttcctaccaaacaactctgtagagctctctgcaccctgtacccttttcacccttttgtatttaattttaaagtcagtgtactgcaaggaggctggatgcaagatagatactatattaaactgtactgttatttaagatgtaataaagcagtttgacatgaaaaaaaaaaa

SEQ ID NO: 709943 - DNA, 112 bp, Homo sapiens
tagacagtaaagtaggtttgaggatggggggcccgcgcgggttgctgcccccagtcgtgggccttagccggggattggtccctttttccccttttttgttaatattttttta

SEQ ID NO: 709944 - DNA, 909 bp, Homo sapiens
aaccgatgcatagtcgcaggagaattcctctcgtccataggatgacaagatgctcctgcatatggcaagatatattgactgccctcacgataattaagtcgcgttgggtgtcagaccaaacgatatgccaaagtcgcccaagagctatcacgggaagatctgcatcaccgccatctcatcccaatcaatcactcggacttacagcggaactcatggtgcgtatagcctgcttctctctattcgaatcatctcttcattcaatagaaacaacccatctattcacattagctcatggcatggcaagattaaataatacaatcttgatgattttactgatctgaaagatcaatgggcaacatgaacacataaaagctccctcctctgatgcgacaggataagcagtttggtacttggagactgacagtcacagcctgtcgacttaccttctgggagtggctgacttaatctggagaactctgatgcggaatgtgtattaacagtagtgaggggaactggggacattcgattaccccctttgaacgctgagtccacgtttttacgatcaggttctaatgatgggttgcccttcatgaggcaatcactggaaccttacgaggtttctcaagaagctgtataccttgaaacaacagtttgggcccatagtggagaatgcttgtgatgccttgcacaagtcagagggttcagaaaaattccccaaaacatattgttggccgactgtgtttccccaggtctaacacacggcacttgatagaatccacgaacggacgcggccttttccttaaaaacccaaaacgttaactccacatacactaactaccttcttgggacaacctccctagcaacccccatcttggtacggcctcacacacagccattccaattaacttc

SEQ ID NO: 709945 - DNA, 158 bp, Homo sapiens
ggacagagttttgctcttgttgcccaggctggagtgaaatggcacgctctcagctcaccacaacctccgcctcccagtgatcgagtttcatgcctgctgcttcagcgagagatgcctggccacactgagcctgcacccgtcccttctgtcgtcttctc

SEQ ID NO: 709946 - DNA, 213 bp, Homo sapiens
tagccggtacgcgctagcggcattagtgaacggaggacttgagttcatctctggccctgctcagagggttaaggatccggtgttggctgtgagctatggtgtaggtcacagaggtggctcaggtctggcgttgctgtggctgtgatacaggccagcagctatagctcctaggctggaaacttccatatgtctagaatgcattcctaaaaagac

SEQ ID NO: 709947 - DNA, 364 bp, Homo sapiens
gctaccgctcccgctctgccacccccgccaaccgcgcgctcgggcctaccgtcgctgccgcgatcgctatatctcgactccttggatcgccacatcctacccagatgcagacgccgggacgaccccgaccgcgcgcatgagccggtcttacgaggccagtaagacggcatccaatgggaccacccacttccgagttgcaccatacccatcgagatgcagatcagaacgccctgtctccgagcacgcctgacacgcttagccttccacccgagtacctggaggaatagcagaaggagggactcacccgacacgtgtggcagaccccaggggcccttcgccccggccccacggcacgcacccgacc

SEQ ID NO: 709948 - DNA, 572 bp, Homo sapiens
  misc_feature (442)..(442): n is a, c, g, or t
  misc_feature (572)..(572): n is a, c, g, or t
gtatttttagtagagacggggcttcaccttgttagccaggatggcctctatctcctgacctcgtgatctgcctgccttggctcccacagtgctgggattacaggcgtgagccaccatgccggcccatcttttttctgatgtgtaaaattagtatatgctaattattaaactttacataatggcaaaaaaaaaaaaaaacgtagacaaaaaaacaaaaaaattgtgtgggggcgcgcaggcgggccctgggaaaaaggatttttaacaacccactttggggtggggcggcggggagcgccccagagataggggttaggtgagacaccaggatgaccaaacgggtggtcccacaaaggggacacctcgcggcgacagcgggacacaggggcggctgtgggttttctcaccaaaataaaaacgaacggcggcgggcggaacaacncggagcgtgcgtttgtggcaccacaactcccagagtggggggtccgagaagggcacagacggcgccctcatcacacagaggggcgcacaagggcaggccagaattaaaactcgcacggcggggggaggtn

SEQ ID NO: 709949 - DNA, 191 bp, Homo sapiens
tagaggattaccacggcgggtgtactcccagctacactacctcaatcaccaccaccgagaccccctcacacagtactcccagctacactacctcaatcaccaccactgagatcccatcacacagtactcccagcttcacttcttcaatcaccaccaccaagaccacatcccacagtacaacctgccggtgg

SEQ ID NO: 709950 - DNA, 193 bp, Homo sapiens
gactggggaggtcgaggctgcgtagagatcatgccactgcattccagcctgagaaacagttatcttaaaaaaaaaaaaaaaaaaaaaatggtttaccattacgaggaggcttcaaacaaactggcacagttcagtaatttggggcagtttaaatttcccaggtctaattggacagaaacctcaaattttcata

SEQ ID NO: 709951 - DNA, 107 bp, Homo sapiens
tagggtggaaagcgacggaagtaggccttatttctcttgtccattcgtacaggtaggaattcgaatgtagatagaaaccgacctggattactccggtctgaactcag

SEQ ID NO: 709952 - DNA, 103 bp, Homo sapiens
gcattaaatacatagacatcctctaaaatacctctaagtaaaaacaaagctcttatggggggggacacagagttcctcaaagacgacggtaacatctttttac

SEQ ID NO: 709953 - DNA, 215 bp, Homo sapiens
tagggtcgatctctagcaggatcccctcttctcccctgacatgtgcagtattagcaatctgaggctgtcctactaatctgctgattacctgatacttcctgaagttcaaggagaatttgtcccagttagaacctcagtcactggaatagttacactgttggagatgataaaggctggactgggtacataatcagtctgttgctgccgatgggtgg

SEQ ID NO: 709954 - DNA, 1161 bp, Homo sapiens
cactctctgcaaggatcacgtatctgaaggatggtcaacagcattagacatgctgacaaggaaccgtgtgcagcccagtgtcacctacagtcctggacatgtgggggcaagaaggtacacactgagctgtgtggttactgagctcagcgagcaccacgggactgaccttcagcatcaggcactgacaaggctcctgcttagcagcgacggtctggcgcttgtgtacctttatccggcagggacctacccagctggactcgacctcactcatgccctctggtttccctgcaggagccagagcctgcagggtgggatgtcgggacatgctgactcttccctcaagcacaggctgagctggcctggcgttcagacttgtgcggacactcctctcccacactaggacagcagagcagcttctggctgggcctggccgcggctggcggctgacacgggcactggacatggaccctgcgcacacatgctgtgcctccctggctcccttcatcaccccataggggctacgcgcacccagcccccccatgggcagccctgcggcaccagaggcagcgactagctgacggcgccctacccatgcccaccccagcctacgcggcagctccacggtcaccctgggcccatcgcaacactacttgcgggccaaagcccaagaccccaaccacatggggcatactcgaacaggcctccatgggcccatactacacgcggcgaaccaaacacgccactagcacaccgcgcagacgccatgtcgcctcggaaccgcaagaggcacaaggccagggcgctccaaccaggcaaccgacgcaccaacagggcaaccccaccaatacccaacacatggggccgaacactggagccataccctcaacacacccccaatggtcacccctggcaaacgccacctaccgcggacaaacagcccccaaacggtcgaccagggccaacagcgtggcgagcacaactcccgacgaggcaccacatccggcgggccgcacccacaagggacacatagtgctcaggggaggccccccaaaagcgggcgcaacagcaaccacggcacatacggcaccctcacccccccacagcgccgcccaccctggggcgcggccaccccagcacggacggagcacaaacgaaaagaaa

SEQ ID NO: 709955 - DNA, 152 bp, Homo sapiens
taaaaaactgggtttggccttgtgccccgggtggaggggcaaaaaaaatcccaaaaaaaaaaggcgagagagagagacggagaggacgagcagcgacaggaggagggacacacaaaagaaaacacaacacaagaacaaaggggtcccggggg

SEQ ID NO: 709956 - DNA, 105 bp, Homo sapiens
tgatcgatcgagctcggtaccgctgagctctgcagcaccagccagatggaacgtggtcatcgcctgcctggtcagtgcttcttcccccaggagccactcagtgtg

SEQ ID NO: 709957 - DNA, 142 bp, Homo sapiens
ggggggcccccccccggggggcccgggggggggggcccggctttttttttccccttaaaaaggggggggggggtggtttttggaaattaaggccccccccccctccgggcccccccccaaaaaacccctttttttgggggga

SEQ ID NO: 709958 - DNA, 132 bp, Homo sapiens
accttagcccaagaaggtcagtctgcagtgagccgtgacacatgactgcactctaggctgggggagacagggcgagattctgtctttaaaaaaaaaaaaggtacatacggtagcctgcttaagatccagggt

SEQ ID NO: 709959 - DNA, 350 bp, Homo sapiens
  misc_feature (5)..(5): n is a, c, g, or t
  misc_feature (35)..(35): n is a, c, g, or t
  misc_feature (129)..(129): n is a, c, g, or t
  misc_feature (197)..(197): n is a, c, g, or t
  misc_feature (295)..(295): n is a, c, g, or t
  misc_feature (301)..(301): n is a, c, g, or t
acatnccattgcaccagactcctacccatgatagngcccatggcttactactgactggaccttaagttacttggacccttgcagattaccctgggggataattaaggaccccaagcgggatctccctgncagccagccagcagacagcccagggtttccgcccgtgccctcatgttgcagtccactttgtgcatggnaagatattgaacacaatttccactgctcttcctgcagggcctcctttccagcagtcacttgctcagactgaggggtgcacctcccctgccattgacangtcctngcgccttcaggatgggctatttcaagcccgttttgtggctcttacacgg

SEQ ID NO: 709960 - DNA, 432 bp, Homo sapiens
tccttttggcgtctttgctactgagggcttggtctctagagggtctgcagagatgctggcacctcttgtgtgggcagcttgaatgctgacctccataagatggggcctgcggggccagtacaggccctgccatcagctgccctccaccagggccctctgcaaaagccttatgctggtgaccagccccctgaggaccaccctcgcccgacgtgtcctcggagatggcgctggccctgaccagctgcctgcagcccctcagattctgctgcgacttccgtccctacttcaccatccatgacagcgagttcaagtagttcaccacacgcacgcagtccccgtaagtgccgcctctgccccgcctcttgcccttgctccgcactgcctgtcgcccttcctgcacctccctggacctctggctctgcctcttctctc

SEQ ID NO: 709961 - DNA, 930 bp, Homo sapiens
agtgacagtgatctcatgcttaagtcatgggtgaatagtaatccataggcggaatcggagtgccatcattccacgtgtagatacgcggtgactagtgctggtagatatggagcacttatggttgcgtgaccaatgtttaggtatgtaagtcgaactaggtgatgagaaaggacagtgtgggaggtgcattattgatgatattttcttactattatgggaattggctggttggttggggaacgtataatacgttcaagtgatgggtttggttggcgggttcagtagttggggttgaactacgtattcgataagttattttatggaaaggaaaaaaggcttgaaaagggaaattccgtattgtgaccaatggaagtggggttgtggtacgggaaattggttaacctatgttggttgggggtgtcagaacacaggatttgattgggaagggggaattaagggtggcggaaggttgatgtgggacgttcccattttcgtaccaagggctatatttggcttaacctatggggggctgggagtgggtggagtgtttggggttttggctttaaatggtaccttataagaaaatcggaaattgtcggtgtaatgtgggtaccataattggattcctggcggaatataaggagaaagttaataaaatggtttttatagggacttattaaataagggtaattgcgtagaaataatttcttaaatacgttttatgaggtgaggataggtcttgaacacggtcggaagatttggacttattggaactaatctcacctgggggacttaaaggttggcgcgcgtgtagttgggaagtggccattgttttccatggtgtaaaaggagtgtttctccaagattgtgggcattgagtctcaattgaagttctactcagagtaaaaattaagaagaaaatggctaatc

SEQ ID NO: 709962 - DNA, 435 bp, Homo sapiens
ctactaatttctcttcctcttctacatcaaactaacctcaaaacatattatattttacacaacactaaattactaaccttatctcttatactattatccttaatcatttttatttccacaactaacctcctcttactccttcctcactcatttacaccaaccacccaactatctataaacctatccatttccatccccttattatctttctcatttattatattctttctctctaatattaaaaattccctatcccacttcttaccacaattcacacctaaacccctaatcccaatactattaattatctaaaccatcatcctactcattcaaccaatatccctttccttactcctaacctctaacattacttcattcaacctactcattcacctaatttaaatttcaacccaatcattttcaaccataaacctc

SEQ ID NO: 709963 - DNA, 108 bp, Homo sapiens
gcttagaaaccacaccgtgaagacgtgctgtctatgcagttatggcacattgtatggaaactctcatgatatgaaaaataaataaatctaggcaagtataaaatgcca

SEQ ID NO: 709964 - DNA, 131 bp, Homo sapiens
  misc_feature (88)..(88): n is a, c, g, or t
tgggaccagtgtgaaggtggaggagtgggtgtcgctgttgaagtcagaggagacacctggtgctcagtgtagccctggatgcccttgnagggggccctccgacgcctgcttcaccaccttctcagacactg

SEQ ID NO: 709965 - DNA, 368 bp, Homo sapiens
tacactctactctcaggaacccgagtaccaaactcatcggaaacatggcactgttgcctatcagaagtcaaaacaaaggacctgcccccagagagacaacacgatacagatatagtagagatgaagccatctattacttcaaggccaatagtctacttcaaaaactatgaaataaagaatgaagctgataggaccttgatatatataactctctacatttctgaatgtctgaagaaactgcacaagtgcaattccaaaagccaaggtgagaaagaaatgtatacgctgggaatcactaataaacccattcctggagagcctggtaaaccacttaacgcaatatatgccaaacctgcaaacaaacagga

SEQ ID NO: 709966 - DNA, 376 bp, Homo sapiens
ttgcttggcaaggccaagatcaaggtgacagcagggtcaatgtctgatgaggactctctccttgatttgcatatggcaaggccaagtagccccaggtgacactcgttttttttgtttgtttgtttttgagacggagtcatgctctgttgcccagcctggagtccaatgccgtcgtctcggctcactgcagtctctgcctcctgggtttaagtgatcctcctgcctcagcctccagaggagctgggactacaggtatgtgccaccacacctggctaatgttcttatttttagtagagacgggatttcactatgttggcccggctggtctcgaactccagacctcatgatccacccgccttggccttgccatatgcaa

SEQ ID NO: 709967 - DNA, 346 bp, Homo sapiens
gccggttaaaaccaagggcccaacccaaaagttggagcctttaaggccccggtttttcccgggtttttttaccttttccccaaatttacccatttccctgaaaattgggggtttttttggatttccccccttttaggagttatccaaaccttttggaatttgggggattcctttaagttttttttccccccaaaggattttttccccccgccaaattttttaatttgggaccccttttttcccccaaaggggggtttaaatttaattttaggcttttttggaccctttttttaattgcccctttttggggggttaaaattggtttttggaatttaaaaaaaaaaaa

SEQ ID NO: 709968 - DNA, 407 bp, Homo sapiens
gcagtgtcttcagaaggacatcagtactctaaaatacttgctataaactattttaagtatcatgaaacgaacaaaactcaagttccgagaagtgaaaaaaatccttgaggtgcagaaagatagtcactttaagtgactgtgaaaatgtacctcatgtttgaaaacaggtgaaaaacagattaaaccagatttaatactacttcaccgaaatcacacaactacttcatttaatctagtcttttcccaccatttccttttgagctctcaagcatatctgcctgtagcaagttctcatctgcacacttcctagaaaagccaaaagcaaattctctactcggaagaactgaggcccagaaggccacatcctgtgataaagccaaggacgcataatttccagtccaaggatc

SEQ ID NO: 709969 - DNA, 924 bp, Homo sapiens
ctctcccaccatgtgcagtctcatggggagaggcttctttcgtttcctcatcaaacatctgattgacgctgtgcgaaactgtctgaatttgccatgcaaggttgtcaacacaattagcatgtttttcagatgctttcaaatcttttttcaaaaaaatagtgtaaaatattttaataagcgcaaagccatgtggaattttcgtttagcatgccttaactgtagccgacacccccacaaccccgctatattattttggttgtctatttctcacagcatattttcagttttttgtccatttgacatcagtctgtggttatattgtagtcagtctagattactgtgtgggtatacctacgcccaaaattgttttctcattcacagcatgagcatattcagcaaatccatctgtggtgggaagttaaaactattatggtattaaagaacatccattcaccccaaaagttgttttacaggattacaattttaatttcaccaatgtccagatttgggctatttctgtatgatccaataacttatttgtcacagggcttaattgccattctggggatttgtcgactcatttgtctgaatttcacaatggtattatgtcactagctacccgactacggtatttcgcttataactcaatagtaccttaacacaaagtataactccgtagagttggcgaatattttagggaaatttcagcaaaatgcatgtacgttaagcacattcttatgacgactgtattcctggcaactttgatttacgcatgcccgttggcagttccacatatgataccctacttgcagaataacttaaaaccgttatgtcctcagggtgatggcttaaacgcttcactttattgtgccccagagagggacctgcacatcatcaagcctacgaagagcgacaagcaggaag

SEQ ID NO: 709970 - DNA, 1717 bp, Homo sapiens
  misc_feature (455)..(455): n is a, c, g, or t
tgttgtagtgagtatattttgtgtgttttatgttgtatagtgtgagttgttgtgtggttttgatatgctacatgatttgtacttgtgtgttgttatatactatactatagtattgtacttaggtgtgtgtgtgaattaggtgtatgaggtgagtatggtgtgtatgttgcagataattgtgtcgaatatgtagttggttatttgtatatatgtattagcatattctgtgtgtatgtcactgataggttctataacttttgtgatgagtggtgtgttactgaaatagtggttaacaattatgttgtgtgtatactttatgtattgtaattgtgattaagtttgttaggttggtggatgtatgtgctacacgattgtttggtatagtgggggctgatataagataatagtgtagtattggtattatgttgtctatctcaatatatttgatagattgngttatattgctgatagcattaatcataatttatgtttctaggttccactgtctagttatgtactctacatagtgggtggtgtggtgaggtgattggattctaaggtccatcttatttgtatgttgggctgaatatagagtgtggtaggtaataggtgtatttcgctgtatgtgtgtggtttatatgggtgttttatatgagggcgtcaagtaggtttggggtgtattgtggagtattgaattgttgtctatagtcaaatattgtttgtaatttgtgtgtgtgttgggtgttgcacaatagttgtgggaggtagtaaggtataaattagatgttgggaagctccaagacgtcaaattgtagggggtcattatttatctggttgtttactattctatgagtgcatactatattggtattggtgataccagttgtgtccacatggttcaatagtcaacgatggcattaggatcacaaatagggtgagttgagtgtgctactagaggtcaatagggtgcctacatgtggtttcacatcaatatggtggtggcaaaagtttcaacataaaggttgagtagttcgtagtcgtgtcacatgtgggatcaagttgggtgttggggtaattattctgtgtgggggttttagtcaattggtgagttcaagtgggtatattctaattattatttttgctatatgttcaaattttttgtgtttgaattcaattattgattggtcatattgtaatttgatttgtataattgtggtgaaattgtcacatggatttgagtaatattctatgttggtggctacatgttgcatcatattgtgtgatctattgatacaatctttggattcatcatttgcattgatacaatttgtttggtatgcaatgagtcagtgtgtatgtcacaatagtggcagcagggggtgcatcacatggctagtggggtgtcacaaagcaggcagtatgagtcacatggtcagttgtcaatgcagttgattgatcatcagtcactacatgcatgtagtcacaggtgtgggatgtcagtgatcagcacacaatgtgtgtataggtgcacagcacagggcacaatggcacagcacagtgcagtggggtggtcagcacagtgtcacacacaggatgcacagtcacagcagtgggcacagtgtcacacaggatcagcaggcagcaggcaggtggcacatcaggcagggcagggatggcaggggcagcacacagcagtggtgagtcatgaagttacaca

SEQ ID NO: 709971 - DNA, 784 bp, Homo sapiens
  misc_feature (406)..(406): n is a, c, g, or t
  misc_feature (426)..(426): n is a, c, g, or t
  misc_feature (658)..(658): n is a, c, g, or t
gggggtactgattattctagcgaaggggcgtggctaacacaatttccttaaatggctatctaactgtccgttcctacctgaagcaagccatgcaaactttttcgataaagatgctttcctggaaccaaaatgagaggatggctctattcagctgagacagctccataggaatctacaaccaggagactatgagtttctaaacatatatttaccttccacaggttttgcctctggaagcctaaaactgctttccttgcgtttgagacactcctctgaactgcatcctttgcggaagatgctatatactccagcagttgtaagccactactcgtgttgaccttaacataagagtttatcctgtgagatgtacgttgcatatataaataaaatgacattgttgtctgtncggatattatatgaccaaangagtcatactttgccggccgctttgtcaaacaaaattctacactggaacaagcttatgcatggggccggtttctgacgcaatttggccattgttgactttagggtagacgtttaaaaggcactgacccgcgttttacaacggggtgactggaaaaacccctggagtccccaaattaattgcgtgggcgcgaataccgatttccccagttggggaacttaagaaaaggccccnacctatagcccttcccaacaagtcggcaacctgaatggagaaagagactggaagcctcaaaatttggggaaattccccttaaatattgtttcactttttttccaagacccctcggggagagccttt

SEQ ID NO: 709972 - DNA, 522 bp, Homo sapiens
  misc_feature (212)..(212): n is a, c, g, or t
  misc_feature (394)..(394): n is a, c, g, or t
  misc_feature (453)..(453): n is a, c, g, or t
  misc_feature (465)..(465): n is a, c, g, or t
  misc_feature (475)..(475): n is a, c, g, or t
  misc_feature (496)..(496): n is a, c, g, or t
gaattcggcacgagaaaaagtctatttcatttgctgaacactaagctaactgaacagggttagaagttagctcagtggccacatatgccagagaatatagacttttttagaaccaatcaaggaaagtaactgaatgaacaggagcaacaacaacaaactgtgttgtggctgtcagaaaatagattgagagagctgccacattatattatttnaaacatctagttttcaatgaaaagttatgagtcacacaaagaaagagaaaagcagtcacagaaaagaagcttaaatagcaagtggaaaacaattcaagatgtaaaggggaccttaataacgttgaccagctgacttctttcagaccctatgaagttcagggggcagtaacttgcataggcanagtgttaacgggaagctctttagccaattctccacttgccaattttctttacctggagnaggatttgggcntctcagttancaaatcagtatttgccatgcngtatccctcaaagaacatttaagaga

SEQ ID NO: 709973 - DNA, 146 bp, Homo sapiens
ccattacccacctcaacaacaacttcatatttaggcagaagctgaatctctctttctccaagcagacagccatcatgcctggacaggcatacggttggaagacgggacattgcagatacaaagacttcagtaaattccggaacaat

SEQ ID NO: 709974 - DNA, 186 bp, Homo sapiens
gcacacggagaacgacaactgctcacaggacgtgcgtccggaggaaagttgcggtgagtgtcagaacagcaggttggcagcgacgaagccgagcagctccgcagcggcctcttccagctcagcagctcgtcggcgtggcagcccagccacagcaccggtccccgagcagccaggttaccgcggccc

SEQ ID NO: 709975 - DNA, 100 bp, Homo sapiens
agaaaaagaagagagagcgagaaaaaaaaaaaggaaaaccgcaataaaaaaaaaagcaaagaaggatgaaacaaaacagacaccaaacaacaacataaga

SEQ ID NO: 709976 - DNA, 573 bp, Homo sapiens
  misc_feature (557)..(557): n is a, c, g, or t
cgttggggctcattcagggtaatacgactaacacaattgtatgggctcattagtctgggggctggggcagtgggacagcaggggccgttgcacagcaggggccgggtatctggtcaaggggcctttggctgtgtcagtccagggcagaagaacaaagagaaggtgagagaagaagaggggtggggcttgtcctttgatggggaagctgctcatgtcataatacccattcgtgagggcagagccctcggggcctaatcacctctccataggccgcctctgatgcatgggggattaagtttccagcacagggtttgcgaggtcacactcagaccagggcagcctcttagggggggcgtagccttagtggagtaactcaccttccggggcccaaattttctcttccaaaggggggcggctagggcctgcctcttagggggtgaaggagccagtatggcatggatatgcccagcagggtggttgcactatggggtacttacccgggggggacccgttaccggtcacaaaagtggggctctgttctgatcgagccaggcggntgagtgagctggctga

SEQ ID NO: 709977 - DNA, 753 bp, Homo sapiens
tatatgtcccctgcttgaaccctgaaggccaggtaatgagccatggccattgttcccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaaaaaaaaaaacaataaaaaaaatagtaatctaaattagtgcataatcagtattattaaccatatacggtaattgtttactattaaatgactagttcttaaacactatatatatatgtgcaattcttagctttaattcatcttaatcgctttgtttgcacatatctatttaagtcatctggtttatttcctaatttcccttatctcttcatatttctcaacagttctcgctaatttttgtgcctattggaaattctccactcttattgctacgtttaagcgtggtttcttctttacatatttcgtattcgttaaactcttgtgttatccctgttctcttcttcttattattcttagttctcctcgatgcgttcttactgtattgaatttctctggattctcgcgttctcacattaactggatgtatattatactttctattaatctattcacgtttcattttgtttttcctctcggtcattcttttcg

SEQ ID NO: 709978 - DNA, 802 bp, Homo sapiens
  misc_feature (336)..(336): n is a, c, g, or t
  misc_feature (522)..(522): n is a, c, g, or t
cgcggtgggtcaggcctgtaatcccagctctcaggcaggctaagaggcggaggatagctgagcccaggagtcgagactgcctgggcgcattatagcgagcacccgcttctccacaaaaaaaaatgcattatgaagtcatgaaaaaagcttttttgacgcgtttggtggctgaggagaaaagtgttttagaaaccattgcagttggcgcgcgcgggcccccaaggttgtgcgagtccacagtggccatagggattactccgagaggaaacccgggcgtagtgaaaaagtgggggggttcttcgccgtaatggaaatacccgccgaggggggaccacncggagggggaggtttttgcaacacaacgctccaacaagagggcaagactagagggccgggcacaaacggggactcttagaccgaaggagggccccatggttgatctcttcagctttgcatcattgtaatccccgcgagtgttggagaataatatcgttcaccattgaacggtcagcctggtgaacncggcgcgaaggagtctcctcattttgccacatcatgcctgttgtccgaggagcttaaccagtgtagctggcgcaggatatttgcacacacgaagttcttaacaatggacaaatggttaccttccgactgcatagtgggcggaccagacatgtattttcgggacaccattcgtggtgctgttcccgcacagcgggatgcgtttgccctgggataatggggcacgaaaggagggggtgtgactggcccctgacagttgatttttgaaactcgaaagacccag

SEQ ID NO: 709979 - DNA, 276 bp, Homo sapiens
atctcgatcgagctcggtaccagttctggtccccactgattcagcacctctcctgagtctgacttcagtcctggcattacagtgacatacttgctgcctagaagcccgaggccaatcttgacaatcccctctctcttcttaccaaggtctaccaattcttcctttaaaacattaactttttttccctttttcctatactccaccctggtttagtcctctccatctctctccaggttatttgcgaaagcttccttgagttgagtaccacttcttccc

SEQ ID NO: 709980 - DNA, 841 bp, Homo sapiens
  misc_feature (1)..(1): n is a, c, g, or t
  misc_feature (62)..(62): n is a, c, g, or t
  misc_feature (64)..(64): n is a, c, g, or t
  misc_feature (74)..(74): n is a, c, g, or t
  misc_feature (133)..(135): n is a, c, g, or t
  misc_feature (142)..(142): n is a, c, g, or t
  misc_feature (192)..(192): n is a, c, g, or t
  misc_feature (212)..(212): n is a, c, g, or t
  misc_feature (223)..(223): n is a, c, g, or t
  misc_feature (252)..(252): n is a, c, g, or t
  misc_feature (262)..(262): n is a, c, g, or t
  misc_feature (264)..(264): n is a, c, g, or t
  misc_feature (274)..(274): n is a, c, g, or t
  misc_feature (277)..(277): n is a, c, g, or t
  misc_feature (293)..(293): n is a, c, g, or t
  misc_feature (295)..(295): n is a, c, g, or t
  misc_feature (299)..(299): n is a, c, g, or t
  misc_feature (303)..(303): n is a, c, g, or t
  misc_feature (310)..(310): n is a, c, g, or t
  misc_feature (316)..(317): n is a, c, g, or t
  misc_feature (334)..(334): n is a, c, g, or t
  misc_feature (343)..(343): n is a, c, g, or t
  misc_feature (348)..(348): n is a, c, g, or t
  misc_feature (389)..(389): n is a, c, g, or t
  misc_feature (708)..(708): n is a, c, g, or t
  misc_feature (734)..(734): n is a, c, g, or t
ncacctcattcttcctctctcgctttctttgggctgtgttctgtctttcgtttttcgttttncnctcagttggnactttgcataatacatctcaagacatccccccttaagtgggccgcctgtgcgggggggnnngggggtngggggatttcccaggtacatacaatatcatgcatttgagtcccccaaagnctgaggggggggcgccctgngcttgcttgcngtcccctcatattgcgcaaggtaaaatanaatgtctggngngcccatgggngancccgttctgttttggngntgcnattnacatgcnttttgnnattgtcatatggcttanccttttgcnatggnctcaaatcttagtcactctgggtgacttcctttactatggngtgtgaagtgactttttctacctttttagtagacactagtttctcctcaaaggtctcttcatgctcttcaaccttttgagtgacggttacagatttagtgatgtatttggtagcaccatctcccccctcactggtgattttttctaccgttttggtcaccaccactttctcctcacttttatcaccccccttcttttcatctgctgggctcaagtctaggccattggtgacaacgcctttctcctcttccctcccactgcctttttccttggtctcctgctctacctcctcttttccttctacctccccattgacagcnatgtcttccttcctggatcccttggnacctttatcactcccttcctcctcacttcctccctctcctcccgctttctccttctctttctcctgctgcagtggcttccctcttctttggtctctttctccaagtg

SEQ ID NO: 709981 - DNA, 228 bp, Homo sapiens
tgagcgtgacttaacccttgacggccgtggcctttgatcctgatagagatctgccatctaatcgccaacaagagtctgttctgtaagtcttatgacctctattataacattgatcttgctcagattttgtgtctactcaactggatacatttgagttaccacaaaagagggagggtataatgaggtgtgtctgacctcccatcctgtcctgaccaggaactcagtttt

SEQ ID NO: 709982 - DNA, 822 bp, Homo sapiens
agcggagcttctccctcccgcagctccagtgcccgagcttcggctctcccagttccccaacccaccccttcccctccccgacaagccccgctagagcccagtggagaccctcgatctgacccacaaccaaacgtcgtttctcctccccccaggtccccctagcattggggtccacgacagcccgagtggacccaggcgcctgagcacggagggtaacgccaaggccacacccggggcccgtttcgggcacccatcactccggggcgacaaacgaccggcttgagaggaccggaaggcgccggaggcagaacagcgtgacagaaacaaaaaagaaggaaccgccggagacagcgagggacacgaaaggcaggagcatggagaccgaaagggcgaggctgtacggacacacacaagggcagcgaccccaacggaaagccaccgcaaacatcctggcgcagcccgatcccagattcccccacgagaggaggccagcagaagacatgaggggacataagagccggaggagacacgaacagacacaaaagacagcaagggcaaaagaacaaaagggaaacagcacaacgcgacagaaatacgcacacacaccaaaacacagcagactagcgaatacaacagagagacacacagaacactcacggcacacacagacatcaacaacaaaaacaagaaacacgacaggacacagcaagagacaccagacgaccgacagcagcagaaccacaccacaatacacacacgcaggacgcaaggtacacaccagaaccccaaacagacaagacagctcctatagacgtgcgcgtc

SEQ ID NO: 709983 - DNA, 326 bp, Homo sapiens
ctcccccctttattattcatgcattggaagttaatttctggctgggcgtggtggctcacgtctgtaatcccagcactttgggaggctgaggcaggcagatcacttcagccaggagttcaagaccagcctggccaacatggccaaacgccatctctactaaaaatataaaaattagccaggcctgggggcacccgcctgtagtcccagctacttgagaagctaaggcatgaaaatcgcttgaacccaggaggtggaggttgtagtgagccaagattgcgccactgtacttcattcagcctgtgtgacagagcaagatcctgtttcaa

SEQ ID NO: 709984 - DNA, 649 bp, Homo sapiens
caggaggctgaggcacaggaattgcttgaacccaagaggcagaggatgcaatgagccaagatcacaccactgcactccagccttggcgacagagggagactctgtctcaaaaaaaaaaaaaaaagggtgtgcccaggccccttagccattggccagtggtgcccagccagagagccaaatttagagggcgggctttcccttattcacacagaattaaagtgctagtgtgctagccaagtgattccctttgggctttaaaggatactcgaaaaatactggtggctcccttttggctcattctccaggtgacattcgtgtttctcataagcaggctccttttctaggggagggaacccaaagggggctagggttaaagaccctaattagaacatggtttttctctaatcctcagggatagagtctgggaagtggtcaccatttcacaggtcacacccttgggggagtggcgctgggtggagacgctgggggacaagggttcgggttaactacattagggcccattgataacgtggccttaaacgggtgatccttcggggtaggataagttaataataaagggaccctaaagaattgcaaggggctttaaaactggcagtaacgtggtgtccttaatggaagcaatacccaa

SEQ ID NO: 709985 - DNA, 186 bp, Homo sapiens
  misc_feature (21)..(21): n is a, c, g, or t
  misc_feature (39)..(39): n is a, c, g, or t
  misc_feature (43)..(43): n is a, c, g, or t
  misc_feature (155)..(155): n is a, c, g, or t
aaaggagcaagccaaaacctnaaaccggcgccccttggncggncgagcactacagccagggcgccgggagccagctagctgcccttcccccagcccgaggactctggggccacagggtgtcttccttcagcccatgcgcacctggtccagcaggngcagcagcagggtctctgatggcagccggtg

SEQ ID NO: 709986 - DNA, 789 bp, Homo sapiens
atgatacccactacagaggtatgtggcggtcccctgtgtctaaagtggctcgtaggggctatccaagggtcaacacaggcaacctgtggacttcagtaggtacatagattgctctgtccttccaggactgtcacaaggcgtcccagagagactcgcctaataccatgcagctcacagtcacaccaattcctgcggttaagtaatggatcagagcataatcgttccgttcagcttcaggaggtgtgggtgaggagagtgagtgttgtcaagggggccagactttccaggctgatttgccaaagtgccgaaatgaaactctagcataagaacttacggctaacatacgaggacattaaaagtagcgagcacctcagtgtctctggggtacatggttcaaggagcttccaactctagcccagccatagtgagtgggcacgccataagccatcaactaggaactccgaacaccacagaggtccaggagtgatctcgtgagtgactctaacaaatagatcaggacacatggggtacaaagactaggcttgatctgcttcaaagcttccctggacctgaagccagacagggcagaggcgtccggctgacaaatcactctccgactgatgagatccctggaggatctccgaaatcctcgctgctgtacaggactggacggttgcgcacatacaatcgctgccaccctccacttcccaacccagactcggaaagacacttagcacaactagcgcattggggaattgtgtgtattttctagcacttgtgtactggtta

SEQ ID NO: 709987 - DNA, 208 bp, Homo sapiens
gccatgctaacattgcagaggcgtgggcactttgttcatggcaggcacctcacgctttctgtgttcaatacaccataatataccctgacaaggagactccaaatgcatgttttaaaacaagttattacatttgatataccatttcttatatttaggtaaaacattggtctatagatgggggctgccagctgatagctattgaaatgtg

SEQ ID NO: 709988 - DNA, 1738 bp, Homo sapiens
  misc_feature (1371)..(1371): n is a, c, g, or t
tgcaaaaaaaaactcatccgcctgaatacccagcactgttaatccttacagttcttctgtgttccccacagaagtcgtgcttaaactcttctccttctttctgtgagttcactcctctttctttccctccctcgtgggtgcgtgacagaacgtggaggtgtggcgcccttgtgcacggttttcacagggtgcgggggtgtgaagatgtggatatttagtggtataagaataacgcctcttgtgctccatttttctcacacaagaacatataatctcccggtttctccttctcatgtagaacaatctgtagagacatatcgcctctcttaactacacgcgagacacttgggtctctctccacagacacacgagactcttttatcacacacactgtgtagggacaacacactatgtgaaactctgtggaggtgtctcttgtgagagtagtgtgtgtaatattggagacccagagtgttgcgtgacttgatgagagagtctcacgtgacgctctcgcgcacaatattacacaccaagcactgttgtgtgtacacacagagagtaaacaactcctcaccacaactgtcttaaaggattatctctatatctacatcacccgcaggagagctgtgttgagcaaattcacaacccacagtgtggtgggagacactactcagcgaagtagtgtgagacgaccattatctgtgcgacgtgtgaaacagagacaacgtgtgtggtccaacccaacccacgcagggggtaatcacccaaccgctgttgatataaaggactagtcaaattatactagtgaaacaacagtagtgacaatagtgacatcacatccctagtagaaaagaggagttggaagtgtaaatcccccgacaagaaggaggagtttatgacccgctgggcacagaagctcaccactatataagacaaagcagcccaccttctggatcctataaccagacaagaaacagaatttcacacacacacctgttgttgtggaagcagaacagggccattaatagagaattacaccacccaaacagttgttgatgaacaccgcccccaactaataacaaaagcggcgtgcggggcaccccctctctagacaacacgcttcttatgtggcgagaacataccggtagggatcagtatcacgcacactaatactaaacaaacacgccataatagagagaaggcggtgacaaacaaaataatctgagaacgacacacactaagtcgcaacacatatcacaccaaattaacagtaataatcgagacaacagtgacatagatacacgatatagcagcaccccccaaagatgtagttggtgtgtacacaggaaaaatcaaatattagtaactccncaccctggtggcacgacataagacgaacacacaaagaaggttcataacataaaggagaatcaactgatgaggccacaaagcacacagcaagaacaattggggccactaatagccacaaacccccacgtacgatctacacagacaactgctgagccagatccagctcacgttagaaccaaccgaccgtctaaccaacacgcagcgacagtacagcaaacatatactgcagcgcagaatgtaacctcaaggacaaacaaccaacaccaaaccagatgatatgagcaagaaaacaacgcgccgaggataaactaccacacaaacacgacgacaccacaacactgaaacaagagcaggagaacaactatca

SEQ ID NO: 709989 - DNA, 491 bp, Homo sapiens
gaattaaccaggataaatacatgaaagatatgactcttaataattcagaaagctgaaaactaaactgctttccatggtaaggttgcacaggttaattaaaaaccgcagttacctgctgttgtgattatcgcacccttggcctcttgttgatttggggccatacgcatctgattattaaaattgaaacatcacaataatttttacttcatgcaatttggaagattaaaaatactggaagatggccgggcacagtggctcatgcctgtaatcccagcactttgggaggctgaggcggtcagatcacaaggtcaggagatggagaccatcctggctaacacagtgaaaccccgtatctactaaaaatacaaaaaattagccaggcgtggtggcacgcccctataatcccagctactcggaaggctgaggcaggagaatcgcttgaacccaggcggtggaggttgcagtgagctgagatcgcgccactgtactcc

SEQ ID NO: 709990 - DNA, 224 bp, Homo sapiens
tcgagctcggtacctatttgggaggctgaggcaatgaattgctgaaccagcaggtggaggttgcagctagccgagacatgccctgctaattttttgcaggtttcaccatattggcaggctgatctacaaactcctgaccttgtgatcttggtcgcctccggctcccaaggttgtaggattacaggagtgagccacaggctgggcggaaaggaaaggggattctc

SEQ ID NO: 709991 - DNA, 545 bp, Homo sapiens
  misc_feature (320)..(320): n is a, c, g, or t
  misc_feature (434)..(434): n is a, c, g, or t
  misc_feature (455)..(455): n is a, c, g, or t
  misc_feature (466)..(466): n is a, c, g, or t
  misc_feature (481)..(481): n is a, c, g, or t
  misc_feature (512)..(512): n is a, c, g, or t
  misc_feature (538)..(538): n is a, c, g, or t
tcgtgcccttgcactccagcctgggtgagagagtgtctcaaaaactaaacaaacaaaacaaaaaactacacataaaataatttgaataaatcgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgnttcacatgtgattttattggacctttgaaggccaacttgttcccctttggggaatggtgtgtgaccgtgcaagtaacatagcacgaagtggagaatccttccacttggcctctnaattccataacttctaacttntgccaagggcnttggtccattctggnaagtttcccccttttttggactccggggganacctgggggggaacctttaaaagccnccttgga

SEQ ID NO: 709992 - DNA, 636 bp, Homo sapiens
ggcgtagggcgctgtgcttgaggttgggggttgcgtcgctctctggtaaaggcgtgcaggtgttggccgcggcctctgagctgggatgagccgtgctcccggtggaagcaagggagcccagcctggagccatggccagtacagtggtagcagttgtggactgaccattgctgctgcaggggattggcaggccgttaacgtttgtgcaaagccatgaaagcatatggagcctcaagtaaaaacaagttttttcaaagccttaccaaaaatctggccttcaggtggtggctatatataggaggtggggttgtgaaaccccagaaatgacaaaagtggggaaggcaggcattaaatacctagggttgtaaagcccttatttgccaaataacgggggaaccactaagagatgctcatcgacgaattatgcttttaaatcatccttgacaaagcgaggatctcctttatatagcagcaaaattcaatgaaggctaaagatttactagaaggtcaagctaaaaaatgagtacactgtttgatgaatttaaggtcgaataagtcatgtatatgagtactaagttttataataaaatggctcagaagctacaattttaaacaactgattttaggcacaagctaa

SEQ ID NO: 709993 - DNA, 331 bp, Homo sapiens
ccccctccccgggtatcttatacacacgcaggcttattgttcagaatagataatttacgaactgtagctcctctggggtcaacgaagggtttaaatttaaaggaacagggtcagtgacaagacttaactgtaacgcttctcggacttcaaattgattacatcacggcccacttcggaaaccgcgcatcagtcagaattggtagttccacaaccttttaagttgaattttcactccctttcagcaataccttcctagctcgttaatacacaataataaggtttacacggacgaacactaattgaaattatgcaactagaagcatctcgttga

SEQ ID NO: 709994 - DNA, 220 bp, Homo sapiens
  misc_feature (31)..(31): n is a, c, g, or t
  misc_feature (100)..(100): n is a, c, g, or t
  misc_feature (114)..(114): n is a, c, g, or t
  misc_feature (149)..(149): n is a, c, g, or t
  misc_feature (196)..(196): n is a, c, g, or t
  misc_feature (198)..(198): n is a, c, g, or t
ccaccacacccagctaattttttgtattttnagtaaagacacggtttcaccatgttaggtggtcctaacaaactcatctacaagaaaggtaaggaatggngtgcacatttcaanttttaagtttgaaaaagcacaagagaatctgcttntttttgcaatgtctaatctgtttaaaaggcatctttcacagagagtntnatttgggaatatttgcagagtt

SEQ ID NO: 709995 - DNA, 214 bp, Homo sapiens
  misc_feature (12)..(12): n is a, c, g, or t
  misc_feature (33)..(33): n is a, c, g, or t
actcagctaacnaggctggtcctgtgctctcgnacttcatctcaggtcaggagagagcacttgacccaactctgccagcgacgcacagtaatggtgattcacgtagtgtggttccaggagggaaggtagggggcagacaagagtgagtgcgctatagagtactgggcagcgtctgctgtggtcccaggcactgggcccagcttatgaatgggtt

SEQ ID NO: 709996 - DNA, 287 bp, Homo sapiens
  misc_feature (10)..(10): n is a, c, g, or t
  misc_feature (48)..(48): n is a, c, g, or t
  misc_feature (58)..(59): n is a, c, g, or t
  misc_feature (144)..(145): n is a, c, g, or t
  misc_feature (205)..(205): n is a, c, g, or t
  misc_feature (207)..(207): n is a, c, g, or t
  misc_feature (214)..(214): n is a, c, g, or t
  misc_feature (227)..(227): n is a, c, g, or t
  misc_feature (229)..(229): n is a, c, g, or t
  misc_feature (235)..(235): n is a, c, g, or t
  misc_feature (247)..(247): n is a, c, g, or t
  misc_feature (265)..(265): n is a, c, g, or t
  misc_feature (285)..(285): n is a, c, g, or t
acagatttcnccccctagcatgaaattccaaaaactttaacaattacncataagtggnncttgagatgacattttcatcttggacagtttgaattctaaatctctagttcacagtgaatcgttttttaaatttttactgatggnncgttatttttcacaaggtactacattcttacaatgtaagactagatgggccaaaattttnanaaaaacntcttgccttgttntnttaaanaacatatatatnctatttgttgtatatacncattagactattttaaaatnac

SEQ ID NO: 709997 - DNA, 876 bp, Homo sapiens
  misc_feature (737)..(737): n is a, c, g, or t
ttggggtctccctatgtcacccaggctggagtgcagagatgcaatcacggttcactgcagcctcaaattcctgagcttaagtggtcctccctcctcagcctcccaagttgttgggattacaagcatgactaattatgcccagcaatggtcttgttacatttcctgaagataaaagagaagcatgaaactagagcttggtacactcaaaggctatgttctccctcaggactcaagatgaattactggcagaattcctcactacatcctttaatggaaacctaagtaaacaaacaaaaaagggtttggccaggttactgtagcatttctaattactatcattatttttataaagaaagtgaagttcacagaggttaagttattagtccgcagttaacactcaacaagttaaagtaaccatctatcaggcactgcctggttccttaattgtctctttttaagaagatagtgtattcactcccattttatagtttcaggcccacctatgctttgattttaactctttccttagaaagataattaacttgacagtgtaccacttcttgggtggacactgactcagtgaaatgcggatattttgatatgttgctataagtctgtgtggttctgcttatgccattcatcaacttctatatccacttgcaccggagaaggcactaagattctgtgcctgtccattaagatcttgaactgggaggacactcccacgcgatgaccanatcaggtattgactttttattaataagtgttatttcaatagcgcaccaaatttatagtttatctcctttcttctctctagtcacaggcgaaatagttttctacctcagtcccgtcgctatctaatgtgaattttacttg

SEQ ID NO: 709998 - DNA, 293 bp, Homo sapiens
agattttatggttccaatgaaatatgtggggttatataagatagtaaaaataatcagttacgggtatctgtcacatgacctttgtttccttattcaggaagataaaagtcagtaacctaccccatgaagatattgggggggagtaatatcagtgaagcagttgggtttatattcttatgttatcaccttccaaacaaaagcacttacttttaaagggaagttatttaatttatattagactcagagaatataatcttgcactactcagttattacggtgagttctcttattcc

SEQ ID NO: 709999 - DNA, 101 bp, Homo sapiens
ccctgtggggccctttacttttgggattttttttcttaaaattttgaattaaggctttttttaaagttttaattaagttgtgaagttgcctttcccctcca

SEQ ID NO: 710000 - DNA, 189 bp, Homo sapiens
tttagtcaaaggccccccccccaggaagcatggatggggatgaaggcacaggggtttccaacctcaaaggccctttgtggggtcaggacacaaagtgggagggagacttatgcaggcctaccagtccctggctttttgtttggggctggaataaaaaggtgccttcagctggtgggccgaaaggcagga

SEQ ID NO: 710001 - DNA, 409 bp, Homo sapiens
agcggaggctaggatgttgaagagagctgggaggagatgccaagaacactaggctgcttcctaccatctagctttacaggtccaacatgtggagtaaccaccaagtacaaatgaaaaaagcccatcaaatgtgtccaaattagtggaatatcctcggtctactgagaatcgaagttttctgttaaagacagaacagcgaatatgcatattgactattctgaaccttgatagctgattttctcgtatcacacgaattcttacgacggacaggggtcggtgatattcacgaagcgagagacatcagtcatcgtgggtgatacaggttcgaatcaagcaggaaccggtcgatacttgaaattaaatgagaatcaataaatgctccccagatgcgtatctctggtatatgata

SEQ ID NO: 710002 - DNA, 1015 bp, Homo sapiens
gcttttataaaattaagtaaccacataattaagtagtcgtagcccgttgtcccttcaagcagatctagtctttactttcagtggtctgttaggtccattctgtgtactagacggatgttaataaaaagctatgacgagcctgacatgacattctcagccaacactttaggtcttgtctctcagtcttgcattggacttatgttcctaatattcttattagaagtggattcatgtctcacaatacgctctacggggatgagagaatttgcacttactttgcgccagttcgctatagactgtgatgtagtcaacatccctatagctgttaagctcttcaaggcagccacagaggccgccattatctccgtgctgcgatgtaatttttctaatggttgcttgcgcagcactctgtaccctgtggagatactcgagtacctttagtcttgatgttggctgacaagacctgagcatcaatcctcttactctcaaagggccctatttaaatcgtgttgcacaaatccgtatggtatttatgattgacttcttattcttcgatataagcctataacgactactcgtttactccacacaattgattaaatccttaatatggagaagcaatctcgtcctagtcctttcatatacagtgatcgtctctagtatgaaactatcaaatcatcctttctatcaagcgaatttacaagaattcttagatattgagacccatatactccacagtgggacgtactggtaccaaaatactcactgggggggtcgcctcaagctacagattacccaagtttattaggctcaattcggggccgagaaaaagagccgtcagtagttcaataagacacatagtcccggcgatggctcgttcctaattccgttcaaaccccgggagaatcattgacgcgggttgggcccatctttcggagaaaggaaccctaaatccctcggggtgtaaccttatggggaccaactacctagaggagattaaacgccaagggaactg

SEQ ID NO: 710003 - DNA, 308 bp, Homo sapiens
  misc_feature (64)..(64): n is a, c, g, or t
  misc_feature (66)..(66): n is a, c, g, or t
aagaacacagcttccacagtgtgaaggcggacccgagtgggtttccaatgctggctggggcaangnagtgggtaactaacccacttgggtccttttccgtgcgggggaggctttgttcttttgccctttgaaacaaatgttgctgcttactccatgagtccactgcttttatgagctgtaacactggctgcaaaggtctgcagtttttctcttgaggctggcgcagaccacgaacccattgggaggaatgaacaattccaggcggtaggagcgaacaacttcagacacgctgccttaagagctgtaac

SEQ ID NO: 710004 - DNA, 112 bp, Homo sapiens
agctcctcagcactcgcatgtgcctgactcttccatgtgacatagtggcgtcacgggttccttcctcagcagtcgcatgttgcctggctcttaccatgtgacatggtggcgt

SEQ ID NO: 710005 - DNA, 460 bp, Homo sapiens
  misc_feature (400)..(400): n is a, c, g, or t
  misc_feature (430)..(430): n is a, c, g, or t
tggatgtgtgggtacttggggggacggaggagctagggactaactgtgctcttggtgggcttggagggactaggctgaagatgtgtcttctccccgccacctagctgtatgacaccacattcttcactagagcagcgtggggttgtgacggacatatgagaaagcagcgctattcgagtagctagaagggaatatgaaaggtagaagtgacttcaaggtcacgaggttcccctcccacctctgtcacaggcttcttgactacgtagttggagctatttcttccgcccaagctaaagcgcagagacgctttgtcgcccgtgccattcctgtgagcacatagcgccatgttatcctgggtagttccttggggctttgggcatcgttttacgctcagcgaagngtagaagagatctgtgcccatgggtctccngcttcaatcccttctggtttcagtgacata

SEQ ID NO: 710006 - DNA, 362 bp, Homo sapiens
atagtagtagtagtaaagatattcattaagcagctgcttatcgcatagctgaaccagctccggcgaaaagtactgcatcgccgtcttgcgatacaggtccggactggcgatcaggcgctcggtgacatcctcgccgcgtacggtgaagtgggtaaaccaggagaagtggttcagcccgtagcactcgacgccgagatcgcgctcgtcgcagccgaggatctcgggcagctcgcgaatcagctccgacggggcatcgcagatgccgtacacccgacgcttaaagccggatttgataatcgcctcggtgaccagccctgacggattggtgaagttaaacagaatggcatcttcggcgggtaccg

SEQ ID NO: 710007 - DNA, 460 bp, Homo sapiens
  misc_feature (18)..(18): n is a, c, g, or t
  misc_feature (45)..(45): n is a, c, g, or t
cgagcccgggagtcagangtgggtggtgccggcggtgaggcttcntggacccccaacccccaccccagctgcggctgctccctggtgtgcacctgaggctgggctgatctcagctgtacatccgcaaacttcccggtgaccttgggctaccccaacgtccacctctgggcctcagtttccccatttgttctgggtgtcagccgggccacgtcctcatcggcctgaaggaggaagccacaggcggttgtggagggggtaaacctgacacggggaggcttaagctggagttgaggggggtcataggtgtgacccctccggccccgcgtccgtgctgacgtggcccagccaatggcagagcagggcagagccgggtggcgcctggcccggcatccacactcctggtgagctctgtttgttttcataaccaattcaatatttaagacccggccagccgcggccg

SEQ ID NO: 710008 - DNA, 233 bp, Homo sapiens
aaagagcggatcatatcaactgaccccagatctccccatctcatatcatcagacacactgcgaagtacaaagatgccattctctacagtcccccaaagtcatataacactcctttcagcactttactgaagtatccaaagcccacagtcttatctgacacaaggctgcagtcccttctgcccctgagcctctgacatacacagtacgttaactactttcaaggtacaatgagc

SEQ ID NO: 710009 - DNA, 108 bp, Homo sapiens
ccttaagcatcctaacagagagacatcttgtgtctgtgcgtcactcgggtggaaagtcgacccagagtgcactgtgtgcattgagagaggcttggctgcgatccgcgt

SEQ ID NO: 710010 - DNA, 121 bp, Homo sapiens
agcggcatctttactaatagacgcggcatctttactaactgtgcggcatctttacctaatgagcggcatctttactacatgctctttactacatgaaccggcatctttactacatgacgcg

SEQ ID NO: 710011 - DNA, 107 bp, Homo sapiens
tgtgagaagctccttcaagacgcctataatgctctgagagcttggagtgtgtgcttctgttactcagctggtgaatgaagttgcttattatcatctcacgccctgtg

SEQ ID NO: 710012 - DNA, 316 bp, Homo sapiens
tctttctttaatagagaacccctggggcccttaagagtgacatgggtcccctgggcacaaaagaaggatgggatctccaggcacggggccctttataagccctagagaaaaaaaatggaactatttcctctttggacctttccataccattggagtgaattttttctttctaaacagggaaaataatggtacaaaagcattttttttggtatttggttggatccctcccccacaccctggtgttttaaaatgaagaaaaaaaaccatccccttttgtacaaaaactcttaatgattaaaaaacaaacaaaacataa

SEQ ID NO: 710013 - DNA, 702 bp, Homo sapiens
  misc_feature (5)..(5): n is a, c, g, or t
  misc_feature (107)..(108): n is a, c, g, or t
  misc_feature (111)..(111): n is a, c, g, or t
  misc_feature (124)..(124): n is a, c, g, or t
  misc_feature (133)..(133): n is a, c, g, or t
  misc_feature (139)..(139): n is a, c, g, or t
  misc_feature (187)..(187): n is a, c, g, or t
  misc_feature (189)..(189): n is a, c, g, or t
  misc_feature (223)..(223): n is a, c, g, or t
  misc_feature (266)..(267): n is a, c, g, or t
  misc_feature (305)..(305): n is a, c, g, or t
  misc_feature (310)..(310): n is a, c, g, or t
  misc_feature (320)..(320): n is a, c, g, or t
  misc_feature (333)..(334): n is a, c, g, or t
  misc_feature (336)..(336): n is a, c, g, or t
  misc_feature (340)..(340): n is a, c, g, or t
  misc_feature (347)..(348): n is a, c, g, or t
  misc_feature (356)..(357): n is a, c, g, or t
  misc_feature (372)..(372): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (428)..(428): n is a, c, g, or t
  misc_feature (579)..(579): n is a, c, g, or t
  misc_feature (601)..(601): n is a, c, g, or t
  misc_feature (612)..(612): n is a, c, g, or t
  misc_feature (625)..(626): n is a, c, g, or t
  misc_feature (701)..(701): n is a, c, g, or t
ggggngcagaacaggaacgaaaaggaccggggggacaggggggcgggggggggggccgcgccgggggcccccagacacaggaggagggggcgaaaacacggcggcgnnggngcagcgaggcccngccaccacngggcgnggcggagggcacaaagcggggggaaccgggagcggcccgggcacggcncnggcgcgccgcgccggcgaagcgggggggccgaangaaaagcggcggccacggccagagcgacggcggcggcgggggnngccagagccaccgggggggcgggggggggcaaaggagnggccnccaccgccanaggggccagagcnncngccnccaaaanngccgcccnncagggggccaaaagnggaagacggagngggggnagncccaaaagcaggggagcggccaccaccgccaaaanggcggccagcaggaccaaagccaggagagccagccccacggccaccagagccaccaccaccacggcggccaccaaagccaccacgaccacggaaggggccgcgcgacgaccgaagggggcagtgtcccaaccgaaaaccaccgtccacganccaccaccaaaggtttccaganaccacgttcgnacctcgtttggcnnggatgaagcactagccaatctcgttgcgtttgacaggcgcgttttctaacttcacaggttgtggccattcacagna

SEQ ID NO: 710014 - DNA, 109 bp, Homo sapiens
ctcgcagcggcctgccagtgtgcatggcatcatctgccagcacattcgtgcttcagccggcacattcccagccacactgtgcggctgttcactcagtggcatcctgcag

SEQ ID NO: 710015 - DNA, 438 bp, Homo sapiens
cagacagggtcttgtccttgtcacccacgctggagggcagtggtgtgatcatggctcactacagccttttaatctacccaggctcaagcgatcttcccacctcagcctcccaactgggactatagtagtgcatccccatgcccagctaatttttttaaatatttggtagagattgaatcccactatgttgccctggctgatctcgaactcctcctgggtcaagcaatcctcctggcttgggttcggaaaggggtaagggattataggcgtgagccactggggcatgacctgctgtcaggtctttatggagcaacggggggcttaggataagtatgcacaggcccccagtgggggctggggcaaaattccttttatgagggccctaacagggggggtacactgtttttggacatgtttctcattcaattccaaaaatcc

SEQ ID NO: 710016 - DNA, 546 bp, Homo sapiens
  misc_feature (468)..(469): n is a, c, g, or t
gtctttcctctcaggataccaagggtggggactctaggaagggtgggggagcaaattggggtattggtccctgggcccagcccccttcaaaaggttcaggcttgccaggctccctttttttttttccccgggtccttcctttgggtggggttgttgcaccatttgtttggttggctggccctttaaagcccttctgtgggagagcgaagggggtcaaaggaaacttttaagcacaaagggctaggggggtggggtccttttttttgagcggtcggggtgggaaaaaagaatgcaagagtggtttgaatgtgcctaatggagaagccccccgtgttaggggatggggggtttcctgggtcttgttccctcccccatttggggttccagccatgaggtccccgggatgaccctttccttccaggggctcgctcccggggggttggcccccctttcaaattttccttcccnnacccctccctccccccccctccctattcccttggggtttttttgggttggttggatggaggggggtttggggcccta

SEQ ID NO: 710017 - DNA, 293 bp, Homo sapiens
cacctacagactaagtcgatacataggtgttctcgtgtgatgagggttatgttgtatgtgtggtgagtgagcccattgtgttgtgtaatatgtagaggcagtatagggctgtgatagtatgttgatctgtaagtaggagagtgatatatgatcaggaaacgtggtactagcacagagagtctcccagtaggtcaatagtcggggggtaggcgaggttagcgaggctgctagaagtcatctaaaagctataagtgggagtagagttgacagtcttgagagaggattatgatgac

SEQ ID NO: 710018 - DNA, 108 bp, Homo sapiens
taaaagagcacacccgtctatgtagcaaatagtgggaggatttataggtggaggcgacaacctacccagcctggtatagctggttgtccagatagatcttagttcaac

SEQ ID NO: 710019 - DNA, 818 bp, Homo sapiens
cgtgcacgaggcgcagcttctgagtatccaggttgctccgtccgtgctccgtctcaccatgacttcctacatgctatctgccagtctgtctggccacgtcgtccttctggagtgcctggtggctgtgctgtgctcctgtgcgttttgtggcctgtgtggtgtctgcttttctgcgctgcccagcattcactgtgtggtgctcctgtgctgtgcctgcttgctgtatcctgtgtcctcctgcccgctttgtgtcctcgtcctcctctggggtgtgctactgtgctgtgctgtgcatactgtgctgtgcagtcactgaccttgctgtcctgactgggctgctggctgggcaactgatgaatgctaaccatgcagaacctcaactgacctgcctggcttcctacctgtaacaatgtgtgctgcgccctggaggctggccaactggcgagctagagtgttgaaagatccgcgacttggtaccatgaagcatgtgggcctgggccctccctgcgactacagccactactacacgaccatccatggacctgcgggacaagattcttggtgccaccattgagaactccagtgatttgtcctgcagatcgacaacgccctgtctggctgcagatgacttcctgaaccaagtttgagacggacacaggctctgctgcattgagcagttgaatgccgacatcaactggactgcgcaaaggtgctggatgagctgacctggcaggaccgacctggaaatgcgatcgaggcctgaaggaagagctggctacctgagaaaacctaggatgaaacagacatgagggcaatga

SEQ ID NO: 710020 - DNA, 620 bp, Homo sapiens
  misc_feature (267)..(267): n is a, c, g, or t
cacgagggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgaccctcggctcgccgcccgcncccgcgcccgctgggaatgatgaagaagaacaattccgccaagcggggacctcaggatggaaaccagcagcatgcaccgccagagaaggtcggctgggtccggaaattctgaagggaaagggattttcagggagattttggaaacattccgagatatgtggtgactgaaagggggaccagattctagagtcgtatggagaagagagggtaacacgactgagacaagaagtagttcaaacagagggtaataagagaaccagatgaagatgagataatgaagaagagatggtgaaagaagacacaaggaaaagagagaggagagaggaagagaagtcaaaaggaaaagaagaagt

SEQ ID NO: 710021 - DNA, 1594 bp, Homo sapiens
taaaaaaaagactatttatccaggggtcccgatcagatcggtgtcctcttaagcaatccaaccagctagggggtgtgccaaaaaaaaaaactctattttaaacacccttgtgtgtgtgggagagtgctttataccactttctcccacgagaaacaagaaacacttaacaatacccgtgtgttttcaccaatgtgagtctccacaaaatcacgagctccctcgagagtttttgtggcgcccaacaccacgagtgagagtattatgtgtgcctctctcaacacacagtgtgtgtcttctctgtgtgtgtgtgagccagagactaagagacgcccctgatgagccaccacacccagtgtgtgtgtctgtgtgggcgtgtgagagttctcacaccacaaaccactctgtgtgtgtgtgtcacacctgtgtgttagcctttctccgctgtggtgtccacttctctctgctgtggagctctctctctctctctctcgctgtgagctataagagcctctttgtgtgttctcctcatatatctataaaaatctcttctgctgtggccacgtgtgcgcacatataggcctatagccgtggggtgtgtgtgtgctgtgggcaacccgccgccacatatagtcgcccaccctgtgtgtgtgtatccgccgagagagagtgttagcgggcgaaagagtatatgtgtgcgcgctctcccacgcgcggcgcatataggggggcgcacagagagcgctatctcggggcgctctccgaagaatatttctctctcctcttctctaggggggggctccaaaaattgtgtgagaagagccgtggtgtgtgtggtggtaacattctccccaaagatattttcctgtgtgtgtgagtttctcacaccaccgacctctctacaaagagatgtgtggggtctccccacttctgattatatcaccccaaaagatctccccattaatattaggggcgcaaatccccccgatggggtggccacccaaaataaattccgacgacaacacaacccgcagggggggtggggtccccacccgaaagagaccacccacgagggaacaccagctgagagagaggttttcccccccaccgagggaacacggaaaaggtgtgtatcagaattccccccagcagggaaaaaacccgacccctccaagaggaagagcacacccaacccaaaaagtgttccccaagagaacccccacatttgcgccgatccttcccttgggggggtcgggtgttgtgaagagcgcctatgaggccacattcttctgtcgtctgtggcacaggggacttttcttctaaagctctcccccaggtggtggtgcgccatctcacgcggagtgggcgattctttcgggagatggcgaccactctttctccccgggggagatccagtgtgcgttccaagagtgttcgacaagggacaaagcctctattatgtgcaccagggcctccggcggacgacgttgtatcaccaaccagctcgacgattttcccccctgcggttgcaacaaatatccctcggcagtaggagtatcaccacgcgtgttttaagtgccccacacagcatcttttc

SEQ ID NO: 710022 - DNA, 1168 bp, Homo sapiens
aacactggtgctagtatacatcaccctggtgcccaagaacaggcatactcagcccactgcagccactgctgggacccgaaggactggcccatgtagtatcccagttcctagcaaagcttcatcactacttttcactaagcacatcctaagccacgtgagaaaatcaccagacaacaatgatgctgtaatacagttgaagaaatcatagcaggtgattacactagctgcactagcagcgccaggaatcagcagccaagagcatcctacccatagtgaagcagcgtacgacatacattttcaggcaagagctcctcccctagtgatacgcaaaattcaaatagacattagcaagaagcaacctgttcacacaagatgcaccaaatagcacatgttacagaacagcaggacaccactgagcacagcaacggcaacagaacaccatgtaacttctctagcaacacagattcccacatcgacacaactcacacttctcaccgacaagtacctggaccaccagcacctctcccaccttatttgcagccccttaacagaacgcatgcgctcgacggccggcgccgttggctgcctcacgcccctgtaattcccagccatcccggggcaacggcagccgtgcacgcgcttctcccctggcaggtccggcgccttcccgcacgaccacgcactgggccaaccattgggtgcacccccctggtctcttacttcaccccttcgaccccacttacgcccggcatgtctggtgggcactgttgcgcctggcgcttccccaggcttactcggaaacgctcttgaagccacgggacacttccgcttgcaccccgcggaaggtgacgactgccctcgccgccgcggcattcaacacccaattcgtcccccgcacttggccgtttccagagcactgtgtgccaaccaaagggcgccaagagaacttcccacttgaacgcaccacagattacgcggccaagccctggaccgagccgtcttctacggacagaatggttcttgcatcatacacagtgtcacacgctacaaattccgacaccgacaaactcccgggatacgccacgcaggaaaaatcccccgcgacaaccgagcctgtgctcaacaacaaatgtccccacaccgttgtaacccaccgacatttacagcg

SEQ ID NO: 710023 - DNA, 576 bp, Homo sapiens
ggagtctggagacgacgtgcagaaatggcacctcgcaaaggggaaggaagaagaaggaagaacaggtcatcagcgctcggaccgcaggtggctgaaggagagaatgtagttgtggtgtctgcacaatatctttgcatccttcaatgacacttttgtgcacactgtcactgatcttgctggcaaggaaagcatctgccgtgtgactggtgggatgaaggtaaaggcagaccgatgatgaatcctcgaccatatgcgtgcatatgtgggcttgtccaaggatgtggcccagaggtgcaagggagctggggtatgcaccgacctacacatcaaactccgggccacaggaggaaataggagcaagacccgcggagcctggggacccagtcggaccgtcagaggcccttgcccgctcgggatatgaagaatcggggcggactgaggaggtgcatccccatgcacctctgacagtactcgcaggaaggggggtcgccgtggtcgccgtctggtgaacaagattcctcaaaatatctggctgtcaataaattgccttcatgtataacaagaatgagatcaata

SEQ ID NO: 710024 - DNA, 383 bp, Homo sapiens
  misc_feature (346)..(346): n is a, c, g, or t
  misc_feature (375)..(375): n is a, c, g, or t
tctcctgcctcgctgcagtgttcctaatctatatgctcacaaagcttatacccatgtggatgtagtatctacttatgtttgcatcttatcctccgtctaggaaaatctgctcccccttagccaatcttggacacaattatttaatagaactgtttgatcaccgatttgttcaatttagtcccatggcttagtaatgaaaatgtgctttaagcttatccttaaaaaccaaagagctttgtatcttgcaccaaacacagaagcacaagacctctctcctttgactcactttgatttcagataagagatgctgaattcatggagtgatacccctgctttgctttctacnaaagtagaacttccttcagtaattaatcnaatttccg

SEQ ID NO: 710025 - DNA, 734 bp, Homo sapiens
  misc_feature (306)..(306): n is a, c, g, or t
gttatacccatactgagatctggtgtggtcacctgcctccgctgttcaaggcgtagggcagacaggtaactcttcccagaggcctgaggccaggccgttcccaagttggaggcgggacaaaaaaatatagtgggcctcccgtgtgctgggggctgggacacgtggagcgcgaatgcaccattggggctggatataggccctggatgaatgtgtcagtaggtaactcgttgtgctctggatagcacctggctgtctccttacaagcatgaaacacgtgcatgtatggagctctcaccacgtagaggncagcgcaatgaggcatttctccaccatttctggggatctttggggcaaacaacaagctttgtccttgaatatcgcgaactcccttgggtgggtctctttccctacctcccttagacctaatcctatttaattctggggtaaacactactacaatgtactaaattactgtattgatagaagactttagccagagggacgtttcccctccttctctctggtgaaggttcgacttaggcaaagatttctcttgacgttcctccattttgtttcgcagaagaggtaacgaagaaccttcccaaggcgatggtccctatcctggtatagtggcgccccgggcaagggttaagaggttaaacttttcccaaattacttaacaaactggggttacttttttgacaacacgcttggaagaaggttcccaagtggga

SEQ ID NO: 710026 - DNA, 1014 bp, Homo sapiens
ggatacgggagttcctccttgctctcgcccctactctttctggtgttagatcgagctaccctctaaaagcagtttagagtggtaaaaaaaaaaaaaaaacacaccaaaggctcgcagccacaaaggggatgaaatttcttcgggacatcctccgggttctcccggttacgtgatcgtcgtggctccctagaagttccttcggtgaaagccttttatattcctaaggaggagcaaaattcaggtcacggggcgaaaatcggtgcgtgattacaggaagcgtgggcattggaaatggggagaacgtgacgtgccttattgaaattgtgcttaaaccttaaagagccaagcgtgggtccatcgtggggatactaacataaggcatgtggacgtggaggcaaacgagctgtgccaaagtgcaagggacacggggggtgccaagggttcatacctatgtgtggtgcgttagaaacgtggggagggaaacgcggagaagagaattatttttaagagagccgatcgtggacaagagacaaggtggcaaagggcgagaaaaatctgtggcaagaagtgttagagggtatgtttaaagggtacaacctaatgtgggcgtgggagtgggataaggctctatatataccatgctcgaggaaatgtgtgggtataggggggatagacagcgcaaagaaagctccgttcaggaagttgtggaagaggaggaaccgtttgttgagggaaaagattatacaattggtataacccttgtggagacaagccaatattatatccggttgggggaagtcgtttaaccagaaaaggggggcccaattttgtgtgtcgttgtaccacggtgtggacaatcaggtgcgacgcggcacaggaaagcaaattaaataaacaccccatgtgtggcggccccacatataatgttggggctagccccaccttgtggtgggcatcttcgagcggaaaaggtctcgtgggggacaccaacttgggtttccacgagagacgtcc

SEQ ID NO: 710027 - DNA, 105 bp, Homo sapiens
aagacacatccttctaataacactagcttcaaagagctcaacaaggtttaacaacctttgggtgtgtgtgtgtgtgtgttttggtggagtggtaggaggagggtt

SEQ ID NO: 710028 - DNA, 2772 bp, Homo sapiens
acacttcccccagagaagcctccgagcgcggccgccattccgggcctcaagcccataaagaaaaaataccggagaggttctggcaccatttcggggtgccaaagcagccatggaagagcctgcagctccctcagaagcccacgaggcagccggggcccaggcaggtgctgaggcagcaagggagggtgtgtctgggccggaccttcccgtctgtgagccctccggggaatctgctgctccagattcagccctgccacatgcggcaaggggctgggcccccttccctgtagctccagtccctgcccacctccgcagaggaggcctgaggcctgccccagcctcaggaggaggagcctggcccagtccgttgccaagccgaagcagcggcatttggacaaagcagatcatctgcaggtattatatacatgggcagtgcaaggagggggagaactgtcgctattcgcacgacctttctggtcggaagatggccactgagggtggcgtttcgccgcctggggcctctgcaggtggaggccctagcacggctgcgcacatcgagcccccgactcaggaagtggcggaagcccccccggctgcatcctccctttccttgcctgtgattggctcggctgctgaaaggggtttctttgaagccgagagagacaatgcagaccgtggagctgctggaggagcaggtgtagaaagctgggcggatgccattgagtttgttccagggcagccctaccggggccgctgggttgcatctgcccccgaggctcctctacagagctcagagactgagaggaagcagatggctgtgggcagtgggttgcggttttgctattatgcttccaggggagtttgctttcgtggggagagctgtatgtacctccatggagacatatgcgacatgtgtgggctgcagaccttgcaccccatggatgctgcccagagggaagaacatatgagggcctgcattgaagcacacgagaaagatatggaactctcgtttgctgtgcagcgtggtatggacaaggtgtgtggcatctgcatggaggttgtctatgagaaggccaaccccaatgaccgccgctttggcattctttccaattgcaaccattccttctgtattaggtgtatccgcaggtggagaagtgccagacagtttgagaacaggatcgtcaagtcttgcccacagtgcagggtcacctctgaattggtcattcccagtgagttctgggtggaggaggaggaagagaagcagaaacttattcagcaatacaaggaggcaatgagcaacaaggcctgcaggtattttgcggaaggcaggggtaactgcccatttggagacacatgcttttacaagcatgaataccctgagggctggggagatgagcctcctgggccaggtggtgggtcattcagcgcatactggcatcaacttgtggagcctgtgcgaatgggagagggcaacatgctctataaaagcattaagaaggagcttgtcgtgcttcggctggccagtctgttgtttaagcggtttctttcactgagagatgagttacccttctctgaggaccagtgggacttgcttcattatgagctggaagaatatttcaatttgattctgtagcatcgtgctgtggcatgtggtctagtctgctgaggttctgtcgtctgctattgcctgttttccctgtgttgacactcttactgctttcaggggctgttgaggcagtgcttctgttttcttgtctattctgcatatctttccccctaggattatggtgattatctgtgttaaaaaataagtccttaaagttactgttttggtgaaattaatattaatgtcagcttatggcttttttttgtcatctctgttgtcaacaggattaactcagttctagtgtagtgtttactgaatttccacacttattttgaagaccctcaagagtaaatgtggcagagtgaaaggagaagttttaattgaactagtagctttgtgctataatagccttaacaaatggacccttgcagggctttgcagctgctcatctgtttgtttacagtttgttctttccctccttccccttcaagtgcacttgttaaactgtgatgaacttgtgattttgtgttttacttgaccaaaaccaagtgtatatgtttacatgtttttatcctgtttagcttgacatgaaataatttatatttggaaatatatatttaagaattatatatataaaaatatatatgtataagagttatgtatttgaaaaaaatatataaaagaatatacatcacaatataatatttatgtttatgtaataaagtaaatacagagctgaaagctgaaggtcaaagcctaacaggactggctgttgtgtggatgtgagttgtgtgaataatctttctgtccctcgcacagaagccagtaattagcatctaatgaaaaggactgttcaagtgggtctggccaaatgtgacagatgcagatcttagaggacttacaaagcactatattggtaattcttacaatggcattagtagcttactctataaatacagagatggttttcctatgcagtttagccaccttctcattaattctttgtaacagcaaatcctaggctcagaggcacagtgctttgtatttgatatacaaagtctctagactttcccaacaaggggcttttgacaaaagagttcaacataaaagtaacaagattataaaagggaaaatagaacaaaaatattaaaaccaatgagaataaa

SEQ ID NO: 710029 - DNA, 171 bp, Homo sapiens
  misc_feature (73)..(73): n is a, c, g, or t
  misc_feature (77)..(77): n is a, c, g, or t
  misc_feature (105)..(105): n is a, c, g, or t
caaccaggtgcatgctgatatcttgagatggcatgctgttagctatgagagtgcatgctgatagcttgagagnccanggtgcatgctgatagcttgagaggccanggtgcatgctgatagcttgagagggcatgctgatagcttgagagggcatgctgatagcttgagagg

SEQ ID NO: 710030 - DNA, 1193 bp, Homo sapiens
ggatgagctactttgccagctagaggccgccacgcaagtgaagccagcagagcaattcgtgctgtggcatgtggtctagtctgctgaggttctgtcgtctgctattgcctgttttccctgtgttgacactcttactgctttcaggggctgttgaggcagtgcttctgttttcttgtctattctgcatatctttccccctaggattatggtgattatctgtgttaaaaaataagtccttaaagttactgttttggtgaaattaatattaatgtcagcttatggcttttttttgtcatctctgttgtcaacaggattaactcagttctagtgtagtgtttactgaatttccacacttattttgaagaccctcaagagtaaatgtggcagagtgaaaggagaagttttaattgaactagtagctttgtgctataatagccttaacaaatggacccttgcagggctttgcagctgctcatctgtttgtttacagtttgttctttccctccttccccttcaagtgcacttgttaaactgtgatgaacttgtgattttgtgttttacttgaccaaaaccaagtgtatatgtttacatgtttttatcctgtttagcttgacatgaaataatttatatttggaaatatatatttaagaattatatatataaaaatatatatgtataagagttatgtatttgaaaaaaatatataaaagaatatacatcacaatataatatttatgtttatgtaataaagtaaatacagagctgaaagctgaaggtcaaagcctaacaggactggctgttgtgtggatgtgagttgtgtgaataatctttctgtccctcgcacagaagccagtaattagcatctaatgaaaaggactgttcaagtgggtctggccaaatgtgacagatgcagatcttagaggacttacaaagcactatattggtaattcttacaatggcattagtagcttactctataaatacagagatggttttcctatgcagtttagccaccttctcattaattctttgtaacagcaaatcctaggctcagaggcacagtgctttgtatttgatatacaaagtctctagactttcccaacaaggggcttttgacaaaagagttcaacataaaagtaacaagattataaaagggaaaatagaacaaaaatattaaaaccaatgagaataaa

SEQ ID NO: 710031 - DNA, 703 bp, Homo sapiens
acacttcccccagagaagcctccgagcgcggccgccattccgggcctcaagcccataaagaaaaaataccggagaggttctggcaccatttcggggtgccaaagcagccatggaagagcctgcagctccctcagaagcccacgaggcagccggggcccaggcaggtgctgaggcagcaagggagggtgtgtctgggccggaccttcccgtctgtgagccctccggggaatctgctgctccagattcagccctgccacatgcggcaaggggctgggcccccttccctgtagctccagtccctgcccacctccgcagaggaggcctgaggcctgccccagcctcaggaggaggagcctggcccagtccgttgccaagccgaagcagcggcatttggacaaagcagatcatctgcagagatatttgttgagtgatgtttcaggctggaagcggtgagccactgacagggatcagagaattccccacagaattgggcagtcacatgcatggatttagaaagacaaagttggaaatgaatcgttgcagctaatttctccctcaagacatgtctacattctgaagctagatctggtggcagaggagactaaggagctcagtatttccacatagtaacaacaaacattctaaaaagaaacaagagaacaatcttacttacaaacagcttcaaaaaataaaatatttagaa

SEQ ID NO: 710032 - DNA, 218 bp, Homo sapiens
tactcaagcacggtcacacggtcacccacaaaccacggtgcgtgcttgtgggttgacgtgttaccgtgctgtgggtgacgtgcttggtagaattacttaggcatagttgagcctttagaatttccttctggcatggacaaaaagcgtcattaacttattgaatattgaattccgtttgcaaaattgaggtgggatccctctaggagtcgaacctgcag

SEQ ID NO: 710033 - DNA, 558 bp, Homo sapiens
  misc_feature (42)..(42): n is a, c, g, or t
  misc_feature (70)..(70): n is a, c, g, or t
  misc_feature (370)..(370): n is a, c, g, or t
  misc_feature (372)..(372): n is a, c, g, or t
  misc_feature (379)..(379): n is a, c, g, or t
  misc_feature (382)..(382): n is a, c, g, or t
  misc_feature (386)..(386): n is a, c, g, or t
  misc_feature (397)..(397): n is a, c, g, or t
  misc_feature (408)..(408): n is a, c, g, or t
  misc_feature (449)..(449): n is a, c, g, or t
  misc_feature (467)..(467): n is a, c, g, or t
accagacctagggacccccggctgcagcggcccctgggccancgagaagatgcaggggtgtaaaaaagcncccccatttcccggctaatggatgggagcgctctgatggacaaaaaagtaaaggccacccatttatcccctcccataagaggacgagaagatggttaggaattttggatggatggaatttaccctcagaagcaccctatcctgactccaccctcgagaacccaaggatactttcggaagaggagcaggaaatgttcagagattttgactacattgctgattggtgttaagttgctagacactgcgaacccaagctgactcacaagaagacctcttaaaaatagcaaccccttcatttgcncnttgtggncancaanaacctccaganttttgtggtgntgttgtttttattgaaacacgtgaagatttgtttaaaagtnccattctaatacttcttnaaaagtggtcctcattgtacttcagcgtaaatatgagcactggaaacagtttcatggagtttaagttgagtggaacatcggccatgaaaat

SEQ ID NO: 710034 - DNA, 640 bp, Homo sapiens
  misc_feature (304)..(304): n is a, c, g, or t
ccccgggctgcaggaatccggaccaggaggaggccatgtttgtgctctcagcactctgagaggctgaggctggtggatcactcgaggccaggaattcaataccagccttgccaacatgaaaccctgcctactttgcaaacacagaaccagctacgaatagcggcgcacgcctgtgagcccagttactcaagacgctgatgcaggagaatctatagaacctgggaggtggaggttgcaaggagccaagatcgtgccagtgcactccagactgggtgacagagtaagactccatctcgaaacatgnataaattaatacacccgattgtctatgtgaaattgatagaatagtgcctgctatataagtagcagaatctaagaatatgctaccactgctttagacttattattgaaacaatgatcatccatgtaggtcagtcatcatctactaagtaggcaacaagctgagcatggtggctgatgcctgcagtcccagagctgtgtgagactgctgttggagaactggctgacgtcagtagattgagaccacggctgccatcatagcaagaccctgtctctaccctgtgggaggatcacttggctgggagcttatgactgcagtgagctgtgacggcgccctgcc

SEQ ID NO: 710035 - DNA, 918 bp, Homo sapiens
  misc_feature (753)..(753): n is a, c, g, or t
  misc_feature (760)..(760): n is a, c, g, or t
  misc_feature (765)..(765): n is a, c, g, or t
agcgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaatagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttgggtctggccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccnacttctnttgcnttctatgctgtttgtagtgacaactaattagaatgaggcacccatttccaaagggtttataccaagtggcgttgttgcaggtttggaactgagggctgtttaaaggtggaatctcggatgcagggtggggcagtcggatctttcccttaaatt

SEQ ID NO: 710036 - DNA, 533 bp, Homo sapiens
agcgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaatagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggtaaccctcgcccctttccagaagccagaggacccagtgttatgtaaaaagtaagggtcgggtgggtagaacccctgcctacccaggccgaagtttctgagaacttggacaaaaaaaatagccagctagtgttctaactactgagg

SEQ ID NO: 710037 - DNA, 462 bp, Homo sapiens
  misc_feature (400)..(400): n is a, c, g, or t
  misc_feature (422)..(422): n is a, c, g, or t
  misc_feature (426)..(426): n is a, c, g, or t
agcgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaatagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggttacagtctctngcttcgccatgtacatggcccntccntgtacatggatgggcggggaggtaactaaaagatcc

SEQ ID NO: 710038 - DNA, 181 bp, Homo sapiens
tccgctggagtgtcgctggaaggagcacaagccccctcactcgtgcctttgtactaccactgacgacatggttgctcacatactctaagagcatattcttgataccggaagcagggcttgtggggcaagcggtgacttggtatcgggcaagagccccgttaagccttcatgagggcagcca

SEQ ID NO: 710039 - DNA, 849 bp, Homo sapiens
  misc_feature (753)..(753): n is a, c, g, or t
  misc_feature (760)..(760): n is a, c, g, or t
  misc_feature (765)..(765): n is a, c, g, or t
agcgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaatagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttgggtctggccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccnacttctnttgcnttctatcacttatagtagtgtaactagatatgaatgagcacgcactagtaaacatgattacccggagtgatattatctgacacc

SEQ ID NO: 710040 - DNA, 424 bp, Homo sapiens
acacaataatgggcgagtaccgtaaaaaagatccgagttgtgagcataaagcctcaggtcaaacataatgtgggaactgcaagatatatgtcccgagagcaaggtcaggaagtagaaagtatagagtcgacatgaatggagaaggcaagagacacttgcgaggccagcaagcaaggactttcacaaaggctcaggctaggacaaaaaggcggagaggagatcggtgacaaaccagttcgtaaatgacaggtggagatgagaccttgaagagtcggatacgatccgaacagggaggaaccgaatggcacagaagcagcatcaacatcagtctgtatctctgtgtgtctctctctctctctctctctctctctctatctctctctctctctctctctctctctctcactctctctctctctctcac

SEQ ID NO: 710041 - DNA, 1018 bp, Homo sapiens
agcgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaatagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttgggtctggccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctattttagaataaattcccaacttttcttgctttctatgctgtttgttgttaaataatttgattgtgcacccattcccaaagccttatcaccacccgcccttgctccatgtttgaaaccgaggccttgttaatgcgccattctctgatctcagttgccgaagtagttttttcccgttgattcccttccgtaaacatcacggtgttgggaccttatacatcttgtaacacccttattgtcgtaatccccctctaggcgccatctctccacctggcccttctctctaccctcgcctccgtctcttccccctctttcttcttcatacctaaataggtataat

SEQ ID NO: 710042 - DNA, 745 bp, Homo sapiens
agcgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaatagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttgggtctggccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggctaccaagaagtgcatgctgctgcagcgacacctcattgccgttgttcttcgacgaa

SEQ ID NO: 710043 - DNA, 963 bp, Homo sapiens
gcatgtgagccaattcatgttccgttcagggaggagtatactcgatcgcaggtaactcccacactatcaagaatacactactagtctgtggatcttgctttttctagtgaaaggcttcctaatgaataaagattgggagcagtaaaggattttgtggtgtacattaggctactgttagactgtctactggtcccagttttgagtagacttgttccacgaggcatggtcgcgagtagtcagaatatgcatacgtacagagcagtgagtgcaaagtgacatgggtaacctgggatgtagaagggagtgagtaattgaggatgatgtgaatgtagtgatagctagtagtgggacaagtgcgtttatacatggagctttgatgcctctaattcaaatgtccgaggaagcagtacgtcgtttactgtgggatgaagatggccaatcgagacccatgtgatacgaataaaggaagggtatgtagatataatagtcgatcttgtggcaagcaagattgatatcacgggaagagtggtaaagaaccaaggaaatggttgagtttaacaagaagaggaatgtgcgcgccatttgtggtagccattgaagccatgttacaatatttagggcacccaaaagagctatttgtcgccattggattttacaattttggaagggtagattgagctaaatatgggaattctgattaagttctctgtgtgtgacactagattcacaaatagcttctatttgaaaccacgagctgaagattgtgttgtggaaggtgtgcaattatagctttcaagtgtgtgtcccaagagcgcatggtattgaatgcaattcgatggcgaacaggaggtggacagattggtctttgagagatggcaagtggctggacatgaattggtctaccccttgattggaacggtacaaaggggggaacgggggctttttaataggaagacaaaaaaa

SEQ ID NO: 710044 - DNA, 762 bp, Homo sapiens
ggcccattattcaacaggcccaaaaggttgtcggttggaggcacaccacgccctccgggtgccccacgcttttgagatgggaagctccccgcgtctgcttggtcaaaccgtttgtacgctacctaattgagtgcgggccacaggactaccccgatgttgtcggccaaaaagcgacgcctattcgggagtagacagactatggcccttgtcctccctagagaggattccccgaccgctaaacaaatagagaggttgtcacgcctggtgccaccccgctgcgtgaatatccaactctttgaactcgccccgtacgagactgataagacatgcgatcacacgagctccctagtcggctacgctgagataataagggtcctacgctccccccacgcctcccaatgggggacctccaaaagtgtcccacttgtttttgaataaaaatataattttgctccccgaaccccccccgttttataacttgggagggtcttgtcaacaattgttgctattatgatatcttatagcgagggatcatcccgtgtgcaaaatacaagtaacaaaggattgtctgcgcccccaccatgtttgttccgtctcgcgaattctgacgacccaccagtgtgtcttctgttcgtataccgagaacccctgggtcgaatctttcctagaaagagaaggtttgtcgcccccctccctgtaacaacatgatgtgcagccccgaaaaccgcccccgagggcttttcgaaaggaaacacggggccc

SEQ ID NO: 710045 - DNA, 520 bp, Homo sapiens
  misc_feature (424)..(424): n is a, c, g, or t
  misc_feature (431)..(431): n is a, c, g, or t
  misc_feature (436)..(436): n is a, c, g, or t
gagctcggtacccagttcgacggagactctcacatctcatgtgatgctcttattacaggacacagcattgttgggtctggccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccnacttctnttgcnttctatcacttatagtagtgtaactagatatgaatgagcacgcactagtaaacatgattacccggagtgatattatctgacacc

SEQ ID NO: 710046 - DNA, 573 bp, Homo sapiens
gtgatctagaggatccctgcttgatgtactgcctcaaccccaaaagtgtgggattacaggtgtgagccaccacgcctggcctcctttgcccatttttaaattgagttgttttttgcctgttactttgtttaagttccttatagattctggatattaaacctttgtcagataacatagttggggaatatcttctcccatttcgtaagttatctgtttactctgtttatagtttctttggctgtgcagaagctctttagtttaattaggtctcaagtgattctccaagcttggcctctcaaagtgctgggattataggcgtgagcctaggcgcccaatctagagcatcttttcttgtgcttgctgctgtctgtatgtcttctgtggtgaagcatctgtttaaaccatgtgcctattttgaataagggtggttaatcgtcttactatggaacagtaagagctcttgtatatttgggctacagatctatggttggatgtatgtgtggcaagtgtattcttccaggtgagcactggcacttcatttcattaacaatgatgtcgacataggacagtgtg

SEQ ID NO: 710047 - DNA, 1296 bp, Homo sapiens
  misc_feature (1264)..(1264): n is a, c, g, or t
agcggagctggaagagcctggggccacctgtctggttcagtagtctctctgtctgtgggcctcttgagagccaggcttggtttcgtggtctgacctgaactgagcaattgacaacttccgtagggatcctgactggctgttgactgaggccagttctccctgctggtctcctggacaggagatgagagacggaaatgggcgttaggatgcctaggtaggcctttcgaaactctacacagcagcggaccacgtctagaacaatgcgttcaccccactcagcatggagcaagcaagaccagactatctagaacatcgagagattttgctgcacatggccagaggctccctggagagcataaagttattaattgtgagagcatagaaagttacacgattcggtgcaacgcattgatagggcaacgtaagaaatcagcccaatgacggcattaatactatggcaaagatagtccgccgtaggaaggtctccgggagcagacagttggtctccgtgcccgttccttgacttgcacaggatcgcaagcaagcgcagggcagagaggccgttgccggattccacctaaatcttgggaagggggaccagatacaaacggaaagaaccgggtaactgcacacagacatagagggtttgcagcgttccggccctgcacacaaggaccccctgcaaatggagttggacgtagtccgatgagaccctttgggcaaggaatggcattcaactgggaaacaccaagggccacatggttgggaaagtccttatccaagaagaaacgcatgctgtgtggaacttgtccctccgggttggcggggccaacgaacgggcaaagtgcccccatggaaaggaaccgttgccacttggttaaagaattctccttccaaggccatgaatgacaagattgcgaccatgcctggaatcgacctatctgaacagggcgccaattgtattcgtgcccctaggaaccaattgcctttggaaagcgtcacccccacgtcaccttggaaaagtggcggttgccccataaggcgctcccccgtgcatgcgtaaaaggcgaagacatcggtgtccctgtagagaatagaggcttgggggtgagcacaggattccccagaggcgaaccatccacacgggcgcaagccgttgggacgcaacggattatttacggaaagctcgagttcctcccggtgagagtcgggctgagaacttgcccctttgggtgagaaaagtgtgcccttcggcctcttgcgngcacttttggacccccacagagaggtcctacc

SEQ ID NO: 710048 - DNA, 485 bp, Homo sapiens
  misc_feature (165)..(165): n is a, c, g, or t
gcgctccgaggagatgccggacggatgagattggctcttgctccgcactgagtgtgacagaggtctccagagccttctctctcctgtgcaagatggcaactcttaaggaacaaactcagttgcaccaggtatgcgcgaacgaagcaggcaagcagcttccaaacnaataatgatcactgtagctggagtgttcggacaagttggctatggctgtgtgctatcaggcattctgggaaagtctcatggcttgaatgaacgttgcttcttgatgggatgtttctggacacgcagtagagcattaagaggcaagaaatggaatggcatcgtgtgagccagtgcggaagcgtacagtatgtgcatttcagcaaccagcctatagaattctgtgggatacgactatacaggacttcatttcctgttcgaccgaccagattctagagaatttgtagtggctaaacgtgcagggagtccgatcacgcaacgaa

SEQ ID NO: 710049 - DNA, 933 bp, Homo sapiens
gggtagctgaggggttgaacgatagacccagatgacggcctttacgaagtgaaagaggtcgggagtcgccccctagccgcttctcgtagtcctgggagcacagtagaagtgttgtcttttttaatgaacaagtaaagcatagaaatgtcaacatgggacggagatctacgtcatccaccagagagtggaaggaatttcatgaatccccacagaccaagcccgaaaggaagcccggaggagagacttgacatgaagaacaaagaatacggcgctatgatggttcgagctgcggtttgtaacgatgatggatccaaaacgaagataatccgagacatggcgcaaagttggtatgatcttggagtttaagccagtgcaacagtccgacaattaaatgaggaaagtactgaaagacaagcgtaaaaagctgcgtgaaacctttgaacgtattctacaggactctatgaaaaacgagaatccagatagtttacaaagaattgagaaagctagaagtagaatatgaacagaagagggctcaacttagccaatattttgatgctgtcaagagatgctcagcatgtggaacgtggagagtgattcctttgccagatatgccaacatgctccttccaacattttgatccaggacattccacgttcctggtgccagcaacctctatccgtaaagaaaaacttcagctatgggactccaatcgggcagttctatccttcctcttcttggacatggtgttcccggtttgcccctgagaaaactctggcttcccctggttcacttctcctcagtcggcgattgattggcgaaggggttggctaacttccctctgtaggatgaagctctatagtgctccccccgctaaggtgtacgcgacttggcgcgcgcaattaaaggacacatgaagcggtttgttagcacagg

SEQ ID NO: 710050 - DNA, 279 bp, Homo sapiens
agttttccaaagaaacaccacaatgaccctctccaggaggcaccactcccggccctccgacagcgaccaccaccaccgcctccaccaaggcagcactcccagcccgtccaacgactacacccatcactccacctgtgcatagtatctggaggcccgaaggctgcggagcctctgtgtgctgtgaccattcctgctttgcaagtaggctgacatcccttcattatgccctcaaagcggatagagggcaaatggagagatgcggagagtcctcctctttct

SEQ ID NO: 710051 - DNA, 926 bp, Homo sapiens
  misc_feature (477)..(477): n is a, c, g, or t
  misc_feature (484)..(484): n is a, c, g, or t
ggccccgactgcgggtttctagccctcgcgtggcgtggggacaattaggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattgtggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccggacgcactggcgagctgggagcgccnacacggntttcaaaaagaccgcacacaccaagataataatgtgtcgttcgctcgtttcgcgcaagcggagtcgcgtccgccttcccggagcctgggagacgatgcatcactgtaagcgataccgtcccccacgaagatctcggtccagaagccatggacgtctgcctaccagaggaggtaccgggagcgccgtgacagcgatacataccggtgtgaagagcggagcccatccttgggagaggactactatggaccttcacgtctcgtcatcgtcggcgatcgcgggagaaggggcataccggaaccgcaagcatgcccacagtgccacaaacgcgaaccaggtcttgtagcaggcctcctcgagaaagcaaagagcagtaagcgcagcagcggagtgtgggcagatgacaaggagggtcacctggggggccggatcggcgaatgctcca

SEQ ID NO: 710052 - DNA, 136 bp, Homo sapiens
cctagggcatccttattaaaatactgagagggactcatctgcagaattctgattctatttatctataatttggcacatgctacaattttatttacaaaacaattaggcaaaaaccaatactagatatatgaatcag

SEQ ID NO: 710053 - DNA, 165 bp, Homo sapiens
tattcgtgttgccttatgttggtgagcatcttttttcagttttttttacttacacatagtacaaatgtcctgtccatatacatatcattttgtagaataccctagagtgacacattgcagaagtaggatagtatggtcaaagggataatgagcatatttacttgt

SEQ ID NO: 710054 - DNA, 226 bp, Homo sapiens
gacaagtccttgccctaaagttcctgtagatttgttccccttcacttggctgtgcttcatgatgtaactgctttattcgtttagctaaagaactcagaaaagttcaggggcacaactgacttatgaattttcacagatacatcaaccatgagaagctgacacgtgcgtgagtatatactaacttatgacgaatgtcagaatgggccagaacttcttctagcttaaa

SEQ ID NO: 710055 - DNA, 918 bp, Homo sapiens
gatcatctcgggtcagacattgccccgttatgtttgccaatgccccagtcctagagacttgtcctgacagtgccgcacacctagctttgtgatactgctcagatgcaggtggctccatccccagactagcctggctgctctccgaggcccctccaccatgcatccccttattgccccattcttgtggcttgccggtgtccacattggactcccttcttgccggtgacagcagttccatcatctcacccgcgtccccaatggagccaagctgcgttctcactcaggctggtgtcatttcaggaggaccaaagcctgcgtgagccgttttatattcttcagtaaaatggtgctttctttccttacttcgagatactatatataaataataatgtacactgacaccttttcgtacggagctgtatgagtattgctttacacgagctcactaaatcagcttcagcaatcttgagctctgtggctcctcaccctgtctgcatggaagaccttgctggacgctctcgggagagcagacatacgcaccagaagccactgggagaagtgtacgcgatcctgtgtctgggccacgagtagtatgcactgtatagtctattgagttccgtaaagcagtctcttcataccatttcttacagactggagtgtactggactaaaatctgtgtaagcaacattgacatactctttctaatgagggtagcgtcaccagcggggtataagagtagtccctcagcgactatgttgcgtaatacgagataccattacctggtcagacggggacccagactcgtttgccctcaattgtggcaacggagaccgtgccagggctgggataaacgggaagacgtctgggtaaccctggaaatttacctgtatcccagcgttgactccaacagctacagcc

SEQ ID NO: 710056 - DNA, 270 bp, Homo sapiens
aaaatttttttcccttttttttttttcccttgggcccccggggccaaattttaattttttttgggggggggcccgtttaaaggttttttgtttttgggggggttttccttgggcccccccccgcccgggggtgttaaccgttttaaaagggttttttttttgttggggggtggggggaaaaaaaaaggttttttcttaaggggccttttaccggtttgttttcccttaaatttttaaaggaattgaattaaattttttttttccggttta

SEQ ID NO: 710057 - DNA, 106 bp, Homo sapiens
gtgctgtccacctcctctgtggcacagaggaggtggacagcagaggagggaaccagctactagatggttcgattagcctttcgccccctcccctcctctgtgctgt

SEQ ID NO: 710058 - DNA, 326 bp, Homo sapiens
ctcttgtatatacattcattttggagggtaagtctctcaaaataggcctttcactgggggaaaatggtaaaaatactccctggtaattcaagaattggagactcctgagatgctgctcatattagctgagcacttatcaatacttcacttttttccatatatactcaaggaacaagtgctatttaaagtgtttcactccactgtgctaggtgcaagactataaagaggtgtgaggatcaacacttttatgaaaaccagtgtcattctggatatagtttcagatgctagtgcaaaggaagctcttggtatacggaaaaagtattcaa

SEQ ID NO: 710059 - DNA, 109 bp, Homo sapiens
gtttgcagtgctccatttccattggtggccccagctcagtaactaaacctggtacatttcctgtgtgcaatcagtcccttgaaggcagaacattttgaataaagttgga

SEQ ID NO: 710060 - DNA, 127 bp, Homo sapiens
  misc_feature (110)..(110): n is a, c, g, or t
ttctgcctgccccacctttgaccctattctaattgcttatagtttctcaatccactatacaaaaactatgaggaactggggtgaagagcagttaacccattgggcaggtntaaatgggcaaatgggt

SEQ ID NO: 710061 - DNA, 970 bp, Homo sapiens
ggtttggggctataatagcaatagggtgccctaggagtcgagcgctcgtgagttggaccacttctatttggtggcatgatagtagattgtattaggcgcgattcagtattccacggtccgctgaccattaattgtgctggttatcacaaactggagtgtagagtatataatgcttgactgcttgcactattcggaaggataggaagtgatcggggtggttctgggtgcagttgttcatagagcgcttagagatatcatcattttttgtttctccagtaaaggtgtgggggaattgccttttgtagttagtataaatcattatttaagacattgggattaaaaagattaggtgaggagttggtaactgtggttgcacaattatagtgcttatcattgggaggtgggagtgagcgagcataggagggtcaagttcagtgattggctgatattctcagggtagcagcggtagagaagtgccgtgaagttgaaatattgaatatgaagtatcatgggttcgtcgtgggtaattcataactatgtatccttattaagactttggtcgaggcatattgcggaatggcggagagtttgttgaactgctgggaatggcataaaccatcttgagggaatttttatctatttggatgggctcacttcatttgaacgtgagggaagggtggtccgataaattgtatgcttggagggtagtttgagggagagtcctattgaagacgtagttccggaaaagcggagtgcatattaattcggggaaaaactctaatcggtgtctaggctgaaaagaggcggcttttcgggcaggaattaaaaagaatttaaaaagatggggaggggggcgagaaaaataccaggggagaaatggaggaccagtggtagagaggcggagggggtccaaagggaggcgggatatattggttttaacaaattgcggggtgatttgtttcatagtttc

SEQ ID NO: 710062 - DNA, 440 bp, Homo sapiens
ggggctcattcaggcgcagagaagttgtgagggaggagacaattgtggctaatggaggcgatggaggtgggggtagggtggggcgctcgatgtctaggtggggggggcagatgtcatagatggcttcgttgtccaccatgaaggcacagtctgagtgctccaggtgggtgtgggtggtcaggatagagtggtagggctcgaccagggttgtagacacggggggggctgggtagatggagaatcccagctgggatttcttgccatagtcaacagagagccgctccatcaggagtgaggtgaagccagagccagtgcccccaccaaggctgtggaacaccaggaagccctgaagtcctgtgcacgggtcagacggaacggtacgaccgagaccgaccagtttagggaggggaggggccggagggactctatcaactgggtcc

SEQ ID NO: 710063 - DNA, 309 bp, Homo sapiens
agaacaactacctgtaaatcacatatgcctaagccctagtatcctttttcattaccacaaaaattgaaggaggacaaagaagtcgtataagtctattcctcctcctctgagaaagatacagaagccaccttcagaaggcagcagtctaagaagctcttagctcagtgcccatatacatgttcataacagattcatatgccaataaaagcaaaacccttctgataactcaaatcttgtatagatcaacagtgctgtataaaaacaatgcataagctctctctaaccctcatctagatagtctaaaattga

SEQ ID NO: 710064 - DNA, 196 bp, Homo sapiens
ctctagaggatctcttgtgaaggacctgtgctcactctgcactgcccctcagcaactgcagctttctgccgaggccttggcccggatcattctctgtccacgttggatatggttcaggaaatacgtggtacagttccacctccgtctccggcttaagtgcataacgtgcaatcgtctggaacgcctgctccacgtt

SEQ ID NO: 710065 - DNA, 346 bp, Homo sapiens
ctatggaaaactctttgcgttgttgtataatttgaaaatccctcctgtgtctgtctgtgttcagatgtccccttaacatgataacagcagtctatactagactgtgggcacaactttatgaactacatcttaatgtgataatctacctaaggactatttccaaataatgtcacactcatgggtactgaaggttaggagcttcaccatctaatagggaggacacaaattcaatcaaaaacatataccatgttagtaacaatatgcaacatgtacccatatggcagaagattttgaaagaacaggcagaaataacagtagcattgttagggtagggtcagaacatatg

SEQ ID NO: 710066 - DNA, 235 bp, Homo sapiens
attcgcggccgcgtcgacccatatctactgtaaaagatgctgtggtgtatagcacaaattcccacgcacaccattgtgttactaacatgtacaggatcaccccattattcctgtaggatgggaaccaagaccctccgtgaagggctaaaaccggaattagttccaaaccctaatatactgcgctgttctttacatgtatatctgtgataaggctcaatttgaaagttaggcccag

SEQ ID NO: 710067 - DNA, 659 bp, Homo sapiens
agcggggtgctggtgcctgcccggggactctggagcattgggatttgtagcgctgccctctgtgtgtagtgctgtgctgtagcggagaggcgtgcgggatcgggatgtcgtgtggctgctcactgtgaccctgtgagcaggagagcgcagtgagccgcggtaccccggcttcgtgcatggggctggatgtggtgcagttctgtgatccgcatgccacgtctatgacctgggcggcgcgggtctgcgggctccagctgtggcagaaggtaggaacacagtcttgagtcctcagaagtttggcttgggtcagaacatttgatcctgattgttacgtttgagacttcaaaggtttggtttgccggttacagtcgcacgcgaaaggcgtgtcaaagatgacttgcgaggtgagataagcagaattgacattcaaagagttgcttgggatcatatgggccgaatttgtctatagcagcaggagtgaaggcaaagcgtgtgttaattaagcgtgtgggaaaagcagagggagagagatcgacggggagaaagtgcaatatggaggcaggcaaggcgtgttgtaagtaggagggtatgggcaggagatgaacgttgtagagggaaggcctgtgttgtggacagcgtttgtggtaagggagttctac

SEQ ID NO: 710068 - DNA, 122 bp, Homo sapiens
atgacgaccatctggacagccaggacttccattgacttggcacgactctgcatgatgtagatgacactgatgattctcaccagtctgatgagtctcaccattctgatgattctgatgacctg

SEQ ID NO: 710069 - DNA, 257 bp, Homo sapiens
ggatataatttattaggtgttttactggggctaactatattttcgatacgtgatccagaagtttttcaaaacttggtactttatttacaacaaccgcaatttatcagcatcattttaatcatgtttttggtgctggcgattcctttgtatctgagtacttattgcttttatgcaaacaagcccagcgattggaggcaaaatggttggatctaaataatcctggagcttcccttttttggcggttaagccatggacaa

SEQ ID NO: 710070 - DNA, 498 bp, Homo sapiens
cctatactacccagcgaacctctaaaggcacagaatctctcttcagctctatactcctaacgtccggccaccaaaatcggggaacaatcacaaaagatataaagtccttcatatggggttctggaaaaaagggtctagtattctacaaattaattctaaacaaaatagtaaaccacactgggaagccccgatttggcattctattacaagtcagaagtacttaaatggtggttatctctcaggagggggaccggagtggggaagggtgtggttttttggccatggcagtactcggatgaaaaagtaacagaagacaaaaacatgatttggaagaagagggagaaaaattcagtggaattacccagtttctcattattccctagggcaggtgacttaccaatctccaactaacaaaaggttggtcctctcataaatctagggcaaaggcaagggatggacaagaatctggaatgtgaatcagacctcctttgttggttt

SEQ ID NO: 710071 - DNA, 782 bp, Homo sapiens
  misc_feature (47)..(47): n is a, c, g, or t
  misc_feature (83)..(85): n is a, c, g, or t
  misc_feature (116)..(116): n is a, c, g, or t
  misc_feature (119)..(119): n is a, c, g, or t
  misc_feature (132)..(133): n is a, c, g, or t
  misc_feature (146)..(147): n is a, c, g, or t
  misc_feature (188)..(189): n is a, c, g, or t
  misc_feature (210)..(210): n is a, c, g, or t
  misc_feature (367)..(367): n is a, c, g, or t
  misc_feature (393)..(394): n is a, c, g, or t
  misc_feature (396)..(396): n is a, c, g, or t
  misc_feature (453)..(453): n is a, c, g, or t
  misc_feature (495)..(495): n is a, c, g, or t
  misc_feature (508)..(508): n is a, c, g, or t
  misc_feature (570)..(570): n is a, c, g, or t
  misc_feature (574)..(574): n is a, c, g, or t
  misc_feature (636)..(636): n is a, c, g, or t
  misc_feature (638)..(638): n is a, c, g, or t
  misc_feature (759)..(759): n is a, c, g, or t
acatggcgacagaagacgagacacaactcctcccccactgcctcccngctcaagaggggggacaaagagggggtgagacagcnnnagggagacctgagcctcagtccagccctacnggntccaggcctgcannaaaggagggtaannaggaggcagggcccagccccccagtgtggggaaacagctgnnggaaggcccccctcaaaaggntccacctcctcaccagcactcctgcccagggacagggagcccacagcagcaaggggaccccggggccatggccacattcatgactgagaagcagctgagtggaggcaggagacacgattttctgggcagaatcagttggggcaggggcctgggaggnccccttgggcaaaccctgaggtcacnngngggggcccaaagcggggctagtgagtgtggtcctgagtgagtgggtcagcggctggncccctttctccagctgcctgtggcccctccaatactgctgcngggggggcccgcntccagggtaatggataagttagcagcctgcccctgctgcagacagagccaggtggctaaggncagnttggttggtccggccaggccttgccacctgcccccagaggcctgtgggaaaaggacaggtcntntagggtggggacaggggctcgaccggctcagatccaagatggtgccacgcttgcttgctgagtcccccatgagctggggtactgcactggggccagcgactagttagacaggaggcagcancttctcaagaaattccttcacag

SEQ ID NO: 710072 - DNA, 484 bp, Homo sapiens
tcacagagcaagacaggtatactatagtacaagcacgtagcccgcctcttagaacctctcatttcctttccatcgtggaaatctatcctcaaggaaataacttctcaggttccatctgctattctactactcctcagggattattcaggtcccctcccttccctacccatcaagctcgaggatttgccccatccaggactggcaaattagctttactcaacatgccctgagtcagataactaaaatacctcttagtctaggtagatactttcactggataggtagaggcctttcctacagggtctgagaaggccaccacagtcatttcttctgttctgtcggacataattcctcagtttagccttcccacctcaatacagtctgaaaacagatgagcctttattagtcaaatcagctaagcagtttttcaggctcttagtattcagtgaaacctttatatcccttacggtcctccatcttcaag

SEQ ID NO: 710073 - DNA, 167 bp, Homo sapiens
tagttggagctgcagtggctggttacaccacagctacagaaatgcagaaccaagctgcatctgtaacctacaccacagctcatggcatgtccaaattccttaacccactgagagaggccagggatcaaacctgtgtcctcatggataggacgcgccatcgtgcgctt

SEQ ID NO: 710074 - DNA, 355 bp, Homo sapiens
cccccccctcaaacccccccaaaaagaaaaaagggggggcggcccccatgaaggaattggaaaactgggggggacccaggtaagggggcccagggcgggcggggcccagccaaactgggggggcctgcccagcaaccaggggggggggggtggggggcaggcaggatgggggccgggcgggtcccctcgctttggacttcccccccaaaccagaagggccgggttgcggccccctctcggcaaggcaggggtggccccggggaaaggggggggggggggggggcgggcggggggggaggggcccgcggtttaaaaggttgaattttggtaaaaaaaacgggattggcaaacccca

SEQ ID NO: 710075 - DNA, 150 bp, Homo sapiens
acagctctctgtggggcttctggctgtggagggctcactccatgtcaaatctccacagtttacctgggctcaataggtttgaaacccagcacattaatatgaccttcccaagcaatgcaccaactgcaatgcaggtcattaacaattatc

SEQ ID NO: 710076 - DNA, 199 bp, Homo sapiens
aggagaccatcaaagaagcggctggagacctattacaaggtcacagaaccctgtcatctgccttctatcagaaactgtggctattgttgcgcacatggtcaactgctgatgggctccggtggacatgtgtcttctcccagggtctgcacccaccatggaggccctataagtagcaacgctggatgcggtgtatcgcttg

SEQ ID NO: 710077 - DNA, 127 bp, Homo sapiens
ggctatcacatatctgaacaactgataacatgtatctccttcacaggttcatggtcaggtgttaattccacccgcgtggattctttcacatctctggtctttatttaattcccgtcccaaactctcc

SEQ ID NO: 710078 - DNA, 248 bp, Homo sapiens
aggattcgtagatccggaacatcggtccaccccagagcaggcagcaagaaccgcatccagcacccagcaacgtgctgcacttcttcaacgcccctgtggaggtgaccggaggagaacttcttttggagattctgcggatgagcttggggagttggaagcgggccatctttctgtgaaaagtattcctcagggctaaaagttggagccgcagttccttctgggaactggctggatgtggggaatccaaa

SEQ ID NO: 710079 - DNA, 734 bp, Homo sapiens
  misc_feature (141)..(141): n is a, c, g, or t
  misc_feature (156)..(156): n is a, c, g, or t
  misc_feature (178)..(178): n is a, c, g, or t
  misc_feature (190)..(190): n is a, c, g, or t
  misc_feature (193)..(193): n is a, c, g, or t
  misc_feature (199)..(199): n is a, c, g, or t
  misc_feature (231)..(231): n is a, c, g, or t
  misc_feature (603)..(603): n is a, c, g, or t
  misc_feature (624)..(624): n is a, c, g, or t
  misc_feature (704)..(704): n is a, c, g, or t
gtagagatggggttttgccatgttggccaggatggtctggaactgacctcaggtgatccacccactggcctcccaaagtgctgggattacaggtgtgagccactgtgcccggcctctttttactttgttaatggtgttttngatagataacagatngtcattttcatgaagcacagcnggtcagtttatngtngctcangtatttggcctcatgttcgagtccctgttttnaatcatgagctggacacagccctctttagagcaactgtgaccacttgtggtgagaagtgcagcccacaccatccacgtgaggctcccacacgccatccacgtgaggctcccatgcagacatttagaaggcgttttcactgcagctcagaaaatggccccaggcccccatgggcacccccatgtcaccagggcctctggttgctgccggtacacagggataggcagccaggcctcgaaggtgctgggcatgggtttgggtgtctgcgttgggtagagacccggagcgcccttgctgggcgtgccctaacatcccggtaccctgtgcccctctgtgggccaggacgcctggtgctgccagctgggcgtaagctncaggagctgagggtggctgtnatttggaggatgagtaggagctcaccaggagggcgtggagccgaggcgtttaatatcatcaggagcaacacttggctcanaaggcaggcacactttccgtccctccagag

SEQ ID NO: 710080 - DNA, 661 bp, Homo sapiens
gtggtagagggaatactaacagatataattacagataaattatacaataatgacttcagcgtaaatctatatgcacaagatattcaagtctcatcttcaggacatttacttgtggattatgaccctctctacttccaaacaggatttgaaatggtgcttcacggttgctcactcccaggacgaaaagctctgggtcatctagatttgggtagagacttttgagtccctctatgatcccaaattataactagcacaaaggtaagctaacaaattccctgacaggcaggcaggaaaaatgctcccgaaagacaagtatctttacaaatgacagaatatttattaacaatacctttaaaaaagattacatatgctagatcactggtaaatatcatttacactggggttgggaactccctgggtgtcattttttttcgttcattttattattttgctgatttattttttgcatgtgattttaaattttatttcaacatagaagtaaccatatcaaactaagaaaggaacacagcttgaaatactgacaatatttttttccggttaccaccctagtttttacacaaatggaatcccgattatgactttatcggataaatataactagaaggttgaaaagttatattttttgtaagcaaaatgacaa

SEQ ID NO: 710081 - DNA, 207 bp, Homo sapiens
ctgaagctatcagtaagcggagcatcagtaagcggagcactgggcagaaatcacagcataacatacccccagcaggtgtgaccgctccgtttactgacgcttactgcccgcttactgtcatcaaaccctatagcgacgtcgctttttgactccttcgatgtcggctcttcctatcatttgtgaagcagaattcaccaagcgttggat

SEQ ID NO: 710082 - DNA, 432 bp, Homo sapiens
gtttatacagaaagctttaatagttagtgtgtgcccctggtttttattcttccccctgctaaaatacctctgtaagcctgatcctttattctttcatatgctgtataataaatgtattgatttcattggccatctaaaatgttgggtgtctgtcaatgaggccgaacggtgggttgcttttttcataaaataatttctattgggggtttctgttcaatgacagcaggtcccctataactgtgaatgtttcgtgtcgtcagtatttgcattcatttcataccagtgtgccagtcctgtgactccctgttttcctgaaaaacatgttatgccaacctaacttgagtacagcaaactggttttaggtttcaatgacattaatgtaaaataatatcccataaataaaaagtatttgtgtttggtttcagaaaaaaa

SEQ ID NO: 710083 - DNA, 121 bp, Homo sapiens
gcccaacgacctacggcactttgaccccgagtttaccgaagagcctgttcccaacttcatttggcaagttcccttgacagcgttcttgttcacaaccagcgtcaagggaagcttcccgagg

SEQ ID NO: 710084 - DNA, 81 bp, Homo sapiens
ctgtatttcgctgggctctctaaatggattcagctccagaggaggaaaaccttgagaccctgagactttcagaaacttctt

SEQ ID NO: 710085 - DNA, 1076 bp, Homo sapiens
atcggagttgctgtcgtgaggtcgccgtgtcctatgcgcgggggctgtgcggcggtttggggtccgggggggctggttgtcggggacaggtctgccgttgctgttgtgcgcgctgaccgtggtgccgggcccggggtgccggcggtggggtctctgggtgtcgcgtacaggggggctagcgcttcgtcgccgcctgggtcccactgtgaccccatgccattccatatgctgtccccgccgtgaatttttgggtattatcccctgctcatggggcccagtcgtttggggccccttccggggttagtcaaccgctgtcgctgagccccctatgtacctctgtcgcccggggcgccctctgtttaccctccgcccagtgtgtccgtgcgcccgtgtacatcgccggccccggcctgtgggttttcaccctcggtctgtctactttggacgccccccctgccccattccccgccccgctgtaggtcaaccctcataccttggccctcctagttgattgctagccaccctctagccctatgccggttactcaatcctctgatcagggtgagcatccgaactccaactaccccctgatcggcgcactgcgagcagtagccccacacacatctcatatgaagtcaccctagcccatcattgctactatccaccttactaataagtggctcctttaacctctcccacccttttccccaccccaggacccctctgattactcctgccatcatgacccttgcccataatatgatttatctccacccttagcagagacccaccggacccccttcgaccttgccgaaggggagtccgaactagtctcaggcttcaacatcgaataccccccaggccccttcgccctattcttcatagccgtataccccaccattattataataacaccctcacccactaccaatcttcctaggaaccaacatatgacgcactctcccctgaactctacaccaacatattttgtccacccagaccctacttctaacctccctgtttttatgaattcgaacagcatacccccgattccgctacgacccactccaacctta

SEQ ID NO: 710086 - DNA, 213 bp, Homo sapiens
cacagagcagatggccgcgtttgtgatggatggattattaataacattaccttactgatggaggcaggattgtaaaaaaaaatgcctttgagacagtttcttagcttttaaactggtggtttcatttctacgtggttcttggtcacagcaggtgtcagcaagccattccattcgttggcatcacatgttcacacattgtgtcacagtttccag

SEQ ID NO: 710087 - DNA, 1040 bp, Homo sapiens
tcagcgagaacccagacctttcccaacagctcaggcattcttcgaacaagttgcagacaaattgatgacttccaacagctgcaagactttccagattgcaagggtcacaatcacgcatccaacctattcaaaatggcaaatggctgtcttagggctgcctttccaacaggcagctcgcacacgcatcattgctcagtcctcttcagcgggctctgggcctggcatgccggcaggctcacacaagcttcctcttcttggcctcctcacacacagcacacacacaggcaactaagaggtccaacacacatcctggtccagatgacaccatcattccagcttcatctccaatatctcttacagggccatgttatgcaccaccgtgggcccacaaatgctcacacctggctgcccccagatttcatctatccagagtcacaatcacaaacagggccttatctagcgagggttttaaaacatcgaccttaggcagagggggttcataatagaacggaaattgcctagggaggggctttcataggcaaacgatcacaacgttgcacggccaggccaaattgcaaaacatgggctcactcgctctgccatcccctcataacgcctcaccgcacaacacctactggcttacatcggttcgcccacttccctcctaaaatccaccctaacccgctccacgcctattccattcacgacacgtcaacacgcggtaacggcgttcggcacactatcaacccccccaacaaagccatcaactcgactacaacggggcgcaaaacctcacctccgccaacccaaacgcaaccgccttacaccccccccacaccagcgccaaccagtagctaccaaaccgccgacggaaccacaaaccacgaccacaccagtagcacaaacaatacctcctccgggacccgcagggcgacacgacccatggcaaggacatcacaacgcgcaccacccacactgcacgggaaagcccccaacctaggcaccagcgacatcatcggaacggcaccggcaatggccca

SEQ ID NO: 710088 - DNA, 1174 bp, Homo sapiens
caggctttcatttgcgcagcaaggcaacgcagcagcaaggcacacattcagtgcatgcatgcaggccagcaggcacagcagcacacaggtgcagcaacagcacagcaggcaagcatcaacagcatgcatgcacagcaccacagccccaagcatcgcacagcatggtggagttccagcatgcaggcaggcatgcaccagcgagtcaagagcatcaagcacacgcaagcacacacactcaagcacagcatccaacagcagcacacatcaccattgcatccagagcaagcacactcaaaccaagcagcccaagacctaatattagagacacccaggcaacaccctgacatgcaccatcccacccccacagaagagcagtcataggcagcacatttcatcacgacaggcagaccgtcccactacacatagcactctggagcacagacacctcacgtattggaccagatccaaagccaccttatattacctaggtcacgcaacgcgtacccagatctggcacacttcgcacgcgagaccatttcgccatcaatctatcatctacccttccagatacggagagaccatccccctttattgcaccctatttcgtatcgcaggcacaaccacaggcacaggcacaaacaaggcaacccacaaccaatccacagacaccttgtctacaatacgttgccctgaaccccgtttggttctgttataccaatatccaaattggggcaccaatgccgtaaggtcgcaatcggcacgtctaagacataaaccccaaagcaatgttacattccttaccaaaatttcactacataccccaggccgagatcgttagaggtaaaagaacataactttagcaggggcattctcggccttagacacaagacgaatattcgaccgcacccggacgaagcaaaaacatagggtcccacaacaggaaggcaaaggaaatcaccatcaccacgcacaacgcgcaacacaaggcacaaagcaagcaccacagaacacacccttaccaacacaacaggacacatcgaccaggcagacaacaaatccacgtaacggatcacacaccgacacaccggaagcaacgtgaagaaagcgccgatcagtcaccagaccatgacaagccatagggcgcgagagacaaaccaacacaacagcgagagac

SEQ ID NO: 710089 - DNA, 841 bp, Homo sapiens
ggagtcccccataacctgagaacgaagagaacaattggctgggcgaactggttgaagaagggtggcgcgcaactggaagggctgattcaagggggcagcaaggaacaactcttggacctggatgccaaggtacaaacagggcaaaggttggcaaattggttatactccttaaacccaagcttctttggattttgcaagggaaagccaaaaatggggaagcttgggaaagcacttgggtgattcaagcccccagccaaggccatggcaggaatatatctgcagtaattaaaaaactagatcccagttgggaatcctccaggataccagcagaaagaaagggaaaagaagcaaatacagggtttgggtgggcccagttattagttctctatatcatgaagaaacccatcagggaagaagaccaaaatatatttgattactggaggggaaaacaacattgaccatattacccaagccatcaaatcgaaaaatgtggatgtgaatgtgaacgatgaacgagggtagggctctacttcactggggccggtgatcgaggaccttaggaactaatcacagtgttggctggcacatagaactggacattaactggtccggaccattaatggcaaaaggtctaacttatgctttggctgtgagttctggatattgataaagtgtggtccagtctgggttgaacccaatttcgagaccagtattgttctgtcaaagaggtaatgcgtcaacagtttttgggctgctggccaatggagggtttaaagcgggactggtgtatacaagggctttagaaaaacattttcccgtgatgtggtcacgtggggggtgc

SEQ ID NO: 710090 - DNA, 964 bp, Homo sapiens
taaggagggggtgaggatgggagagaatgggcgtggttgtgagaaacatgagggatccttgtgatgatggaaatgttctgtatcacagctatcgatgtcagtatcccagttgtgatatgtgctatagtttgcaagatgttaccactgggggaaattgggtgaagggcacatgggaatctctgtattatttcaactgcatgtaaatctacaattatcccaaaaaaaaaaaaaaaacaaaaaaaaacaaacacttgggggggggcgccctggggccccgagaaaagcctttttcaacccccccgttgggggcccgggccccagggtgggaaagggtggcacaaagcactgttcgcccagagagaaaaaaccgggggccagtgaaccgagggtggtgcgggactctctcaccaattaaaaacagggccgcgggggggcacacccgcgagcggttcgtggaacaccaatccaggagaggggcaccgggaggcacctacgaggggcatctcaccaacgatgaagtcccaggcgcacctcgatcgaacaaaatacgcccccccccgtggtccccctgatcctcaccacgcacacacgcacgacagcacacagcacgaagcacggacaccgcacgacggaccgccagagccgaccggaggagcacggcagaccacgcgcgcagcgccgccagcagcgcgacgggcgaccggaagcggaccgagaaggccgacgccggacacccgagcacagcgaaacgcacgagcaccaccgacagagcaaccgaccaaagaagcagagagaaggcgacaggcggacccgggagcgcagaaagacgcaacaggcacgtcataggaaagcgaaccacggacagacaaggaaccgggacaagggagggacgacggcaccggacagggcccagaagcgcccgccgggcgcgacagcacccacgaccacgcccaagcgcaggcgc

SEQ ID NO: 710091 - DNA, 108 bp, Homo sapiens
ctcattgaggtatagtaaaagggagcatgaacttgagaaaatacgctttcaatcacaaggctgtaataatataggtcaaatcagattctgcattggagatagaaaact

SEQ ID NO: 710092 - DNA, 439 bp, Homo sapiens
  misc_feature (430)..(430): n is a, c, g, or t
tacaaggttgtacaaaccatccccactatctagttttagaatattttcgtcacctcagaataaaccccaaaccctattatgtagtcactcctcctttccccctcttctcaaaccctaccaaccactaatctgctttttgactctatggttttgtcaactctgtacatttcatataaaggaaatcatacaatatatggtcttttgtggctggcttctttcacttagcatgatgtttctaagggtcatcatgatatagcatgtatcagtacttcattcctttttattgccaaataatgcacctctgtttttttttaaaggacaagagtttcgctcttgtttccttgggctagagtgcagtgggtgccacctcgggcttcactggcaacttctggcctgctggggtttcaaggcaattcttcctggcctcagncttcccgag

SEQ ID NO: 710093 - DNA, 909 bp, Homo sapiens
ttttttgggttttttttttaacccctccttagtcttaatcgcgctcaaaaaccaatataaaaccccccccccatgtaacgggggggcagggacaaaagcaaaaaggcaaaaaccccagccgggaacaccacaaggttcctgtgccccacgcgcaaatataaactggcccggaaggggcatttgtggggtattatcaaaattcgtgggtcccgtggtgagcagtggaggactgagagtctaaagggggtgagacacccatcgcaggggggcgacagctgtggcacacagtgtgagaccccacgtggtggagagaaagtctcagagagggggagagtgtggagagaagagggccacgtgtggcgcgcgagccgccgggaacatcagcgtggtggacaccaagggagcgtgtgggctccccacgagaagaatctccgtgagagagtgcgcggagagagaggagcggagaatgcaggcgcccgagggggcaccccccacacgaaggggtgtctacaagagagaggggggttgcacaccaccgagaggtgggcacacacaaagaagagaggggtggggcccaccactccgggggagctgtggagcccccgagagagagggcagtgtgacccccgcgatgcaggcgggagaccaagagggggggggctcaaagcacgccgcagtgtggtggtgttctcaaacaaccggagagaggggggggtccacccacaacttgacgaggggccccgaggagaggaccaaccaacggggtgatgtggctgcacgaggagcaaaattctgcggcgggcaccaacacacatcgtgatgagtgaagagggagacacacccctcatccccgcgacgatatacgaacaccacatggcgatgagagaccaccaaactctcaggggcacc

SEQ ID NO: 710094 - DNA, 400 bp, Homo sapiens
tagactaaatgaccatgcaaaagatatagttgaaagagaagaattgttacatataaaagagaagaaagataagtgatagcataacgttcctaagatggaaaagggcatagccgggcgtggtggctcatgcctgtaatcccagcactttgggaggccaaggcggacggatcacctgaggacaggagtttgagaccatcctggccaacatgatgaaaccctgtctctactaaaaatacaaagaagttagccgggcacggtggtgcatgcctgtcatcccagctactcgggaggctgaggcaagagaattgcttgaacttgggaggcggaggttgcagtgagccaagatcacgctactgcactctggcctgggcgacagaatggtactccgtcttaaaaagaa

SEQ ID NO: 710095 - DNA, 144 bp, Homo sapiens
tctacacgatcccccgcggttctcagcatacaacacatgttacagtggacgtgcgatagagcatccgccgggctcaggtagccaggctgaagggggctgcccggctggcccctgctgcagggtggctggcttagtatctggagc

SEQ ID NO: 710096 - DNA, 142 bp, Homo sapiens
gtacaagaggaatagccacctgtgcttcccaataagcatggccgatggcaagaccagacagaaagcagaataagaacaacaaagatcgtgtaaaccatgtagttcatcaagtaatcaattttagttctatttacatctttta

SEQ ID NO: 710097 - DNA, 461 bp, Homo sapiens
ccgcggaccccttatcagctctagcgcatgtatgaaacggagactgcaatttcatcgcttcatgactgagccccacaggatcgaagggccagatctgtaaccgggtgactgtactatcacgaaatggaaaggtttcaatgacgttcattgatgtcgaaatttgggaccagcgctcaagactaacgccatatgtccgttggggacgatcagcaagcatcgtatgcttatcaaggaaggtatcacccacttgagcgtatccatctggatcaaacccactcacatatacatcagctaaacgcggagatgagatgagcgacctaagtacccaccaaggagtagagccgtcattcaacttgtattcggaagccaggtgccgttccagtttttccagcagatcagggtgatttgccataatgagcgtcgagatatcggtcatatcagttttcctcggggatcctcta

SEQ ID NO: 710098 - DNA, 293 bp, Homo sapiens
atttaagggagcccccccggggtttttgtttgggggagggggggggggcgcccccccccccccccccttttggggttgattttttgcgcccccctttttttcccccccggggggggggcggggaaaaagggggggggcccccccctccccccccgggccccttaggggggggggggggggccccctttgttttttttttttcccccccccccccccccccggggggggggggggggggggtttttttccccccgggtggtttttttttttttttttggggtgttttccccaga

SEQ ID NO: 710099 - DNA, 314 bp, Homo sapiens
gtagcacaacctagggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 710100 - DNA, 541 bp, Homo sapiens
tgtaatctcgcaatcctagtgacgactgtggtagaaacgtgggtcaagtagattcaccgtctaccagctcctacgctgtgtccatgaggacaaacaggatacgacaacttgtcatatagataaccttatccctgtggtctccttgacaggaacaaggctacctctcaagagtcagtgaagtgttagtacatatgcacaagtctactcaatttaacacatacagttattcaatgatctctgggggcagctggccccagtgagccatgagtccaggtggtgttaaggctcactggtttcgtggagactggtccttctaggaacagcttgagaagttgagctttggacagggattcaaatgtaatgcagaacttcaccacttcagctgtggggctatgtggttcttcagagcaagcacatctccttctgtgagtatcttcaaggaccaatcaacactcatccccagtgtcctgggcaggaaaacatgactgcaaggagtgacccacaggctctgagcctcaattttggcttggagcaggttccc

SEQ ID NO: 710101 - DNA, 1837 bp, Homo sapiens
cacgcgtcgcagctcgtctgatccttctctgagccctcctgagctggaagatttcatcctgatggctgactcaaaaccactcaggaccctggatggggaccccgtggctgtggaggccttgctccaggacgtgtttgggattgttgtagatgaggccattctgaaggggaccagtgcctctgagaaggtctgcgaatggaaggagcctgaagaactcaagcagctgctggacttggagctgcagagccagggcgagtcccgggagcagatcctggagcgctgccggactgtgattcactacagtgtcaagactggtcacccccggttcttcaaccagctcttctcagggttagatccccatgctctggctgggcgcatcatcacggagagcctcaacactagccagtacacatatgagattgcccccgtgtttgtgctcatggaagaggaggtgctgaagaaactccgtgccctggtgggctggaactctggggatggggtcttctgtcctggtggctccatctccaacatgtacgccatgaacctggcccgctttcagcgctacccagactgcaagcagaggggcctccgggccctgccgcccttggctctcttcacttcaaaggagtgtcactactccatcaccaagggagctgcttttctgggacttggcaccgacagtgtccgagtggtcaaggctgatgagagagggaggatgatccctgaggacctggagaggcagatcattctggcagaggctgagggctctgtgccatttctggtcagtgccacctctggtaccaccgtgctaggggcctttgaccccctggatgcaattgccgatgtttgccagcgacacggactgtggttccatgtggatgctgcctggggtgggagcgtcctgctgtctcggacacacaggcatctcctggatgggatccagagggctgactctgtggcctggaaccctcacaagcttctcgccgcagggctgcagtgctccgctcttcttctccgggacacctcgaacctgctcaagcgctgccatggatcccaggccagctacctcttccagcaagacaagttctacgatgtggctctggacaccggagacaaagtggtgcagtgtggccgccgcgtggactgtctgaagctatggctcatgtggaaggcacagggtgggcaggggttggagcggcgcatcgaccaggcctttgctctcacccggtacttggtggaggagattaaaaagcgggaaggatttgagttggtaatggagcccgagttcgtcaacgtgtgcttctggtttgtgcctcccagccttcgggggaagaaggagagtccagattacagccaaaggctgtctcaggtggcccctgtgctcaaggagcgcatggtgaagaaggggaccatgatgattggctaccagccccatgggacccgggccaacttcttccgaatggtggtggccaaccccatactggcccaggccgatatagatttccttctgggcgagctggagctcctgggccaggacctgtgagctgcttctgctctctgccccacccaagctctgcgtagtctcctgggttctcaaaatcgacctttctaggaaacagtggccttgactgtgtgtgctcccacacactcactctcccagctaagtattggctgtcaggaaggtgtctaaacacactacagtatgttcttacgaaatatgcttttattaagttgggcacaggggcacacacctttactaccagcattggggggacagaagcagccagtttgaggccagcctggactacagagctgggctacacagagaaactgtctc

SEQ ID NO: 710102 - DNA, 220 bp, Homo sapiens
taggggaaaccactaactataccaaccagctatatacagcacactaaggtgggctatcagtgctcactcaatgtgtttaggcagataccacttttgaaaaacaatatgaaatgtgtgctcaactagccagtaaattttttaaaaagcactgtcccattggattgatagttagtattataatagagatattctgggtatatctctgttattgatagtattg

SEQ ID NO: 710103 - DNA, 174 bp, Homo sapiens
agataaggcgcttcaggctaccgcaagaagttgcttgaacacaaggagatcgacggccgtttaaggagttaagggacaatttaaagacttaccaagcagtattaaaggcttaaaatactttaggcccgtcagagatttggcagactgtggtaagacttacagttacttagaaaa

SEQ ID NO: 710104 - DNA, 164 bp, Homo sapiens
  misc_feature (154)..(154): n is a, c, g, or t
gtatcccaagtagagatggggtttcaccatgttaaccaggctggtcttgaactcctgacctcgtgatccacccgcctcggcctcccaaagtgctgggattacaggtgtgagccactgcgcctggcctgtttgttctttttaagcaacaccttcncaccccgtcg

SEQ ID NO: 710105 - DNA, 278 bp, Homo sapiens
aaaaaaggggggggggccccccctgccctttttccttggggggtccccccctcccctggtggggttttggggggcccgggcaaatgggccccaaaagggggggcgggggggggcccctttccccccgaagggttttttttttttttttttggggaaaaaagggggaaaaccccgggccctggttttttccccccccgaaagaagggaagggtgtttttttttcccaatggcccccccctttggtttttaattaatttaaggtttttggacgctgggga

SEQ ID NO: 710106 - DNA, 519 bp, Homo sapiens
tccgtgcgtaggcgacggcgctgctgttccgatggtgtctttgatgttgggctgatgaggtctggttcctctagcttcaacatccagaaaccgatgccagagttcaggtacttgcatgtggttgtcaagttctgcatattcatttccaagctagaggttttcgtgttcggatgcacaggcccaagcttgatctgagtatcactattattttcatgttgttgggtactcggaaaccgaaaggatagtggtatgcatgtgccgagtccgtaggaagaaataaagaaacgagaccggttcttgccgcagccccatcaaggctgacgtgtaacgagcgaaacggcgcctcctgctttctctgtcctcgccgtgaaacctggtcctattgtcatgttcgtgcttttcacgtccaactggacttggggtcttggccttcggcagctggtgtccactccacccgcactggggccctgtcttcgtctccagcccgaacgctgcggtcccgatcccggcgccgtcgcc

SEQ ID NO: 710107 - DNA, 211 bp, Homo sapiens
ggctccatacggaaagcccatcctaacacatccgtctctcgcatcaggagtatcatcacaggagctcaccatagtctaatagaaaacaaccgaacccaaataatcaagcacggctactaacaatataccggggtctactattttaccctccttaacaagtactcagagtactatcgagtacaccctatcaccatattccggagcggctatc

SEQ ID NO: 710108 - DNA, 297 bp, Homo sapiens
tagatttcagcatacgcagatacaatacagcaaatcctaaccacccaggtgatttgacaaacgggcccgtccatggacatagatgacttcatcagatgctacctggattcttcgcagcaggtatcatatttcctaggtattaggaaaacagaaattttcaaggtcacgacaagaaatgaattatgtatgcctcgtattttagaagataatgcttttgcttatttttagccattatttacttgactatctccggttcactactactactgtcgtcaccatctatgataccgcgaagga

SEQ ID NO: 710109 - DNA, 407 bp, Homo sapiens
ctcttattggcccctggcctcccctcatgcctgccagactgaaattcccttcccactctgctccatctgccgacatcgccccacatttgagggctccatccagcaacacttcctgggtaaccccttcctgacctcccaaggaatagggacaactcccttcctccgatccccttggggccccctgcctacacctatgtgacctggtcacaagcctgtcttccctaccagacctgggctccatgggatcattccaattccctgcagactgacacagggtctggccccaaagaagagctccatacacactgagttaacaatcaatgctatcttgtactttctaagtacactttccccttgcaagttgcttttatgcatgatttcatttgattctcagaataaacccctca

SEQ ID NO: 710110 - DNA, 560 bp, Homo sapiens
  misc_feature (26)..(26): n is a, c, g, or t
  misc_feature (43)..(43): n is a, c, g, or t
  misc_feature (65)..(65): n is a, c, g, or t
  misc_feature (70)..(70): n is a, c, g, or t
  misc_feature (88)..(88): n is a, c, g, or t
  misc_feature (106)..(106): n is a, c, g, or t
  misc_feature (134)..(134): n is a, c, g, or t
  misc_feature (146)..(146): n is a, c, g, or t
  misc_feature (151)..(151): n is a, c, g, or t
  misc_feature (158)..(158): n is a, c, g, or t
  misc_feature (162)..(162): n is a, c, g, or t
  misc_feature (167)..(167): n is a, c, g, or t
  misc_feature (180)..(180): n is a, c, g, or t
  misc_feature (198)..(198): n is a, c, g, or t
  misc_feature (200)..(200): n is a, c, g, or t
  misc_feature (206)..(206): n is a, c, g, or t
  misc_feature (216)..(216): n is a, c, g, or t
  misc_feature (236)..(236): n is a, c, g, or t
  misc_feature (253)..(253): n is a, c, g, or t
  misc_feature (267)..(267): n is a, c, g, or t
  misc_feature (269)..(269): n is a, c, g, or t
  misc_feature (277)..(277): n is a, c, g, or t
  misc_feature (282)..(282): n is a, c, g, or t
  misc_feature (293)..(293): n is a, c, g, or t
  misc_feature (295)..(295): n is a, c, g, or t
  misc_feature (308)..(309): n is a, c, g, or t
  misc_feature (313)..(313): n is a, c, g, or t
  misc_feature (316)..(316): n is a, c, g, or t
  misc_feature (325)..(325): n is a, c, g, or t
  misc_feature (332)..(332): n is a, c, g, or t
  misc_feature (343)..(343): n is a, c, g, or t
  misc_feature (347)..(347): n is a, c, g, or t
  misc_feature (352)..(352): n is a, c, g, or t
  misc_feature (366)..(366): n is a, c, g, or t
  misc_feature (368)..(368): n is a, c, g, or t
  misc_feature (379)..(379): n is a, c, g, or t
  misc_feature (389)..(389): n is a, c, g, or t
  misc_feature (441)..(441): n is a, c, g, or t
  misc_feature (447)..(447): n is a, c, g, or t
  misc_feature (452)..(452): n is a, c, g, or t
  misc_feature (460)..(460): n is a, c, g, or t
  misc_feature (481)..(481): n is a, c, g, or t
  misc_feature (559)..(559): n is a, c, g, or t
tcagcatcaccttgatttattttccnagtatttttttccccanaaggaaaaaaaatttcatcaanaaaanaaatgcttctgccaaagngaaaaaattttatgtctnaatgcttttctttaaaaaaaaaaaaagncaacattgaacnagganatgcccngctnccccncccccattttgcngacaaaattttaaaaaancnattggnagaaaaaaanaaattttcttcaaaaagagngattatgttttattgcnattttgtttagtananatttttcncaatngggaaaaaaancnaggggaaaaaaannaccnaanaagagaagnagtttanaaagtcaaaanattnaaatngcggcccaaaaaangnaaaaaaaattnaatgtaaaangtcacaaaatttcaaaaaacttaccccaattgtctatcatttatcaggtacnaaaagncaacnccccaaanaagattacagtcctttattanaagcccccccggggactatagtatacatttaaaaaacgccaccacaaaaattttcttttctttttgtttttgcttatng

SEQ ID NO: 710111 - DNA, 201 bp, Homo sapiens
cggcacaaccctcagaccactacactatcatcttcaacacgttcgtcatgatgcagctctttaagctgagatcaacgcccgtcaagatccactgccgagaggaacgtgttcgacggcatcttcagtcaacccccatcttctcgcacctatcgtttcggcgctctttcggagattcatgattgtcatctgtccgagtcggca

SEQ ID NO: 710112 - DNA, 659 bp, Homo sapiens
  misc_feature (343)..(343): n is a, c, g, or t
ggtgatgctgtggtgatctagaggatcccgacgctctctctggtggggtagggtgattaggtttaatgagagggtaaggggtgcaagatcggtcgccaaggagggagtagaggtatcttatactgtgtgggctaaggtggggggatacaagaggaggacgcaaaggaggcttgggatggggaagaagggcggcaatgagatatagatgtagtccaggaatagtcagggaagcagataatttagttaaagtgtctcagcctaataagggaacggggcaggtgcggataactaaaaaggagtgcttaaaagagtatggtctacgttggcaccagagttggggagntttaagaggtttagaagcctggccgtcaatacccacaacagttatggaggcaagggaaacaggcccttgaaaagaaggtaatgtggagtgggtagcctccgtattgattaagaaggggacggacttaccctccaccgtgagagttacctaaagctcggcatccgtgatggtctacggggcttctgaggcgatcaggcaggatcagtcttcagccggtaagtcaagaaggagtcagtcagagaaccttgagccagagttccaggggctctgggaggggttgcaggtgagttgcccgtcgatttcagggggtcccaca

SEQ ID NO: 710113 - DNA, 397 bp, Homo sapiens
acgcgtgggcgcgagcggccgctcgcgatctagaaccggacgcgtgggcggggtttcaccgtgttagccaggatggtctagatctcttgacctcgtgatctgcccgcctccgcctcccaaagtgctgggattacaggcatgagccaccacgcccggccaaaaaaaaaaaacttttgtgttttgtttgtttgtttgttttctttttgagacggagtcgctctgtcacccacgctggagtgcagtggcgcgatctcggctcactgcaagctccgcctcccgggttcataccattctcctgcctcagcctcccgagtagctgggattacaggcgcccgccaccatgcccagctaattttttgtatttttagtatagatggggtttcaccgtgttagccag

SEQ ID NO: 710114 - DNA, 832 bp, Homo sapiens
gtgtacacacgcgtcttccctgtatagggcggtcccccttcttggtcccccgttatactttcgcatatggccgcccatgttccttgtagcccccgttgtctaacacactctcgcaccgactttcgtatgccgaacaactttctcggccgctcccgggattttagacccgtttggtagatgttcgtgccccgcctatttcctttggccgtctggccgctgccagttctagcgcgtccctgtttcattaaccaacggggctcacgagtccccctcccgttgcgaacaaaaccagtggcccaaccccaggggcgggacccctcggggttcaccccggcttccggccggctatatttttcgcacatctcctgacaaaaagagttcgccgccccgtattgtctcgcttgaccaccggcggaacccttccgaatctcttgaacgggtgcccacatctcgcgggtgtgggatcttctcccgcgttgggagccccccccccttcgctgatttattaatgtaaccttccaacgccaaagagtttctctgcacacttcaatgagagctggtcccccactacattatggtggctttcaaaccacgatagcccatattcccgcgaacgttgttgaaccccacccaccttgctcaccgcgctaacaacgacgcggggtataataaccgcgttccatggtttcttgaaatctttggggccacacaaccacccacggtttcactggcccctctgcttctttagaatttattcccccctaaaaaatttttaaaaggggccgttttttcccctttggccccccctttcccccttttggaccccaaaaaa

SEQ ID NO: 710115 - DNA, 122 bp, Homo sapiens
cacgagggggacagacgccatgatgcacatgtctggcgttctgaggaaggtcattgattacatcatatacttgcagcaggtcaatcataaactgcgccaggagaacatggcgctgaagctgg

SEQ ID NO: 710116 - DNA, 199 bp, Homo sapiens
tgagagacgtgtctcacttataagtgggagctaaacatttagtacatatagacacaaagataagaataatggacaccagggcctaattgaaggtggatagtaagaggagcatgaggttcaaaaaaccacctcttaagcacgatgcttatcacctgggtaaagaaatctgtacaccaaagcattgcaacacggtctctca

SEQ ID NO: 710117 - DNA, 127 bp, Homo sapiens
ctcgtgcagcagtctattctccacttccaagctgcgttcagtgcttgtgatcgcccacgctgcactgtcatcagactttgatacagttgacgactgatgcttccgttttctctcattttcatcttgg

SEQ ID NO: 710118 - DNA, 422 bp, Homo sapiens
  misc_feature (322)..(322): n is a, c, g, or t
  misc_feature (338)..(338): n is a, c, g, or t
  misc_feature (353)..(353): n is a, c, g, or t
  misc_feature (387)..(387): n is a, c, g, or t
  misc_feature (402)..(402): n is a, c, g, or t
taaatctagtaacctatgtgaacagttcccatttcaataatatttatccacagcatcactttcaatggaaaaataatactgcttttgatgcatgcactgtaccacatttgtttatttaaccaattcctattgatggaaattctgatttcctttattctctccctccccctctaaccttccttccttccatcttattacaaataaccctgttattaatatcattatagggtaaggcctttgcacataaagcttaattgtttttgtaggtttacattcgtaggaaggtggaaattggctatggtcccaaaaaatggcacttttnttttttcccttgaggnggggattttcactcngtcaccgggggtgggagtgcagtgatctcggggntcatggcaacctccntttcgggggggttcaggcgg

SEQ ID NO: 710119 - DNA, 337 bp, Homo sapiens
  misc_feature (150)..(150): n is a, c, g, or t
tttcccttgaaaggaaggctttggggtttttctgttacctgtcaaaggcaggaccctttgagggcatccaaaggcaggaaaccgtcccgtgggtctcctggaaaatcgtcctagttacatttcaaggggcaaaaccgtggtgggttttgnctggaaattcatataaactttttaaaaagttgagtgataaagctaacccctatctgtaagttttgaatttatattgtttcatcccatggacaaaacccttttttcctacaaaaagtttggggttgggggggggttcttttttttgttttggttttgttttttttttttttgcgttcggggggttgta

SEQ ID NO: 710120 - DNA, 286 bp, Homo sapiens
ccaaggagaggagtcgggtaacttggaggattccagcctcagcaactgggcagaaggtgatgtgatttttctgaaaacaagggagaaatgggcttgggaagggaaatttgatttgagacatgctaattaaacatccaggagatgtgaatgtggagatcaggggagatgtcaggcaaaaatataaatataaatgtgtgggtcatgagcatatgggtggtgtttagagccatgagcccaggaagcagaggttgcaatgagctgagattgtgccacggtactctagcct

SEQ ID NO: 710121 - DNA, 222 bp, Homo sapiens
catatcacctaagttagagccaggcctggctctgaacttaggatctcaaaaaaaaaaaaaaaaaaaagttagccatgggtgtaatggaacaactccaaacctccaggggtttaaaacagccgggcatttctaagtcccacatttaggtgtgcctggggaagatctttgggtggtaggcgttggcagaagaggcattatccagtgcatctggatgtctggcgt

SEQ ID NO: 710122 - DNA, 672 bp, Homo sapiens
atgacccctgtacggaatatgaaccggctaattcacttactgaaccactcaggctggtctgagacaaggaatacgccatttacggcatgaggaaacgatcgcttactgcttgtggcctgcctgatcctgcaagttacgactgtgatgtccctagccgtgcactagttactagacccgtgagaaagcttgtcataaatcggccacatgactgaggacgtggatgatggatgagtgatctgctagattcactcccatgaggcgtctcgattctttaggtgcctgatcgtacacatgatacgacgtctatgttacagagcatttatcatcctcacatccatggagcatcgtgatcatgctgccgcttgctactatacagggagactttatagactatgttcttctgtgaggtcaaacattaatatgatgggtgcacagagttactaacttactgtctcgctatccatacattgctgaccgacctatgctaactgatttgccgaggctatgcagtcaagttgtccgaccctgcgaccttgtacctttcagtaggttatgacctttagtattggactcctattgaactccaggtcctatatttgcgccaaccgggatctaacagccccctatgtgtgactgtgcaattcgcggaagacaacttttcaacctttactt

SEQ ID NO: 710123 - DNA, 157 bp, Homo sapiens
ttcagcaccgatcacctcctgctccctcttgggcctaagctcctgcagagtggatgtgctgtcccgtgtgtcttccagctactgtctttaaggcctccagcaccagcacgaattcccttagcacaagcacgaattcagcaccagcacgaataccctt

SEQ ID NO: 710124 - DNA, 329 bp, Homo sapiens
aagattgtgccactgcattccaagcctgggcaccagaggctctgtctcaaaaagaatcatggcaaagatgccgagtaaaggcacatcttatacactgtggggaggaatgtacattttacaacctctggaaaacagtatggagattttccaactaaaaactaccattcgatccagcaatcccactagtaggtatctacccaaaggaaactatattttaaaaatcacctgcactgtttatcgcagcactattcataataagtgtgtttatcgcagcactattcgtaatagcaaagttatggaaacaaccttagggggcatcagagagaggt

SEQ ID NO: 710125 - DNA, 398 bp, Homo sapiens
  misc_feature (37)..(37): n is a, c, g, or t
  misc_feature (55)..(55): n is a, c, g, or t
  misc_feature (114)..(114): n is a, c, g, or t
  misc_feature (291)..(291): n is a, c, g, or t
gtgactctagaggttcccaaacgcagagaggatactngttgcatctttcaggatngtcaaaaccttctggtgtatcacatacaacctttcctcaagaaaaccatcgagaaacantgtttgacatcctatatgcaagatttcataaataatgcagtaattgctaatataattccaacagactcttagcatcgctacgagtgagaaagcctcaccgcagtcaactccttgaacttgtcggaaaacatgttaacgacaagtcgagatttcttaatggtgacacttaccatcatngtctgtcttccttttaaaatccatctgtactcaaaagccttacgaccatcaagcagttcttccatagtctacactttgttttcatacatggatcctctctgcgtttg

SEQ ID NO: 710126 - DNA, 1330 bp, Homo sapiens
  misc_feature (202)..(202): n is a, c, g, or t
  misc_feature (214)..(214): n is a, c, g, or t
  misc_feature (227)..(227): n is a, c, g, or t
  misc_feature (241)..(241): n is a, c, g, or t
  misc_feature (249)..(249): n is a, c, g, or t
  misc_feature (251)..(251): n is a, c, g, or t
  misc_feature (369)..(369): n is a, c, g, or t
cgctgtctgagaattgcctaggaacaagcggcacctgtcctggtctcccccatctccaacggcaggtatactcatcccaacaagacgaggacttgtccctcagcaaccatgtcatagtccgtttgggctgctgtaatagaataccttagacaagggtggcctacccacagcaggaattaatttctgacagctcctgggctcnagggatcctccnaccttggcctccncaagtgctgagatngcaggtgngnaccaccacacccagcccacaagtcctcttagaacattgaagtgcccttctcatgacctcatggtgaataaagttcactctggttggcatggcgtcaaggcccgtcatgacctgttccntgcgtaatttaatatgacgctggaggctcagccctcaccacgattctcagttcttcccacctcctacagcccactgtgagtccctcacgtgtttgctacgactgtatctggcgcgcctgaccttctgccgccacctgctctcttctggcacagcgcttcccactctggcctaactactactcatctcttcggcgcctcagtctagcacatgacgtcctccactcacgctcccctcgtcatcccgaccaacgacgcaggacttgtccctcagcaccatgtcttagtccgtctgggctgctgtcactcgaataccttagcactgggtggcctaccccacagtcacgcgcactcccttctctcaccagcttctggcacgctggcacgcctcacagatccgcgctgcccgacgccactcacgctcgcgggtcgacggcgcctctttccacgttgcccccggccacgcttcctcaacccgagtccttccacataggctgaatccactcaacctcccctacgaaggcccaaccattcgatactaccataaccctaatgcgcgttaagagttccaccactacgcaattccgagtgcacgacacctccccatcgtacgacccgagcacacctgtctgaacatccacctcaggatcactgcgctcggacattggacaccatttccctacttctctccccctaatctagacaatattataccccacactacatctgactacaactcactactcttctactcaataccacaccccacatacttacttcctatcgtgaccacaacacacctcaccgctcttcccacacaaccaacaatcacctattcatccattcctacatcacctctcgcaatcacaactctaccacacaccactctccatagcacactctctaaccctacccaagctatccttcaccgtacccaccataaaaaaatcacccaccacctacc

SEQ ID NO: 710127 - DNA, 85 bp, Homo sapiens
cgagcggccgcccgggcaggtaccccccgagaccgtggctggcgtctccccaacaacaagctgggttccggggatgacatctctg

SEQ ID NO: 710128 - DNA, 148 bp, Homo sapiens
aaggaggctgctctgtgctgtgcggacaagcagtgctcacctcagaagtgctcaccactgcttcggccacccttcagatggccacctgtgagctctcccactcccatccttcccagagctccttcccgggcctggtccccctgcagga

SEQ ID NO: 710129 - DNA, 226 bp, Homo sapiens
  misc_feature (3)..(3): n is a, c, g, or t
  misc_feature (21)..(22): n is a, c, g, or t
  misc_feature (112)..(112): n is a, c, g, or t
  misc_feature (133)..(133): n is a, c, g, or t
  misc_feature (168)..(169): n is a, c, g, or t
  misc_feature (186)..(186): n is a, c, g, or t
  misc_feature (207)..(207): n is a, c, g, or t
  misc_feature (209)..(209): n is a, c, g, or t
  misc_feature (215)..(215): n is a, c, g, or t
  misc_feature (217)..(217): n is a, c, g, or t
  misc_feature (223)..(223): n is a, c, g, or t
tanctgctttcctcccaaatnngccccagtggagagctgtcactcaggtcgtgcggcattcggaggactgcttccgtgcttctcctcctggctctgtgtgacagtcgggatngggatctgctctgtccttctncacaccccacccttagctgttccccagttctcttnntgccatttcttgagctntttatggcagccttttcctgncnggttcntnatcccnata

SEQ ID NO: 710130 - DNA, 172 bp, Homo sapiens
tctggaggccccggagctgcatttctgaagaggctcgggtaatgcagatgcctctggccacaaagctcacttggagggaccaagcttgctgggcaccaagacaggatctaagtgggaaagcagcatcatgtccaccctttgagttctctttaccaagaaaagaggcctacat

SEQ ID NO: 710131 - DNA, 165 bp, Homo sapiens
tgcatctgtcccggggacaaaactggaggggccatgcggaaaaccaccgcgggacgcttgagatattaggtggcggaaagagaggtggtagtaggttattctcagagagcagcttggagcactacccgattcatcatggcaaggcaagcgctacacacgcgggtg

SEQ ID NO: 710132 - DNA, 100 bp, Homo sapiens
cgaaggaaggaagtacgggtgcgtaggataggaagtcggagaagataatcggttagaagaagacaatgtgttagaagaagcgatacttcctatccttcgg

SEQ ID NO: 710133 - DNA, 237 bp, Homo sapiens
  misc_feature (18)..(18): n is a, c, g, or t
  misc_feature (34)..(34): n is a, c, g, or t
  misc_feature (54)..(55): n is a, c, g, or t
  misc_feature (57)..(57): n is a, c, g, or t
  misc_feature (65)..(65): n is a, c, g, or t
  misc_feature (70)..(70): n is a, c, g, or t
  misc_feature (76)..(76): n is a, c, g, or t
  misc_feature (80)..(80): n is a, c, g, or t
  misc_feature (91)..(91): n is a, c, g, or t
  misc_feature (95)..(95): n is a, c, g, or t
  misc_feature (101)..(101): n is a, c, g, or t
  misc_feature (116)..(116): n is a, c, g, or t
  misc_feature (121)..(121): n is a, c, g, or t
  misc_feature (124)..(124): n is a, c, g, or t
  misc_feature (137)..(137): n is a, c, g, or t
  misc_feature (139)..(139): n is a, c, g, or t
  misc_feature (161)..(161): n is a, c, g, or t
  misc_feature (165)..(165): n is a, c, g, or t
  misc_feature (186)..(186): n is a, c, g, or t
  misc_feature (193)..(193): n is a, c, g, or t
  misc_feature (206)..(206): n is a, c, g, or t
  misc_feature (217)..(217): n is a, c, g, or t
ggaaccccaggcctcttncctccctccccacctncaaggccctccccccagggnncncagggccnaggtncctggncccngggtgttccancccntctctnttcagtccctggaangggcnctnagaaaggcaccancnccttggaccccacctcccatgntctnactctcatccccgttctcttntccacanagctcttccaatnaaggtgtttcncttcctccttctcctccttc

SEQ ID NO: 710134 - DNA, 119 bp, Homo sapiens
acttgaatgttagagtgcaactgacaaatgattattactccttcgtcattgaaactaatacacgctctaaactttatagcttttcacttactctgttaagcatagcttgacacaaatta

SEQ ID NO: 710135 - DNA, 324 bp, Homo sapiens
aacagttcgacgtgatcccttgagggtagaatatgtgaatccgaggacctgcaagatgaggggactctctcagtgtggagtggatggagctggtcctcgcatgtgtgatattaggcgttcgtagtgaggcgggtgcccccgtgacagtggcaatgggcagtgaggccagtgtgatgaagacagacgggtgactgccccataccgtcgctgtgcgtggacggacaggccgtgggacagaccggcacgggtggacggtttgtgccgtgctttgactcacttgtggaactccatcagtggcctacgccactctgggaccgcacatgt

SEQ ID NO: 710136 - DNA, 1605 bp, Homo sapiens
  misc_feature (295)..(295): n is a, c, g, or t
  misc_feature (446)..(446): n is a, c, g, or t
gtatggaggagtctttactgtgttagatctctagtcccttaccaaagacgcgagattcgtgattctatgcggcttctctggtggctcgaccgaggtagtggtgggccggagaggatcgattgatcactacctcaacgtactctgcgcatcttgcgcaggaccatacaagttgggcgcgcgcacaacttcaatcgattcactgacttggccacttgagtcgtctcgaagctacactcgaggctgattctaacaggatctgttgtgtgttcctcgacaaacatatgtgtcaccgagnggacacttgtcaccgaaattcatgagtaatccgagttgatctccgttagtatatcccattcgatctagaccacgtcgagtgagatagatagacactggctagccctacgaaccgtagcacgaggcatccagtactggggagattgtcgtgncggtaggagcgatctcggatgcgaatgacgctaatggcatgacaaggatttttggagatgcatgcgaggatagttctcgcacctgatgattattactaacggcactggaagtggccttggtagcactgacctggtttgccccgactcaagaaacgttccgaaaggtatggcgtgtgctggagcgtacacgccacataccgtacttatacgcagtatccagtaaggggcggcagtttgtgggcttcggctagccctggtggaagttcctcagcacacctttaggggaaagggtctggggcgactgggacacggcattccagcctttagagagactctaagagttttgccggaccccacggcctggtggcgaaacaccaggccaatgaaccccccgttcttcttaccaaaaacattttacaaacacttagctaggcgttggtggggcggtttggcgtcaaccccattaaggttcccagggggaccctcgcggggaaaagcttgagggcgacggaagaatcactgttgaagccccatggagagggccgaatcagattgcacggtggaacctgttgacttggttgcaccccttacacaggttccacccctgggggtgtggaccagcaggaagaacgaacaacaacgacgacacgtttcgctacaaatatcgggggcgaaagaagcccaacaacactttgggaggaggggccggcggtgtctcggagcacacgtacgcgtttccccgcgaaccaagaagcatttccggggggggggcacacacacacccagacactatatacattatttaccaaccaacacatcactactatctgcagcaagcaaacaataaacaacagtggagggtggtcactaacgacaggtcggccgacaggacgacaaagtagcatctgacatatagagacatcacatcacctactaattagtaagacacagcgtccgtcaaatgagcgccataatgtagtctgccagccagtcgtgtgagaaccaccagccgacaccatctgttctggctacactttacgtcagacagactaataatcgacacggtagttagcctgactccaccctcatccgtcctgctcgcaccacacaacccgacacggcaagcaacaagtaagagagaggaaggaaagcagcgacg

SEQ ID NO: 710137 - DNA, 734 bp, Homo sapiens
ggtcaacgatccctcccttaccatcaaatctattggccaccaatggtactgaacctacgagtacaccgactacggcggactaatcttcagcgtccatacatacttcccgccgattattcctagaacctaggcgaactgcgactccttgtacgttgacaatctgagtagtactcccgattgaagcccccgattcgtataataattacatcacaagacgtctggctacgtcgatgagctgtccccacattaggcgttaaaaatcagatgcaattccgcggacgtctaaaccaaaccactttcactcgctagcacagaccgggggtagtactacgggtcaagtggctctgaaatctgtgtgagcaaaccgacagtttcttgcccatctgtcctaagaattaattcccgctaaagaatcttttgaaatacgggcccgtatttaccctatagcacccgctctacgccctctatgagtcaaggagaaaggatgtgactgtaatgcataagaagagattcttgagtgggcagttgagacccttgaaaagagttttgtgaaagactatgataggggcgggggccactttgtgtccataaagcatggtgaatatgggttgcgaagaatgagtgttgactaacttggggcagtgcaatttgactacaatagaagaagtgggggctggcagatgttgttttgaaatagctcgaatgcggcattgagaggacttcaagaggttgga

SEQ ID NO: 710138 - DNA, 369 bp, Homo sapiens
  misc_feature (310)..(310): n is a, c, g, or t
  misc_feature (349)..(349): n is a, c, g, or t
atgggggttaatcggataacgaacaggctctctagaagggatataaaaaaccgccaggtccttggagttaaaggctggtggtcgtagtggtgctgggcgagcagtttggtggattaacctggtggaggttaagggctaagcataggggggtatctaatcccagttggggtctaagctatggtgtgtccagatatgtgaaagcctctttcgtagtcaatttggggtcaccgggagtttttaacaactcaggtgagtttaagctaatacacgatacctttttctgggcgataatgtggacggaggctatttnagtatagagggtgtctcatattgaggggtccggaagatnctatacccaatcaacatagg

SEQ ID NO: 710139 - DNA, 322 bp, Homo sapiens
tttttttgagacagagtctcactctctcacacaggctggagtgcagtggaaatcttggctcactgcagcctcagcctcctgggttcaagcaattctcgtacctcagcctcccaagtagctgggattacaggcacgtgcaccatgcccggctaatttttgatagagacggggtttcaccatgttggccaggctggtcttgaactcctgaccttaagtgatccgcccgcctcagcctcccaaagtgttgggattacaggcgtgacaccgcgcctggcctgaaggttacttttcttttcagtggtttggggcagggaggtcgacg

SEQ ID NO: 710140 - DNA, 541 bp, Homo sapiens
gtgcaagccgcttgaatgccgtgcttcggtatcttgagacccagcctcggccccccaaggctgaccccagtgaaaagcgtgtccagcgtgctcagcagcctgacgcccgccaaggtggcccccgctatccgaacaagcggcttccccctagcatcctgggcaagcgcagctactgagtcagcagcaacggcggtggacggtcctggcaaaccactggacagaccaggcaacatgtggaccaagggccggacacctcctgctcgagcgggaatgtgctagcccgctagcagaaggtgctgccttgatcctgtaggtgtggctccgctggcagccgaggtcaacgcttgcggcggacttcaaacttggactcgaaggccccgagatgatctgtgttcttacagtggggcaccagtaggaggaccaggggaagagtccggcataggctgctcatcattccgtctggaagaccgaagcagtgcgtgcctcagcctgggtccatagcagagccccatcggcccatgcggccagaaggtcaggcgcc

SEQ ID NO: 710141 - DNA, 742 bp, Homo sapiens
  misc_feature (574)..(574): n is a, c, g, or t
  misc_feature (577)..(577): n is a, c, g, or t
  misc_feature (590)..(590): n is a, c, g, or t
  misc_feature (597)..(597): n is a, c, g, or t
  misc_feature (660)..(660): n is a, c, g, or t
agcggttcaggcagttctcctgcctcagcctccccagtagctgggactacaggtgcatgccaccacgccctgctatgtgtgattgatatttctgtcaccttgactgtggtgatggcttcataactgtatacataagtcaacatttattatactgtatactttatgtacagtttatacttttacaactataacttcagaaacccactaccctattttaaaaaagttaataattactctcagccactgtgagacctcactgtttccttatgctcatttttccctttaacaacaatggggaactagtattttatcagataaaaataatgtttgataggatttgtgcaaagtctgtttgcctactaattctgccttatggcatctcagacatgtaaattagacaagagccttcagtatgtctggtctgtgtcacgttattttccactagtttgtgtgatttagattatttttaaagagttgataaaggaaaggaaaggaagagagagatagaagaaagaaaagagagaagaaagagaaagaaagagaaggaagggaaggaaagaaagaaagaaagaanganagaaagaaagaangaaaganagaaagaaagaaaaaaagagacgcctgtcttttaattccagttggaagcagctttagttatanaatttccatctctagaatatcttggggaaaaaatgaagtgtcattaaattgatttttttaattgcatcctatgtctctgaaa

SEQ ID NO: 710142 - DNA, 775 bp, Homo sapiens
  misc_feature (607)..(607): n is a, c, g, or t
  misc_feature (610)..(610): n is a, c, g, or t
  misc_feature (623)..(623): n is a, c, g, or t
  misc_feature (630)..(630): n is a, c, g, or t
  misc_feature (693)..(693): n is a, c, g, or t
agcggttcaggcagttctcctgcctcagcctccccagtagctgggactacaggtgcatgccaccacgccctgctatgtgtgattgatatttctgtcaccttgactgtggtgatggcttcataactgtatacataagtcaacatttattatactgtatactttatgtacagtttatacttttacaactataacttcagaaacccactaccctattttaaaaaagttaataattactctcagccactgtgagacctcactgtttccttatgctcatttttccctttaacaacaatggggaactagtattttatcagataaaaataatgtttgataggatttgtgcaaagtctgtttgcctactaattctgccttatggcatctcagacatgtaaattagacaagagccttcagtatgtctggtctgtgtcacgttattttccactagtttgtgtgatttagattatcctataaccaggtcagctccccccgagaccccagcaccgagacagagcagcagctccagaccaacaccagaacacagcacagaccaaaccagcaaaccacaccaccagcccgagccggaaccggaaagaaagaaagaaagaanganagaaagaaagaangaaaganagaaagaaagaaaaaaagagacgcctgtcttttaattccagttggaagcagctttagttatanaatttccatctctagaatatcttggggaaaaaatgaagtgtcattaaattgatttttttaattgcatcctatgtctctgaaa

SEQ ID NO: 710143 - DNA, 161 bp, Homo sapiens
actttttgatgaagtccatgagtccttggcatggttcgtgttcgctctactgcccacttctttgttttcataactaggagtgtctcccacagcctttagcacaatgtcaatttttttcttgagtgtcgccagcaggttcctctgttcccggggaaactgca

SEQ ID NO: 710144 - DNA, 136 bp, Homo sapiens
gaggtcggattaccatatcgacgcagcgtccccacttggtcgaagttgacatctgacgacgtgcaaggagcagatttacaaacggccaagaaggggcggactccttcacagatcggtgtaatcctgagagattcac

SEQ ID NO: 710145 - DNA, 210 bp, Homo sapiens
  misc_feature (166)..(166): n is a, c, g, or t
  misc_feature (168)..(168): n is a, c, g, or t
  misc_feature (208)..(208): n is a, c, g, or t
ctaaatcgatttcgaacatggatgtttgccgtcgccgccgctatcgtcggcgtgaccgttgcagtatgcggagttgttggtttcatagggctggtcatgccgcacattacgaggttgtgtgtgggggcggatcaccgtagaactcttcccatcgggctattgctgngngcgatcttcactgtactagcagaccttgcgcccgaatggnta

SEQ ID NO: 710146 - DNA, 222 bp, Homo sapiens
  misc_feature (36)..(36): n is a, c, g, or t
aagagggggtttcaaactcttagtgacttaaaatcnttcatctcttcatctgaaaattcatgaaataaataaaatagctggtgtggtggcgggtgcctgtagtcccagctatgtgggaggctgagggaggagaatggtgtgaatccgggaggcggagcttgcagtgagccgagattgtgccactgcactccagcctgggcgacagagcaagactccgtctca

SEQ ID NO: 710147 - DNA, 120 bp, Homo sapiens
  misc_feature (3)..(3): n is a, c, g, or t
tantcatcaagaagaaaactattagaaatttatctcctgcaccgagcggaatgtttcgaatagaggaaatccctttggaccaggtggacatagacaaagagaatgagatgcttgtcacag

SEQ ID NO: 710148 - DNA, 1190 bp, Homo sapiens
agcgggagcaggcggggctactcgactgctctggaggtagcggccgcggctgaggagagccatgggacgggcagtcaaggttttacagctctttaaaacactgcacaggaccagacaacaacgttttctaacacaatgatgccagcagccattacgaagcagctcagacactaaagcataacatgcaagaactttccaacacaatacataaaccacgctgacaaccttctttcctacaccaacacactagcaagcagccctaactgcacacaactacggctctcctgcactgctcggcacacctctactctaccctcccaacgcacaccccttccctggctctaagtacccacacgcgcaataactttccaaccacccaacggaaacccaaccgacaactaacccaccctggacaagaaccttggggattccccccctttaggaggcaccaaacgcaaaccccctttcccttctgcgttacggcacaaaaccactggtttgaccccagcttcacttcatgcttgcaacctggccaaccccgaaaaccccttcccacggccaacaacgccccacaacctggcaaccccattctttactcccttacaccgaacacttaaaccaacatacccacctacgtcgttccctttattgggttaacccgtttgctcctcctcctaaagaccccattctatccaaacacacaacacactttccgttaagcccaacaaaccctttccatttgtggccccagcaaccaccaacggattcccccgttgggggcagaggacaacgtttggcccaggggaaaccccaacgttagtcgttgtgcgccccctgttgttaatgaacccttggtgggccgaagtgtagccttctggcaagaagaccgcacgttggcacacacagtgttggtagcaacgttcttaaagccgacgcggcaatcaccactctacgcgccccttctttcccactgctttaaaccctttcgcccttacgcactccagcaatttctctatcccaactcggttggcctttctatcactaccactcacacggcgggggctcccagcactttgtagatacgcccttgggaaacggcgaaagatgcccctttaagtcagaacagggaaaaacgcgaagagtttaaacaagtttcgctacgaagacgggtacttacacattgtagctcg

SEQ ID NO: 710149 - DNA, 383 bp, Homo sapiens
gacacttacaggcaggcccacactcgccagagagatccttaaggcgctcatcatccatgtctactccaaaatacttgatgtaaacataggtgaattcttttgccctagctccaagtacagctatctcgtactattacagagacttaacatcgtccaacaacatattttagagatacatatacggagcattccacttcattttttcaactagctctttcagactgcttcctgcagtctccaaagtgtacaacatccatcagccctatggaaccatatattcatacacaacaccacacttacatgcaaaggatgttcccagacagcagaaaatgtatcatacagtgctttattatcaacggatttgtccagatatttactgaata

SEQ ID NO: 710150 - DNA, 1123 bp, Homo sapiens
tgggcatcaaaaagcttatattcccattgggcccaagggctgtgtaaggatagttaaaaaagctgcctatatgtgggcgtggagggaagaggctttaggcaaaagccctatattaactttgtgcaaggggccctcttcaaaagctcgcgtgggcctcaaaaggcctctatagctcggtgctgtgaaaggtgacgccttctcagaaaaagaatttctctcggcccacgccccacgcctctcgcgggccaccccaagccgcgtgtggagagggtgtgggactccaggggtggtgtcacccacactatcttctctgtgtgaataaggccttctcaactatctccactcactctctatggagaagagagagtgagtctctctccgagagaagagtctccacaaagagagagatggggtgatctcgcggtggcgtgtgcacagatacaccccgaggggccatgtttacagatatctctcacaagagtggcgcgcggtggttctcacgagtatatatatctctctcacacgggggccccattgggggagagcagtactataatcacagagtggggcaaactgcggggagagatgtatattacccccaacacactactcactctctctctcaagcagctgtgggcctctctctgtgtgaagtgtgtactcccgtggagacaacatataaacagcgccgcgcgagagcgcagagacacaacgcagccaagggaggaataatagagggcagatctcctcttcaccaagggaggagaaaaccagcgcacacgtagaaaacgccccactcatcgtcggcgagccaatatcaactcactcttcggggggcccccaaagattcagcgacgcgagggaacacagaaaagtgtggggggactacaaagcggcccctgatctccacgagaaaaggcaccacacacaaaaatacaataaccggagcagagccaccaaaaaaaacaactagagaaaaagagcccacaaagaaaagcaaaaaacgggacactaggggggtgataaacaagacgaaaaggggccccagcaggcaaaggtggaaatcaccaacaaaggtgtggggaaccccgacgggggacggcagtaaaaagaaaaacgggag

SEQ ID NO: 710151 - DNA, 468 bp, Homo sapiens
cttaataaataattattgaggggggctgggtgcagtagctcacatctgtaatcccagcacttagggaggccaaggtgggaggatcacttgaggccaggagttcgagaccagcctgggcaacatggcgagataccactatctccacaaaaaaattaaaaaacaaaaatagctgggcatggtggtgtgtgcttgtggacccagctacttgggagactgatgcaggaggctcacttgagcccaggagttggaggctgcagtgagccatgatggcaccactgccctccagcctgggggacaaagccagaccttgtctctattttcgaaaagaagtattattgaaggaatgagccaggcatggcagcatgcacctgtagtcccagccacttgggaggctgaggcagcaggatcacttgagtccaggagttcgagaccagcctgggcaatatagaaagactctgtttccaaaaa

SEQ ID NO: 710152 - DNA, 145 bp, Homo sapiens
gttaagggggaaaaaacccccccccattaaattccaaaaaatttttgggaatttcccttaagggggtgaatttgcccggggggaattgccccccgtttggcccttagggccttaaaaaatgaatttttggggggtttaagtttta

SEQ ID NO: 710153 - DNA, 1024 bp, Homo sapiens
agcggagttgcgcctcccagactgcagtatggacagctctcggggtgcggagcccggcggtgcctaggcggagtgcgcggggcatggtctcccggtcccttctaggcccgtgcgtagttcccgcgttctcgacggagatcttgagcatacgcgcagcgcgtcggcttgaggcgggacgctgccgtgctgcgcatggcagtgcgctgtgcgtggctggcacgacggaatgtggccgctagagaaggcacaagttgagagtccgcggtgtggagaaccgagggacggagaagcccgtgcgcaagtccttcgcggagctggcagtgccggccagcaggcattcaggggtaattctgcatgtgggcaagatgtagtaaaagcgaaacagaggcctttgaagcatatggtggtaaactggggagctgcatatgcgaaataacaaagacagaatatgtgcccaatgggacgaagtttcatacactgcttatgattaagttaggatggacaatcgtatgggaacgaagttaatactgcatcagagtagaaagaacgaaagttggatggggccccttgggcacggcaaatgtacagacggacatgcttgcatatgacacgttaccttggtttaggaactcccgggagcgaaatgacatttaaacccttgagggtgttgcacacggtaactgtgttacttgggattatttgtatgccatatggtcctgtccgtagtgtccatggacatatctgggtggcacaaagttccatctcgtcaaggttggtttggttggaacattgtgcgcttttgctgaacagaaggacaagtgacgtatggcaagggttctttgctcactatttcgggcgattaatcaaggttaaacacgcccattaggaagttaaccccaactatttagttggcccccaatgtaggaactggaccctacattgcagttcctggcacttggaaacgccaaagagaaggcgccaacgaatgggaaaggaacactgaaacgaaccccgagcgaaaccg

SEQ ID NO: 710154 - DNA, 462 bp, Homo sapiens
  misc_feature (425)..(425): n is a, c, g, or t
ccgacaatgctccatctacctgatggcgtgctagatgcatgtgagcgagacaccctcagctgcaaggctggcacgctgttacgaggaccaggctgtggaatcaatgcctgtcaaattcacacatgtatattctctctatgcccaggcccatctagtggagggcaggccaaagacacgtgtgcacactgagtgggctgacctatgcgcagtgtgaccaatgtctgtgacattgctggaatggcaacaaagctggaggcgactcagatgcccgcggaaggaagaacagccacaggaagaccgagtaatggcaccttaacatgcagtccacagacagaagaacaaagctgtacatacacacgctgtgaaaggccaccgagatgcttagataagtgagaataggcaagtccaggagcctgcatagactnttcaatcctgttggattcctgcagtgctgtggggtcg

SEQ ID NO: 710155 - DNA, 344 bp, Homo sapiens
ttcatcagctcgaggatggcgtcatggccgagcgccttgtcggaatcttcgagagcggcgagcgccgagcccttgacgatcgggatggtgtcgcccgggaattcgtacttcgagagcagctcgcggacttcgagctcgacgagctcgagcagctccggatcgtcgaccatgtcgcacttgttcagggacacgaccagcgcgggaacgccgacctggcgggcgagcaggatgtgctcgcgggtctgcggcatcgggccgtcagcagccgacacgaccaggatcgcaccgtccatctgggcggcgccggtgatcatgttcttcacgtagtcggcgtggccggggca

SEQ ID NO: 710156 - DNA, 144 bp, Homo sapiens
ctttataagcggagcatcagtaagcggtcagataatgcggagcatcagtaagcatcagtaagcggagcggtcacgcctgctgggggtatgttgtgttggaagaagaggaggcgaggaggtggcataagatctgcctgctccgct

SEQ ID NO: 710157 - DNA, 440 bp, Homo sapiens
acgagcgtagtctccatccagtgttaacagaataaccacatagtaagtaagagataacactcctactgcgacttacaaggtcgccagggtcgtctacactttccacacataaactcagtcctcacaatcatcactacgtgccaggtgaatggcaaccaccagggttgttgccttacaagacacgtgacgacacaactgaaaacctaacactagaaagttgtaggcaaaggctcctgttcacaagcatccagagatgtcagaaacatgtggggtgaccataggaggaagcacggaaaaacgcaggcaagcagcctccctgcctgtctgacgctgtggacttccccaggctggttctgcactcactcctgagtctttcagaactttggacatacttgcttccacccgcttcctccatttaaccttaagactcaggtggtgtg

SEQ ID NO: 710158 - DNA, 151 bp, Homo sapiens
gcttgattggcaatggtgatgacctggcctgtcaggcagctcgtagctcttctccagtgaggagctggaagcagccgtggccatctcttgctcgaagtcgagtgacgatgtagcacagctttctcctttatatgtcactgcactgatttcc

SEQ ID NO: 710159 - DNA, 101 bp, Homo sapiens
gcacgcaggcgcacttctgcacccaggcgcacttctgcacccagtaaaattgtaataagcagtgcttgaattatttggtttcggagaagtgcgcctgggtg

SEQ ID NO: 710160 - DNA, 842 bp, Homo sapiens
  misc_feature (130)..(130): n is a, c, g, or t
  misc_feature (133)..(133): n is a, c, g, or t
  misc_feature (169)..(169): n is a, c, g, or t
  misc_feature (502)..(502): n is a, c, g, or t
  misc_feature (600)..(600): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (654)..(654): n is a, c, g, or t
  misc_feature (662)..(662): n is a, c, g, or t
  misc_feature (669)..(669): n is a, c, g, or t
  misc_feature (674)..(674): n is a, c, g, or t
  misc_feature (680)..(680): n is a, c, g, or t
  misc_feature (686)..(686): n is a, c, g, or t
  misc_feature (693)..(693): n is a, c, g, or t
  misc_feature (697)..(697): n is a, c, g, or t
  misc_feature (700)..(700): n is a, c, g, or t
  misc_feature (715)..(715): n is a, c, g, or t
  misc_feature (722)..(722): n is a, c, g, or t
  misc_feature (728)..(728): n is a, c, g, or t
cagaaaagatcagtctgctgaaagtctcatgaataagagccgatcgaagagctgtgtgtctaacattttacttcactgtgataagagaagatgcttgatattacttcaagttttttgaaagaacacctgnganattcatcgcaaaaagatcatcacctaggcacatcgncgtcaggttatccaaagttaagatgaaggaaagaatcttaagagctgtgagacagaagcaccacgtaacctataaaggaaaacctatcatattaacagcagatttctcagcagaaaccctacatgccagaagggattggagccctatcttcagcctccgtaaacaaaacaattatcagccaagaattttgtatccagcaaaactaaacctcatatatggtgcttagctatttattttgttatctattgttgttgctcaaactgttcaagctttggccattgggagctctttcacattggctcttgtgtacttttggcatgccctcatccactntgtttggagcacttcctctttctggcaccacaggatgctccaggctcatcttgtgttttcttctctgcattggccctagacttagtcatttctcctangagccctggttcttttttttttttttttttttgatgaanggccttanaanccangatttggngatgggngtgcncattgntactgngatgacnctgnttntaccattctaatgancagaacnaggaanattcggctggcggccaacccctggcttcccatatccctcattatgtgcgtatattgctattgttcaggctgaaccctaggcactgcgattgaaggggcggaaggtattctggcg

SEQ ID NO: 710161 - DNA, 341 bp, Homo sapiens
  misc_feature (260)..(260): n is a, c, g, or t
  misc_feature (287)..(287): n is a, c, g, or t
  misc_feature (295)..(295): n is a, c, g, or t
gagttattatgcttagatatattttggctactaggattcttcccctaggattgggcaaagaagggaagattaaatttggaggctgggggaacactcggccccactgatggagaaaaaaacaaacagatgggagtaaagacgagatagaaacacaacaaggtagaaaaagaccaggataatttggaacccctttagtgggaggtaagaaaaagaagagaaagaacaacaacaacaaaaagagcaagttcaaatcccagggnggagagctcctctaggaacaaaactcnctacaaangagactaaagagctaacggagagggcaaaatccagggattcccttc

SEQ ID NO: 710162 - DNA, 429 bp, Homo sapiens
accgttacccaggagaaacaagagatctggatacgaagcaccgtacactggccagaaactaaatctgtgaagtgtcaaaactgaatgaatgatgatatggaagaggctaatcatattgaaagtgtaattgagtcaaactgccaaactgggcgagacagtgacagcgagttcagtgggtcttttcaaatcaagccggtatgatccaagcatttctttttctggaatgtcattatcaggacacaatgacacttataggaagtgtccaaaataaactcaattccccgtagctggagaggtagtgatatatagtgaacccgacgtctctgagaagtgcattgaagtttacagtgacattcaggatggcagttcttggaggctctctccagtgatactcataacagtggttagaggatgttggatttggtatga

SEQ ID NO: 710163 - DNA, 323 bp, Homo sapiens
ccgagaccacctctatagcacagcctacgcagaggtgtgggtatcggtgagtcatgcctgggagtatgtcggaacatggctctgagaacacagtacagaagtaacactaactcagtagaaatggatgcacaacccgaagatctcactgagaggcctgacagtgatactaagagtgtagtactaagctcattggctgagggacgtctgtaggtgtgcatccatggcatggaggagcctgcattgatgcagctagggatgtagacagatttcaactgaagcatacacgatcgatgatggagtcagcagtccaggaggcattggtc

SEQ ID NO: 710164 - DNA, 118 bp, Homo sapiens
aggatcccctacaagtacacgatcacggggaaagccccaaagcagcctgtcatcgtgaaggccaaattcttacagcagaagagctgaggcgaagattaagagtgactcgtgggtgggg

SEQ ID NO: 710165 - DNA, 101 bp, Homo sapiens
gattctagcaggatccccgacgctctctctgtgtggtgcttggtctgcagctccagggccctagcctgggcttggtggagctcatgtctagggagttgggg

SEQ ID NO: 710166 - DNA, 638 bp, Homo sapiens
aaggaatgaggaaccaaccacccctctgggggtagatttacagactgagtggaccgtactctgtatatctgagatgaactctataatgttttggataaaaatggaccttgccatcactatggtataatatggcatgtattttttaattaagatgtctagttgctttttataagacccagaaggagaaatccgaccacctgggaagatttttgttttcactgcttgtatgatgtttccccttcatacaccttatgaatctctacccagaggccctttggactgccttgtgttctgtgagaaccaatatttacttagagtggaaggactgattgagaatgttcccatcccaatgtatgcatcaccacttaccatgctgctcattgttgtgagtactatgagattccaatttttctaacatatgggaagccttttgtcctcccaagatgagtactagggatcatgtgtttataaaaagaaaggctacgatgactgggcaacagaagaaagatggggaactggattaagcagttgatcagcatcattggaacatggggacgaatgacggcacggaggaccccgaggaaataccctccaaactaacttgtttacaaccaaataaagtattcactacccttgga

SEQ ID NO: 710167 - DNA, 353 bp, Homo sapiens
agaaacacttcttgttcccagacctaactgaaacacctgggtagggtggggcacctacgaaatggctgcttctgtgggtctgaggtaggtctgaaacaatctattttcttttagtttgttaagttccctaggtgaccacgatgccaggtttggaactgctcgggtgcaggttcatctgtgaagggctgacccacctatctcttgtctttatatgcagatgtcagcttatctttgcagccagctgaagcatttttcagcctagaccctatcaatcttgctcaatctgcagatttgacaggactccctctgtgtcttcttccaaattgttgattaaatgacgagacgtaaaaaga

SEQ ID NO: 710168 - DNA, 122 bp, Homo sapiens
ctcagtctggttatttcagcttcacctcggcacaattacttacctgacccaggaggatgggcccgtagtgattggctctaccagatgcacctggacaggcaggaatcctggctcagcgggag

SEQ ID NO: 710169 - DNA, 179 bp, Homo sapiens
tattttaataaaagtgttaactaaagcagtaatcctacttcattaacccttgctggggtgcggggcacttttttaattcatctaccctcactacatactaagtatgctcagtgctgtgaaagtggattacaccaaattaagtcattcttatcacacccaatcaaaagtcaagaagccag

SEQ ID NO: 710170 - DNA, 278 bp, Homo sapiens
agttagcagcaggattctggatggctgacaccgatgctgctgcaccttttggaaaaaatggatccaactgcttgccccgtcatcccagatggctaggcccccattcatcccctctcgctctcctactggaggaactgctgtatgaatcataaagctctgggtagggaagcagggagcaggttccaggcagagctgacaagtgacttcacttttgagcatcggttgaaccagatttaacgtctcttccagttctaacactgaggatgaaaataaaaaaa

SEQ ID NO: 710171 - DNA, 158 bp, Homo sapiens
aggcctgtgtctatgtggaagatcctactaccgagcctaccaggcgctcgggttatgctaatccagagagctggagaggctagcctaaaacagtagcgctgggaaaaggggagggaccgtgacaggcaggtgtggctagtcgggctagtacgggtgga

SEQ ID NO: 710172 - DNA, 182 bp, Homo sapiens
cagcctggccaacatggcaaaaccccatttctacaaaaactacaaaaaattacactgtgtatggtggcatgtgcctgtagtcccaggtactcatgaggctgagcctggaaggtctagaatgcagtgagccttgatcacgccactacactccagccagggagacagggtaaggccttgtctca

SEQ ID NO: 710173 - DNA, 106 bp, Homo sapiens
atagcctgaccaacatgcgaacggactgatcttttttgctggaactttagcacgcagcagcagcagcagcagcagcagcagcagcagcagcctcagtagcagcgct

SEQ ID NO: 710174 - DNA, 422 bp, Homo sapiens
  misc_feature (7)..(7): n is a, c, g, or t
  misc_feature (95)..(95): n is a, c, g, or t
  misc_feature (286)..(286): n is a, c, g, or t
  misc_feature (315)..(315): n is a, c, g, or t
  misc_feature (401)..(401): n is a, c, g, or t
cgatttnccgcgaggaaaaaatccaagtatcaagctctctacgcaagtagatcaagcttctcttattctttactctataattaaagtgcttgcgncattgtgcattgtacttagctctgtcaacttacatattttaattaaagaaacgttattagacaactgtgacaatttataaatgtcaggtgccattattgagttaatatattcctccaacgagtggatgtgtcccttctcccaccaactatatgaagcagccacattagtttaacttttattagtagatganacactgctgctaacgctaacttctcttcnccatccccatgttgattttgtgtatatgtgtaagtgggttagaatgcatcaacaatctaacaatcaacagcgagatgagccaggcntgggcttgcggtgaagattga

SEQ ID NO: 710175 - DNA, 161 bp, Homo sapiens
gatctggaagcgcctcttcacggcacttgggatccgcatctccctgggatcatcaagccctagaagcttggtttctttaaatagggctgccgtttctgtttctccctgggcttccgaaagccaaaagatttattctagcttatacaagctcctgggttccc

SEQ ID NO: 710176 - DNA, 966 bp, Homo sapiens
  misc_feature (38)..(38): n is a, c, g, or t
  misc_feature (48)..(48): n is a, c, g, or t
  misc_feature (194)..(194): n is a, c, g, or t
ttcacccaccctgcaaagcattggcaaaagacttgccnaaaagcaccnaggattcttcgctgtgacaagaagacaacaccgagtatgagaagtatgattatcgggaaatgctgcacaatgccactttctgtctggttcctcgtggtcgcaggcttgggtccttcagattcctggaggctttgcaggctgcctgngtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccatgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaaaaaaaaa

SEQ ID NO: 710177 - DNA, 1153 bp, Homo sapiens
gatgagcccaaagtaagcataattaatgccctaatgaaagagtttagttggagcccggctcattgcgttctgagactgcgccgaagccccgatcgcaatatctccggaattgatcgagacgttcgagttcaggctctttgcgcgcttggcctgaggcctctcgatatcaccacatggattagttgcctgaggcgcatggcagcgtcactcatcaggaggcgcgtcgaaccggcgcgtatgtcatcgaatccgcgcgcatcatcactctgagacgtaaaattaatggcgtagaattgcgatccgcgtagcactgtcacagtccgaagtgcgcgcgcgtacaatcattgctttagtctggcgctcttgcactagcaagcatctggctgaggcactagtattactggatcatttgcgtctacatctggacataccgtgaaacgatcgggctattatccatgccttggcttggtggcagacttaatagacgaacaaagcctttcgataggcttgatggttcatcactcgatgaggcctaagatcatcaatagcatggcatgcgggccaactagtgaatgactaaacattactatccgttccatcccatacatatggggggcagcacctaaggtctcagatgaaagtctggagggaggcctaaatcagtaagactaggtgccccaaagctcagggggagtatcattgtacgcgttttcagtttcattttggccgcgtgtgcaattagtgtgcagcctctgaggcaaggcgattgccgaacatacctaatttcgtttgacagcagaaaagcggcggatcaaaataaaatccccaccgtgaggaaatccacgcgtcgcaattgcgggactaagaggtcagccttccacaacggctttactagcaacaacttccaagaggacgccccgtagggtttaagcttagctcttatcgcttgcatcgtgcctttagatggacagttttaacggctatttcgtcagccagggaaccttcctaggtggaagcaagatgaaattattagcccgtaagagcaaagcgcccttagagaaaccccgtttccgcacattagggccggaaggaattttttcctaattagcctaaaaaaatgtctccggatccggacactaaaaaataggaaggg

SEQ ID NO: 710178 - DNA, 867 bp, Homo sapiens
  misc_feature (38)..(38): n is a, c, g, or t
  misc_feature (48)..(48): n is a, c, g, or t
  misc_feature (194)..(194): n is a, c, g, or t
ttcacccaccctgcaaagcattggcaaaagacttgccnaaaagcaccnaggattcttcgctgtgacaagaagacaacaccgagtatgagaagtatgattatcgggaaatgctgcacaatgccactttctgtctggttcctcgtggtcgcaggcttgggtccttcagattcctggaggctttgcaggctgcctgngtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgaggagcggttttttgccctagggaacataataaaggggggggttagcttgagggggagggggtttaaaaaagggggggttggttcaaggggggggggttc

SEQ ID NO: 710179 - DNA, 735 bp, Homo sapiens
  misc_feature (153)..(153): n is a, c, g, or t
  misc_feature (345)..(345): n is a, c, g, or t
cccaagtatctctagtaggcaggtaatccaagtctagcctcacaagtcatgccagttcaaaactggcttacgttgtgcgctgaacttcagtggtcaggatcagtggcattgcacagtgcctgcagtacgcatggacagtggctgctgtgtganacaggtctgtctcacttataaagctgatggtattagggcatgccgggagtgacgggacagggtccctgagtgttgcctgcctgcacctccactcacaggcattcctttccatgagttgtgtggttgccagtaatacgcagaaatgccacagggcatatggggcacatccaccaccacaagaggcttctgggnagatcagcgtatgaaaggataatgcgcccagtcttaggggtgggccagtgagctagttcatagcatgcctccagcccctctggagtccacacttgggaacggaagctaatgctgtgcggcactgcagtgtgactccgcacataccagtagggcttggaggggcagccccttctcctggaaacgggtggggtaagaatagggcttgtcagaggctaaaccttctgccttcatggccccagcagatcacaggactgaagagttgtagagcaaggctggatctgacccgagatccccatgactgcctggactggagtcaaatgggatctgcagcctctttccacttggcctaggggatcccgcctctttctcagagctgggctcgtgccgaat

SEQ ID NO: 710180 - DNA, 349 bp, Homo sapiens
accaggtgaacaaggagatctactcaacctctaccaataatggggacccccacgaccatgtgctcatgagggaggaataaagaccagctgacatggacagccactcaccagggcctctgacgctggcaggaaggggagcaccatcactcatcctgtcccaactccctcgtgggatcaggttgggacccaggagctggtgtgaaccaaggaccaaagccccttgacggccgaggaacaatacccaatgctgatcagagctaaaaatggctccgtgggaccagactggaagagcacggcagggagtgaaggggaaggcaggaggaggtcaggaaggctgatgagccccggt

SEQ ID NO: 710181 - DNA, 879 bp, Homo sapiens
  misc_feature (38)..(38): n is a, c, g, or t
  misc_feature (48)..(48): n is a, c, g, or t
  misc_feature (194)..(194): n is a, c, g, or t
ttcacccaccctgcaaagcattggcaaaagacttgccnaaaagcaccnaggattcttcgctgtgacaagaagacaacaccgagtatgagaagtatgattatcgggaaatgctgcacaatgccactttctgtctggttcctcgtggtcgcaggcttgggtccttcagattcctggaggctttgcaggctgcctgngtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaaaaaaaaa

SEQ ID NO: 710182 - DNA, 808 bp, Homo sapiens
  misc_feature (321)..(321): n is a, c, g, or t
tcttcttttgcgtcgacagtacgagccacatcgctcaaacaccatggggaaggtgaatggtcggagtcaacggattcggtcgtatagggcgcctgggtcaccagggctgacttattaactctggtaaagtggatatttgttgccatcaatgaccccttcattgatctccaatctacaatggtgttacatgttccaataatgattccacccatggccaaattccatggcaccgtccaaggctgtagaacgggaagctatgtcgatcaatgtgaaatcctctatcacctatgccttctccggagggagctgagatcccatccnaaaatcaaagtggggcgatcgctggcgctgcagtacgtcggggagtccactggctgtctgtacactcaccagtagggaagaaaggctggagggcatcatattgtcgaggaaggtgatgccaaagaggggtcagtcagttctcctgctctccacttctggatgatgcgcctccaatgttcgtcatggtgttgtgaaccagtgagaagtatgacgaattaggcctcagatgatcatcgagcaatgctcgtcctgtcagccagccaacgtgcttagcgatgctcctggctcgacggtgccactcccagttgaccattacctttttggctagttccgtgggaaacggatctctctggacactgctggttccccatggcccacttggcttggcccaaaccagcaaagactggtgggattgggcccctgtccgggggaagagctgttggcggtcgaatggcgcgtggggggcctcttccccggacccctttcc

SEQ ID NO: 710183 - DNA, 1726 bp, Homo sapiens
  misc_feature (38)..(38): n is a, c, g, or t
  misc_feature (48)..(48): n is a, c, g, or t
  misc_feature (194)..(194): n is a, c, g, or t
ttcacccaccctgcaaagcattggcaaaagacttgccnaaaagcaccnaggattcttcgctgtgacaagaagacaacaccgagtatgagaagtatgattatcgggaaatgctgcacaatgccactttctgtctggttcctcgtggtcgcaggcttgggtccttcagattcctggaggctttgcaggctgcctgngtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaaaaaaaaa

SEQ ID NO: 710184 - DNA, 191 bp, Homo sapiens
tacgaggagaattataccctgaccatgactgatgaccagtgtttactcctctctgagattgtctggggacctcttccgtggtccggctacttttagccagcttgtttggcaatctgttgagggcacattctttatcaacatgactgagattgaggattttccccgcgttcctcaccatgggcttgttgttg

SEQ ID NO: 710185 - DNA, 1636 bp, Homo sapiens
  misc_feature (38)..(38): n is a, c, g, or t
  misc_feature (48)..(48): n is a, c, g, or t
  misc_feature (194)..(194): n is a, c, g, or t
ttcacccaccctgcaaagcattggcaaaagacttgccnaaaagcaccnaggattcttcgctgtgacaagaagacaacaccgagtatgagaagtatgattatcgggaaatgctgcacaatgccactttctgtctggttcctcgtggtcgcaggcttgggtccttcagattcctggaggctttgcaggctgcctgngtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaaaaaaaaa

SEQ ID NO: 710186 - DNA, 442 bp, Homo sapiens
ggaagggtagcaggggaaagggaagtggggatgtttaatgggtacaaaaacacagttagaataagatctagtaagtgatagcacaacagggtgactacagtcaacaataattgtatattttataataacttaaagagtataattggatagtgtgtaacacaaaggaaggataaatgcttgcagtgatggataccccattcatgcattgtatgcctgtatccaaagatttctttcttttttttttttttgagatggagtctcgctctgtcgcccaagctgtagtgcagtggcgcgatctcggctcactgcaacctctgcctcctgggttcaagcgattctcctgcctcagcctcccaagtagctgggattacaggtgcgcaccaccatgcctggctaattttagggtttcaccatgttggccaggctggtctccaacttctga

SEQ ID NO: 710187 - DNA, 132 bp, Homo sapiens
tctttgcgctctcacttcatcttacccttcattattgcatggcctagcaggacttcacctgctatatcatgcatcgaaacgggatcaaacaaccccctagggaatcacctgcccagttcgcgataagaatca

SEQ ID NO: 710188 - DNA, 1233 bp, Homo sapiens
  misc_feature (38)..(38): n is a, c, g, or t
  misc_feature (48)..(48): n is a, c, g, or t
  misc_feature (194)..(194): n is a, c, g, or t
ttcacccaccctgcaaagcattggcaaaagacttgccnaaaagcaccnaggattcttcgctgtgacaagaagacaacaccgagtatgagaagtatgattatcgggaaatgctgcacaatgccactttctgtctggttcctcgtggtcgcaggcttgggtccttcagattcctggaggctttgcaggctgcctgngtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaaaaaaaaa

SEQ ID NO: 710189 - DNA, 181 bp, Homo sapiens
gacgcagtgggtccccgaggtaaacatatcaggcatgttgacggcttatcaccaatgggtaccaacattccgccccagaaagacgctgaacacactgaatcacatatgagttgctatgtacacatgaagcttcaaagatcttcttatgatagaagctcacaatccccagacagtagtagca

SEQ ID NO: 710190 - DNA, 235 bp, Homo sapiens
tttctctattcatgtctcacgctttatttctttaagttgatcttcaatctctgatatcctttcttccgctgatcaatctggctatgatacttgagtatgcttcacaaagttctggagctgtgtttttcagctccatcaggtcatttatgttcttctctaaactggtgattctagttagtaatttgtctaaccttttttcaaggttcttagcttcctttattatgggggaaggaat

SEQ ID NO: 710191 - DNA, 194 bp, Homo sapiens
  misc_feature (12)..(12): n is a, c, g, or t
  misc_feature (39)..(39): n is a, c, g, or t
  misc_feature (63)..(63): n is a, c, g, or t
  misc_feature (71)..(71): n is a, c, g, or t
aaaaaaatggangaaactaggcaggccaaaaaaatttanggagcttcttacaaaagactctanaaataatntaacataacattcttttctttcttttttttttctcgcactgtctcctgggctggagtgcaatggcgtgatctcagctcactgcaactccagcccaggtgacagagcgagaccctatcttagga

SEQ ID NO: 710192 - DNA, 440 bp, Homo sapiens
gcgtcgacaaagacttagatcacaatgcccaattcccctcaaatacttggaaagccttcccaagaaggacaggtacaaagaagcccagactgtgaagactacaataaacatctaaccattcaatgcacagacactaatgaacatccacaagcatcaagaccatcgaagaaaacatgacctcaccaatatctaataagataccagtgaccaattccagagagacagaaatatacaaccttagagacagaaaattcaaaatagctatttttagccaggcacagtggcttatgcctgtaatcccagcagtttgggaggccaagggacaggtggatcagttgagctaaggagttcaagaccagcctgggcaacatggcaaaacctcgtctttacaaaaattagctgggtgcaatggcatgtgcctgtggtcccagctacttgga

SEQ ID NO: 710193 - DNA, 188 bp, Homo sapiens
tatcgagtgccttcatgctggtatatcaagtaggtggggtgaccgcctatttcctgaggggtgcaggccagagtaatttaccagatcccctccacagccatacgcattgtcttgtgtatgacgttcttcataatacctacctcactaaaacggtatgaacagccctgtgacatagaagtggtacctgc

SEQ ID NO: 710194 - DNA, 672 bp, Homo sapiens
  misc_feature (63)..(63): n is a, c, g, or t
  misc_feature (254)..(254): n is a, c, g, or t
  misc_feature (485)..(485): n is a, c, g, or t
gccccctcgtgaatgaggacctattgccaatgggcctattctcacgccacggcaatatctggncacacgacttcctccctccgaggttatttccacgcggccacagtcactataaagggggcacacgaaggttataaattcggagaagccacgctgggtcacacaaaatgcccacgagaccactgaatgtgagaaacacttttgccacgcgctatgttatgagaagagaaaaccccacgccacgcaatggaganaatataagaccacgctgagacccacacgctatggtgggttgtccacgtggcgcccttcacgcgctatttgccctcttccctgtaaactattgtaaaaccacgagaggagactaggtgaacacatgtgagaaaatataaaatatgcacgctccacccctggagacttcacggcctgtttatggtggccacgtatctgagcacataaacactttgcccaagggagagtcactnccagaaaagtcacaagaagagctttaaaaccactttttaaatgcaatatacccacaaacccatcacgagcttatctggagaataaaattacctattcccacatgtttcagtgggaaatgaactacatattgagatgctgacagaaaactgcctcttaccgtagggaaccactgaaccccatccaata

SEQ ID NO: 710195 - DNA, 203 bp, Homo sapiens
cttttatatagaaacgtcgccttaagttatatacagttagactttgagttctccatgtggagtgagaccaggctgacggtccccacggcaggctgaggcggaaggtgctagccaggcccactgcgaggagaacgaaggtggttggagcatccctaaggcagcaagcgccaggggctgcctgctatgatgtgccggccccacac

SEQ ID NO: 710196 - DNA, 2862 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatggactcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattggcaagaaaaaaaacaaaaacaaaaactcgcgtcttttctgggcggaaagtttaggcgctgcatgttctgccttttaaggc

SEQ ID NO: 710197 - DNA, 1328 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 710198 - DNA, 349 bp, Homo sapiens
atgtatataagcgccacatgcttctgagtgtcttttcattctgtcatgtggagcaatagttttttcattttcatgccatataatattttattggtacgtctaccccaattcatttatttatttatttttttgagatggagtctgtctctgtcatccaggctggagtgcggtggcgagatctcatcactgcaacttccgtctcctgggtttacgtgattctcgtgcctcagcctcctgagtagctgggattatgggctcgtaccaccacgtctggctaatattttgtagagacaggctttcaccatgttgccgaggctggtcttgaactcctgagctcaggcaatccacc

SEQ ID NO: 710199 - DNA, 1088 bp, Homo sapiens
catagtggctcatgcttgtaatcccagcactttgggagaccaaggtgggcggatcacttgaggccaggggttccagaccagcctagccaatatggcaaaacccagtctccactaaaaattacacaaattagttgggcggcgtggaggcatggcctggtaatccaaggctactcagggaggcctgagcaccatgcagcaatcaatctggcaaccctggacacggcccgcacacggttcccaaggtggaggcccggagaattcaagaaccacctggccacattcccaagaccttcaagctggaacaggaagccgaggaccctaatggttcttcaaagcacaccaaacacaacacacacaccaccaaaacaaggtatcgcgaactgcagaaacacatctggcgcagacacatacacacaaacaaaatacacatacttcacaacaagaggctatccccttcacccacactatattacaaccactacgcctgactaaaaccacaccaacacacagtggggcaccaccacaccgcgcacacacacccccatctaacacaccaaggaggacggacagcacacaccagccacgagcgacaccacaaacaaacaacagcacggcgacacacaacaaacaaacaccaaacaaaggggcgcaccacaacaacaacaagacgaaccagaacaacaccaaccagcagcaaccacacacaccagcaacacacagcacgtgtgcaacacaacacaaccaaacccccacaaaaaaaactgtagccaaaacaaactgcgaggacaaacctacaacacacaccacacaccaagcaagtcaccatcttcacaccacaccaattcaaaacacgagcatcacacacccacacaccacgacctaataactcaccatcctatactaaaaaccaaaaatatacccccacccttattgcagtctaccaccacagacaccaacaacagctaccacttccaaataccacacacctaactcccaaaatctaccaactcattctttctaccccaccaactacaaccccacttttttatacaacccacacaacaacacaaagtacacttcttctacaa

SEQ ID NO: 710200 - DNA, 1525 bp, Homo sapiens
tgcgcggcggcggcgcgcgggcgcctggggcgggacttccggcgcgctggagcgttttccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 710201 - DNA, 439 bp, Homo sapiens
tctgagttcccgctcacgcccactaggactgacgttgggtggtttgaggtccagaggacatcaggacactctcgcatacttcgccaactgaggcctgctcagagcagtaggagctgaatgatggtgccttccaccctcttgggctgtgtgccctttagagcaggctcagcctgcaaaggccctgcgttcagaggtcttgtaatctactttttgcaggagaaagaaggttaaaactgattttttcaagaaaagctattttattgcagctctttcccgagagctgttctgggaatagctggtcttcatattccccgtggagaggggaacaagtggggctgggcttatatctcttccggcttctagtgggatggagttggggtatagaacttaaccctgaagatgtttccaccaagcctgctgtgagtccttctgggcgtta

SEQ ID NO: 710202 - DNA, 1421 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 710203 - DNA, 2320 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatggactcagaggagcctggcccaccctcttgaaactggtcctggaccttggctcagctctgccgcctcaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattggcaagaaaaaaaacaaaaacaaaaactcgcgtcttttctgggcggaaagtttaggcgctgcatgttctgccttttaaggc

SEQ ID NO: 710204 - DNA, 315 bp, Homo sapiens
gtcacctttttcaccggaattggaacggtggattccaaatttatatgggaattccaaggaccccgacttgggcaagcattcctgaaaagggaattcaatccaaaaccccatgggatcctcctttcaacctgccagggaggctataataaggagaccattaataatgtgttggtaaaagtggagaaattagaaccctcatacactgctgatggaaatgtaaaatggaacagctgctttgaaacacagtctgccagtttctccaaaggttaacacagagtcactatataactcagcaattccattcccaggtcgacg

SEQ ID NO: 710205 - DNA, 1787 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgaaaaaaaaaaaaaacaaaccggagtcatcagcccttcaagcacagaacagacggggggcggcgcgcccttctagaggattattcccctccggtgggggggccccccaagtttttacggccgttccccccgaattttcggttggcatccgcagggggggcccccccctagtgaggtgctcttgcctcttttttagggcctggcgcgatcggtgcctgctgtggtttctcaacacccgtgctccgtgagctctgcgcaaccacctcgttgttccgctgtggggcatcgtgtggtggggaaggagggcacccctgctacctgagtgggcggggggtgcaccccatattggtggcgagccaactcatcctg

SEQ ID NO: 710206 - DNA, 839 bp, Homo sapiens
attgcctgtcttggtcacatgagtctgtctccggttacttatagctccctgggcaatcgttgctctaattgctttggtctgactcaagcaaggggccgaggccttaggttctgactattagaggtctcctgaccgcccaggcgaatggctgctcatagtagtcgtctaggccagaattaagataagctgttgcctgtgaactagtccatggaatcttttagtctaaaaggcaatgaggagttatcacgctcatcctcaaactccaacaagcatctatgcctatagcttgttgaccatttcgtccgtcttgccttcagaatggtgagaaacaagcgcaagagtaattataggagcgaaagaaagcgtgcgagaatgcctgctcaatattacgatcgagctaaggtcgctttctggcatattattacgaattcatgagcggaacaatatgtcttgggttttgagggtgttattagtaagtatccgggcacaagttggtgaatcgtttgtaccaaagatgcgacacgaaagacggtgaaacgaattagtaacggagagtaaagttgtgctttaatgttcgcaattcaatatttgcattgttaactgggctctaagcgtttttctttgggtccaaagcgcaatatttatttaacgccactgctagattccataagaaatttccaaagaccgtgaccgaaagttagcattgtagataaaaatataggttgttatgtacacacggggacagaaatgtaaaatcgaatatctatggaaagtgtgtaagaacataagaaataattacaggtatataataaaaatatattagacaaatcctgggcctt

SEQ ID NO: 710207 - DNA, 1704 bp, Homo sapiens
aagcaggctgtaccgggcggggggtaaggatgtctccgtccacaggtggggagggctaggcagcagggagtgctggtgtgtgtcctctcttcctgggcttccggcctctgaactagaatgtttcaaggcctaggagtgacaggacgtggtcagcaatagtggcccaggtcctgcccttgggtgacccaggccaaggtctcctagttagaacaggacagagtcacgaggctgccactgttgggaagggccctgcctgtgctgactctgcaaatgaggagtcgcccagagccgccgcgaccccacccaggagcactggccagcctggggaagacacaaacccagccccaaaggccccacagccaccaggcacctccaacaaccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 710208 - DNA, 1862 bp, Homo sapiens
aagcaggctgtaccgggcggggggtaaggatgtctccgtccacaggtggggagggctaggcagcagggagtgctggtgtgtgtcctctcttcctgggcttccggcctctgaactagaatgtttcaaggcctaggagtgacaggacgtggtcagcaatagtggcccaggtcctgcccttgggtgacccaggccaaggtctcctagttagaacaggacagagtcacgaggctgccactgttgggaagggccctgcctgtgctgactctgcaaatgaggagtcgcccagagccgccgcgaccccacccaggagcactggccagcctggggaagacacaaacccagccccaaaggccccacagccaccaggcacctccaacaaccaggtgcctcctcaccccaccggcctgcccctgccctactctgtcccccccatgcccacggcagacaggcagtgggcaagcaggagggcctcagggcaggtcagacctgggcctacagggcagagcctggacctccgccagggcaactccaacccaaccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 710209 - DNA, 1607 bp, Homo sapiens
tgcgcggcggcggcgcgcgggcgcctggggcgggacttccggcgcgctggagcgttttccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagcctctcggaactgccgtggctgttcaagcactcactgcctttgcctgtggctccatgtactgggtgctgctgtgcttgccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 710210 - DNA, 1810 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctagagagagccacccagacgtccccaccgagtccagcacggcaagggtgcaggggctgccctagaaatggactcagaggagcctggcccaccctcttgaaactggtcctggaccttggctcagctctgccgcctcaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattggcaagaaaaaaaacaaaaacaaaaactcgcgtcttttctgggcggaaagtttaggcgctgcatgttctgccttttaaggc

SEQ ID NO: 710211 - DNA, 128 bp, Homo sapiens
  misc_feature (28)..(28): n is a, c, g, or t
gacagcggctgaggaggggaagagagtnctaaatgataacagtctttatccgttaacgctgaataaatgccttttttaaaagtaaaaaaatacggtcgactgcgatctaccaatacttctcgcctgat

SEQ ID NO: 710212 - DNA, 120 bp, Homo sapiens
gccaaaatacgttctctgtgaccagacatgagaaggtcgcccaacagcccattggcaaccttctcatgtctggtcacagagggctgatttgtcctcagcacctctccgcccaaccaatat

SEQ ID NO: 710213 - DNA, 108 bp, Homo sapiens
  misc_feature (2)..(2): n is a, c, g, or t
tntaatgtttaacaacatttatagcatctttttaattagattagctttacaagcaacgttgagagctctttcataatgaaacatgcttttaaattagatgatttatag

SEQ ID NO: 710214 - DNA, 145 bp, Homo sapiens
tttgaagtaaaatttaaaaaggcctttaaaatttccaattagaggttaaatttaggcaaaggaattttgcccgggaaaaaaattcccttctccccttccttgggggcccttttgaaaaaggttattaaaaaattttttttaccca

SEQ ID NO: 710215 - DNA, 162 bp, Homo sapiens
gactggccgcacttctctccgactactagcatccatgctgcgtcaccctgcaccttgtgttgcgccttcagagtgcattattgagccttctctccgccagattgcccggacctcctactgcgacacgatgatctgccgcatgtactatgctcaccttcaacc

SEQ ID NO: 710216 - DNA, 346 bp, Homo sapiens
aatccatgtcaataacccacaaaggagccatcaaaatcaggaagttaatgtggatacagcattattataccagctaacctaggcttacttaaattttaccaatcgttacaacctctcttgtaagagaaaccccccagattacatgctgtgtccagtggtcagtttgttgtttgtttaagtctcctttaatctggagcagattctcagtttttcctgatatttttaaagaattgtttttggccaggcgctgtgctcatgcctgtaatcccagtgctttgggaggccaaggtaggagggtcacctgaggccaggagtttgagagcagcttgggcgacagagtgagacc

SEQ ID NO: 710217 - DNA, 471 bp, Homo sapiens
tgaagtgcactgagacttgtaatgcagcctgctctggcacacagtcctggcagcttgcagatgaagtgcccagctgtgcggctgtaaggctgagctcagaggtcagttgaactctcaggagctctcatgtgactactgcccttttcgatgtactatctgcaagagcgcatctgcttgccctctgtctgttactggggaaggctgctggcctcttccctgggcatcctgattgtgctaacttccttctgtactgtcaagataaggaacatgtcttgatttatcaagggtctctgtcaccgtcacttggatcttattaatgacatttatcaacatggtgggtgtatgatcttttaatctcatgacttgtaaaatacttttaaaaaatatcaaatgagtctttctttgctggaatatataggttattttattttaatgtaaaaattaaaatggaaccaaatgtatttagaaatg

SEQ ID NO: 710218 - DNA, 141 bp, Homo sapiens
agtgcggcgataaactgcctatcctggtgactcttactcaagagaaactgaagagtctgttcagcagtttctacaagaaatgcgggacctccgcttgcttcagttttttccaatatatggacacttagcagtggtgtttcg

SEQ ID NO: 710219 - DNA, 489 bp, Homo sapiens
atgatttaagtctgactgtgagcctgcccaacttttaccaagttagtgggatattcaatttcagccatcactgtggctccatatgctactactgggtcaagggaggggctttggagatcttacacagggataaacattttaaaaatctttcatagtctttttctttcttctccttgggtcttaactctccttaactccaaagatgctcacttcttttccacaatatgtaaacaaacctaggaagaaaaattctgtcctagactttcaaactccctggagccaacagagtaaaaagatttggcaggaacaaaatgcaaattagtacatcaataaatactcccaccacatttgaaatgttaaattgctaatgttaaccttccattcttactaaatgactcagaaatgttgaaacagcagtatttttctttagtcattatttccttggaattgtaacctagagtagagcagtaatctgtgctccatgcaaaa

SEQ ID NO: 710220 - DNA, 628 bp, Homo sapiens
  misc_feature (23)..(23): n is a, c, g, or t
  misc_feature (81)..(81): n is a, c, g, or t
  misc_feature (96)..(96): n is a, c, g, or t
  misc_feature (151)..(151): n is a, c, g, or t
  misc_feature (529)..(530): n is a, c, g, or t
ccctcaaagtcacttagtgccantcagcacaaaatcttaagaaaactctactactatgaaaggtaaactagcccgtatatnccaaatgggcagatntcccaattcattctgtttgctgttatttggttacagaattccaggcaattatatnttatggagagtaaatttaaatgcctgatataattgctaactcaacaaaaacattccttcctttcctgaaagactgctccttcacctgtggaaaagagaaagagataaattcaaatatcaagttttgagaatcagagaggaaccactaaaataatgcttcagacccacaaggttgaaatcaaatgctgttggcgccacccaaaagtaccaaagaagccacatacaaatgtgaaacatacacagaacccacttgtggtcagtacagcgattactactaaaaggagaaaaacctagaaaagatttttaaaattttaaacaaatttaactctatatagagattacgccgggtgcagtggctcacacctgtaatcctagagtnntcagaggtcaaggagggaggattgcttggggccaggagttcaagaccagaatgggtaacatagcaagaccctgtctctaccaaaaatttaaaaatcag

SEQ ID NO: 710221 - DNA, 137 bp, Homo sapiens
gttacctacatagtgcgcgcgccagggtagctgctgcactgctgctcttcggtcagcgtgccggagacgaagatgaaaggggtctgctggagtccgctcgcgtgccagtgcgagggccgcatcgccatcgaatccgg

SEQ ID NO: 710222 - DNA, 648 bp, Homo sapiens
ctaacaccaccagcgtgtaaggtgagtcttctttctgagtggagttctgtgataagacagatgactcacccagagggatgccagaggatgaccgtaggcagatgtctcagagagggagttctggctctatcagattgagtgtcccgtcccaccctcaggggtcaagcctggccattccaaagcagattgatgtccccaagcatgctatcaagttgtgacaattgctgttgccttcgcctgagataccccttcttggttacttgaacttttacttgaccttcaagccctacagttcctcctcctccaggaagccttgcgaacccaccctctgagctttttattggagcactgatgatcctgggtcaataatgcctgatacacatttgccttgcccatgagactgagtcccatggcagccaaggctatgtgtgattcattctgtgtgcccagttcccagaacccaggacacggcttggcacaaagaaagggaggccccagggaggccagcggattatgcctgtacagggatcatccagcccatcctcccatttctcattcctgactgagtctggaactattcctgggcatctcgcttcttggatactctggctgccgctagcagacgttgcacagagcctagttgggccc

SEQ ID NO: 710223 - DNA, 352 bp, Homo sapiens
gcacgaggaagtacaggagtacttcatagcatcatttatttatgtatttatttttgagacacggtcttgctatgttatccaggttggagtgccgtggcacaatcatggcttactgcagccttgaacactttgcctcaagtgatccttggacctcgacctccagaatagctgggactacaggtgtgagccaccacgccaggtaatttttgtagagatgaggtctatgttccccgggctggtctcgaactcctgagcttaagcaattctcctgccttgacctcccacagtgttggcattataggtatgagctatgatgcctggctgatagcattgtttaaaaggggggaaaaaa

SEQ ID NO: 710224 - DNA, 246 bp, Homo sapiens
  misc_feature (100)..(100): n is a, c, g, or t
  misc_feature (149)..(149): n is a, c, g, or t
  misc_feature (160)..(160): n is a, c, g, or t
  misc_feature (237)..(237): n is a, c, g, or t
tcagagtaaacctgaagtttctgaccaggacgagaagcaccgtggctgagtctgtgagccagcagattttgcgccagaaccggggccgcacggtagaccngcctgtacaaggaccaagaagaagaaggctgagggcaccgtgttcaccnaggaagacttncagaagttccagcaggaattacttcggcagctaggctccctgggagggcacggtgcaagaggcctttcaagcccttncagccttcc

SEQ ID NO: 710225 - DNA, 317 bp, Homo sapiens
gatcgaatccttaaaattagctttaatgcagatgggcatgcaagtctcccgtgggacttttgccctcagccaacagaaatatatgtggtgccaggagagactgccctggggtttttcagagctaagaatccttctgcccaacccgtaattgggatttttccaaccaatattgttccctttgaagctgggcagtttttccataaaatacaggcttcaaagctgcccagagtttacgttttaaaaagttggcccctttgatggggtagtgagctgatcctccccttttttttaaaataaaaaaaaaaaaatggcccgta

SEQ ID NO: 710226 - DNA, 379 bp, Homo sapiens
  misc_feature (188)..(188): n is a, c, g, or t
acagtgttctaaccttaatgtgaaggtagaatacaagagggggaatagcaagaggatataaaatcagaagttgttttaaaaaagaaaaagtaagggcagaggcttaaataagcaacaaggtaatataaaaaatgcagtcagcatatgccataggcccttgtaatcaagtgcccagaaacttatgggcnagtatatcagaaagctagaagtaagaaacttgatcggctacaggtacagcagtaaaagtgagctgagccaggcactcaggtgaagctgtgttcccaatacaaaaccagaaagagctttctcctacaggtcttcaaggagaaagcacaaagtgcccaccaccttcttgggccgcaggggtaaagagtgggtc

SEQ ID NO: 710227 - DNA, 177 bp, Homo sapiens
ttttttccccccccccccccccccagattttaaaaaagggttccccccaattttgggttcccgaaaaattttgggggggaaaccttttttaagggggttttggaaccccctaaaacggctttttttttcccccaggggcccccccccctggggttggttcccttaaatttttgggga

SEQ ID NO: 710228 - DNA, 107 bp, Homo sapiens
cacacgacacacgacacgcacgcaaacacgccagacgcgacagagcgcgcgcgggagcggagcagcggaagcgcagcagcgcacacgagagataagggcggccgagc

SEQ ID NO: 710229 - DNA, 604 bp, Homo sapiens
cgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaacaaacaagggggggggggaccatttacagagagtggtgattgacccaaattgtttgaacccaatttattgtcttgggggggggtgtccttagctgttgaattcctgaagggttcactacacggtgacactagctggcttaattgcagccagcgtcctgggcagcagaactttattcattccttacggtaaattctattggctgcttccaaaggtgatgattttcaagcagacattgtctatatggccggggctccaggatcgtgtggcccagcctcttatcagagcttggcctacctggcaaaagttgccttaccctttcaagttgggacacctc

SEQ ID NO: 710230 - DNA, 1385 bp, Homo sapiens
  misc_feature (268)..(268): n is a, c, g, or t
taaagggggggtctctctgatcgggggaaaggggaaaattcctagtttctacccactacgcgtatgacccaatttggggggatcccaagctaaaacaacgttgggggatttaaaactccgggattaattattttcctataaagcctcagtgagccatataaaggcctcacttgtgaccatgtgcaaaaatgtgcgggagaacccaggggtgtcgcacgtgcgcatgtgggaattacattcctcccgtgatcttctgagaagaaagacncctcttggtggaaatatttctttcacagaaagccatgtgagcccgaggatgtgtctcgctggagcaataacttctcctatacacagtctacaccccatagcacattatccttatatatatgtggaccgatgtgggtctctcccatataccgcgcatatataacacattccctcgcgagaatattctcccccgctctacagagagcgctctagagagaacagacagacacagacacacagacagagaacgaagagaaacacacaagacagacacacagagagacagacacaacaaaagacagacgagcggagagaacaccataatatgatgtgagcggggggcgcgcgcgagaacaacatgagagagaagagcaacagagaacagaaggaagcgacggagaccacgacgtgcggacgacacaacaacaagtactgaggtagtcgtcaccggcagtagagcagcccgccaaccagagtctgtcttgatggtaagaccacacaccagagtagtgagcagaaaacaaaacatcgaggccgcggggaggaagcccccaccacaacatacaaatagtagtggcggaggaggcgccagtaccagctcacatactatcatacatagctgcaagagaagaagaaagaaccgacaccggagggaagtatatacaaaacaacacgcggtgagataaaataaaaaagagacagacccgctccggccaggacgcaacagaaccaagcacagaaagcaaaaaagacaaaagacaaacacacgacggacgacaggaacagcacgctgagaacgacgccaacagacaggacgacagagaacacaagacgatacgaggacaagcacggacacgcgcagagaacgagaaaagacagacagacgacaagaacaagagcacaccggacgccataaagcacagaaccaagacaaaccaccaagacgacgcatccggagctagcagagcaggacagagaaccacagaccaaacaacctacaacgagcacgagacaactacggaggggcgcagaccgacatacagctcataatcacacaaccatacgaaagaacactactagaacgttagcagaacagcacaaagagcagagaaaagaga

SEQ ID NO: 710231 - DNA, 359 bp, Homo sapiens
aaacaaaaaaaacccgggggtctatgtcccgctattgggaaccgctgaggcagaagaatcactggaggagttcagggctcgggtattgctatgatcatacccctttcatagctatggacggcatcccagtcggggcaacatagaaagacctcatctctattggtaaaataatttagagggaaatccccatagtgtggttggtgtacggggtttggttcattaccaatatttggccggtggtcagaagtataagaagactggtaagggcgggtttatttcatttcattctcttttcagttagtgagacacgcatatcagggggattcctcatagagctcgaccctggcagggcaatgtgc

SEQ ID NO: 710232 - DNA, 1541 bp, Homo sapiens
ctaatatatattctagtatttttagtacgagatggggagttcacacatagtaagtctatagatggtctcgatctcttgacctacgtgatccgacccacctcggcccttccaaagctgctgggattataggccatgagaacaactgcgacctggccaaattcattctgatacttttaactatcttatttctatatcttaagagtgggaaccaaacaacactactagaccacacagagtctcacacaaaaaaacacacaccacacacatcacacaacaacagtaaacgaacacaaaacagtgggtgtgcggagcggctacggagcaaccgagcacgaccaagacagagtacactacacacacacaaaaaccgaacaaggagcgcgcagcgcggcgcaacccaccagcagtacagaagtaaaacagcacgcgggccaagccaaagacaggcgaaccgacacaatgcgcagacaccaccacccacgtggacgccaaccacggaacggcagccgcgcggaacgaagagaagaccaacccagccacgaaaaaaaaaaaacagataagagacagagagagtagaggacaaacacacaacacggaacagagccagacccgcgaacagcacacatgacacaccgcagacatcgctgacgaaaccacacaaggagggaaggcagagatacacgaaaccagcggagggcggaacaacaacaccgcgaccacgacgcgggggcatgagcacacaacataacgcaacgagggtagacgaagtagatagagacagtggcagcagacgccacgcgcggcaggaggggggaacaacacacacgcgccgaaagacccaaagaacgaacgcgacgagcgaaaccaacccaacagagccgggcatcccagaaggaaatacaagaccgagccgcgtcacaccgacaccagaaacagcacaagcgaagcaggggggaagcagagagatcacacgaacacacagcggccacacgcacgagacacacacaaagaacgaggatgcaaacaggctgacgagaccacggaccacacagcagcacgcaagcgagaacgcactgggcagaccaggaaatagacaaaacaccacctatcagcaaaaagataagatcaacaagaaaacataatatacacaaacagcacagtaccataaaaaactaacacactacatatcaacaaaaacacataaatcaacaatcaatcacaaaaccaccccactacctcattaatcctatatataacggacaacagacacaaacggctctcaagacacacacacaacgaacaagcagaggagtgcagcgaaagacgagccatatccgacctacgcacgaagctgacataacgcgtgaagctacgggcacaccaaatccgaacagccacgaccgaagaagaagcacagaccaggaacgtgacatacccccggcagaccgcacttcaacacagacactcaaaccaacagtacacaaaaacagaaaggagcccagaccacatagaagaagaacacaatacagaaagaacgaaca

SEQ ID NO: 710233 - DNA, 267 bp, Homo sapiens
acaaagactgggctgggcataggtggctcatatcctgtagtcccaccatatttagggaggcctgggcgggtggatcgcctgaggtcaggagttcagagagcagcctggccgatagtagagaaaacaccatctctgactaacaatacagggattggctgggcgtgatggcgggtgcctgtggtctcagctgctcgggagactgaagcgggagaattgctcgaacctgggaggcggaggtttgccgtgacgccaggatcgcgccagtgc

SEQ ID NO: 710234 - DNA, 265 bp, Homo sapiens
ccctttgcctcctgggttcaagtgattctcattgcctcagcctcctaagtagctgggattacaggtgttataggatcacattgacaaaagtaccatggagttttatgagtcagcatattttattgttcttattccttcaatagttattacagtaattttcctctttttttggcctttcatgaaaaaaaccttaaaatattgaagttctgccaaaccaaaaaaaagaccaaaggctaattcctcccaaaccggttaaaaggaagcc

SEQ ID NO: 710235 - DNA, 219 bp, Homo sapiens
gtagtgtatggaaaatcatagggaacatacaactaattagaatgaataaacaagttcagcaaggaatgctggatacaagatcaatacacaaaagtcagttgtacttccacatagttagcaatgatcagccccaaagtgaaatttggaaaacaattacatttgtgattgctttggtaaatgcaatttataatcttttaataatttataattgcatttata

SEQ ID NO: 710236 - DNA, 163 bp, Homo sapiens
tgttcagaccgatcttgctgcaacactttccggcatttctgataaaggcacggactcattctacaaaggcgcgaccgctgatgcgatcatcaaggcaagccaggacaagggcggcattctcgccaagcaggatttcgaacaatacaaagtacgcgaactggag

SEQ ID NO: 710237 - DNA, 182 bp, Homo sapiens
ttatagccatttcagggagttaaattatcctgctggatgaggaatccttgaagcaagaagtgacatgatcaggctaggcaggggggctcacgcctgtaatcccagcactttgggaggccgaggcgggcggatcacaaggtcaagagatcgagaccatcctggccgacatggtgaaaccccat

SEQ ID NO: 710238 - DNA, 342 bp, Homo sapiens
tatcaacaggacaggtatatacaccgtgaaaaatatgatcagagagatgactattagcggaactagccttgacctaggcagtgtaatgccccgagctcatagtaccactgggttcaacaattccatataaggaatagagtacccttgtattttcttctgcaacattcttacatttaagggtgcaaaaaggagccaaatctaagatttccggaaactttatgtgtttgttaactttgcgtaggttaaaaccagcctgctgaaatctctttaaatgaagagtaagaacaggaggagcaagagaaattagcatctgctttttggcattggtgtaaacatgcttcc

SEQ ID NO: 710239 - DNA, 120 bp, Homo sapiens
  misc_feature (91)..(91): n is a, c, g, or t
aaaaattacagtcacttggggcctcgctcattaattttcgtctttatgatgaggcatttatttgtggtccggcggcgatgatggatgaacnggaaaccgccttaaaagcactgggaatgc

SEQ ID NO: 710240 - DNA, 574 bp, Homo sapiens
tcatgactgcgggcccagtagtttgtttcaccccggtcaccccaaacacgtaaggtaatgtctaatgctatgcattctgatggctgcagcatgaccatgtggtaggaatgcttcatctctgttatactttgatggggctactgtggtttgtgccatccactgtctactgaattgttgttatgttgtacacgattgtacctgaagcagaaactgttagaacttcaaggagaaactgacaaatccattatgatagttggagattttaatacccacttctcaataattgaacaaatgagtagggagaaaatcagtaaggatatagtagaacactatagtgttgaagaacactattcatgaagttgaccccattgatagatacagggacttaaggcagcaggatgggtagcttacccagtgcacacagaacatttattaaggtatgccagaaaaaagcttaggaaaaaaaaggcaactcataaaatatgctctctgaccaagtgggcttcattaagaaattataataaaggtttctcggaaactgccaaatatcagataataaaggatacatttctga

SEQ ID NO: 710241 - DNA, 333 bp, Homo sapiens
  misc_feature (46)..(46): n is a, c, g, or t
  misc_feature (152)..(152): n is a, c, g, or t
  misc_feature (252)..(252): n is a, c, g, or t
aaaaaaaagaagaagaaggggacccccgggaaaaaggccaacaaanctaaccaggagacctgagaacagcggcaaagggctacaacattagaaaagaaaaaaccgaacaggagttctttgggaagttttaatgataacagcttcaacactantgagaacataccaaacctgtaatggtcactccgttcacgtccctcctcatggggccggcgggacggcccgggccgggcgatcggcgagcggagtgcacanacgggggcccaggacaggcccgggagttccgggacggggactgggcgccggaggggtgacgccgggaccgtgggacgggaa

SEQ ID NO: 710242 - DNA, 679 bp, Homo sapiens
aaagtataggcgatcagaaattgaaccctggcgcaatagatatagtaccgaagggaaggatgaaaaattataaccaagcataacatagcacggactaacccctataccttctgcataatgaatttaactagaaataactttgcaaggcagagcccaaagctaagacccctgaaacccagacgaagctaccttaagaaacagctcaaaagagcacacccgttcatattgtagcaaacatcagtgggggcccagcatcttaatcaggtagaggcgaaaaaaccttcacgctgagccgtgcgttgcatagctggtggtccaacgatagaatcttagtccaacctttccaatttgtgcccacagagccctctaaatccccttgtcacatttaacctggtaagtccacaagaggaacagctcttgggacactaggaacaaaaccttgtacgaagagacgtacacacacttaacacccatagtaggccctaaaagcaggccaccaaattacgaaagcgtcaagctcaaacccattacctaaaaaatcccaaacatataattgaactcttccacccaatttgaccaatctaacacctatagaagaactaatgtagtatcagtccctgagacatttctcctcgaataagctgcgacgatcacacatgactgaaattcaagccaatat

SEQ ID NO: 710243 - DNA, 387 bp, Homo sapiens
gtctgagcgcgctcggctttatttttattttctctacgggctgtccctgcagcagtggccggtgtccagctagcctacttttctgcccggatctcgggctcctcatgctctccggtactccgcagatctaaagccctcgggaatatgcagcagccatgccggtgtgcacacgctgtgagccccggagccccagcccggcccccgcccataccttggccagccagagcggaccaagggctccctgtggccatacctgtgctatacgcggagcgcacggcacgagtggttgagaagcccagggaaaacccgcagcgctgaagagaaggcagccagtgagagagccagaacaaagcgccaaaagatacagtatcaaagaggcccgtagac

SEQ ID NO: 710244 - DNA, 155 bp, Homo sapiens
ctaagttgcctgtgtgacttcagagtcatgttacttcttcctggagaatctttcttaggtgttgtatacttgaagatgctgggcatgaaagagcttcctaagttttgtgcagtgaactccttgatgttctggcagtaagtgttactctggcctgc

SEQ ID NO: 710245 - DNA, 436 bp, Homo sapiens
  misc_feature (25)..(25): n is a, c, g, or t
  misc_feature (50)..(50): n is a, c, g, or t
  misc_feature (168)..(168): n is a, c, g, or t
aattcacatccattttgtcctgtantttccacatcccacaggtatataanctacctttgggtccttgatgttggtgatcattcagattggggtttttgtgtggaacgtccttttttgttgatgttgatactattcctttctgtattgttagttttccttctaacagtnaggcccttctgcttacaggtctgctgaagtttgctggaggtccaatccagaccctgtttgcctgtgtatcaccagcagaggctgcagaacagcaaagactgctgcctcttccttcctctagaagctttgtcccagaggggcacctgccagatgccagctggagctctcctttatgaggtgtctgttgacccctgctgggagatgtctcccagtcatgaggcatggggatcagggacccacttgaggaggcagtctgtccttagcaggg

SEQ ID NO: 710246 - DNA, 790 bp, Homo sapiens
acagagctggcctggagtccgccggctggcctgctgtgagtatgtccctcgcctggctccctcgtgggcctccactgcagctgcagctgcccatagctctgaacagtccctgtgttcccagcccacctggaacccctggcagagtgcccaccaatggctctgtgttgccctttgatgtgaccttgttttggtgcatgtgctgctctgtgttgtggtgaactggtgaccaatggctgatgccttccattgcagactgtgtgcatgaacattttgctgtgatgcacatgctgtgctgtaatgctgtgtgtgccagcatttgacattcagtctaccattgtgccactgctgcaatgattgctgtggatgtattggttgtctgatgctgtggaccttggccttgtgtacaaccatgcttgctcaacatacttccccaaggatgtgtcttcctgtgcctcgcaaacatcaatccagctgcatcttctgtccagctaccctcgtgcatgcatggagttgtgggatttgctgtcctggagcagattggatgaaccaccggttgttgattgcccaagcaaatggacgactggatggttccttgcttgacttccagcatcttttgggactgcaaaatgcttacccccattgctcaatgttcgcgttgcgcccttgaatgcttgtgggttccctcgattcatgacccgtccaacccctttcccagtgcccccggggaacctgccccatgtgacccctgttggagcttggccattgttggccttgcggccattgagcctga

SEQ ID NO: 710247 - DNA, 937 bp, Homo sapiens
gctgatgtaattaccaaactcccctgggaggggggtgctctctgctccatcataccgatggggaacgggaggcccagggcagatccataacaagggcatgtggacaggtcactttgtggtctccatccagaatagcatcctgctgccaagtcagtgggcgtgtccccttcgctccaggcctgtcccatctatcacgggtaggggctcacctggccaggtgtactctgagcatggggctactgcatggcaggtgggcagggtagtctcccccagtctcttgatgccatattcccaatacacttagtctgttgcattgtagtcactaaggcatgctcgtcggggtggtcaggagagcgggtggtagaagcctgaaagatcagtccctggggacacgagcagagcttcgtcctcagtgaccagcagggctgagccaggcctcagaccggcttctggctctgggtgtgcagaagaagaactagaagcaaggtgctttcctccgggtcccagagctgtgagtgatggagccaggctgggatccagggttacctgagttacctgacccctggtcatttcatagtcagctctcagcacttaccagaggaacaggcagcctttggtactgccttcagagaacagagagatgagagaattcaaatgcgtgtgaggtgccctgtctagtacaagcaggcgcagggggaacgaaactgcgcactaagtgaggtgggagcggaaaactagggagagggccccggtgcagttggcttggaattacggccggttaaactcccccggcagatacatttcccccccatacaggattgggccggcacttcttgtgccccgtacatgttaggggagcaagagcaccacagggttcggcgaccccaggctcatgaggtcccgacaaggaacggacaggcggaacacgcgcagaata

SEQ ID NO: 710248 - DNA, 179 bp, Homo sapiens
aattcatagtaggggtaaaaggagggcatttctagatcaaataataagaatggtaatatgctactaagaaagacattttatgagagcaaagggacgcgggcggggagatatacgggccgaagccgcactcgtaagggggtggatttttctagtgtagcacgttgagttatagagacccg

SEQ ID NO: 710249 - DNA, 774 bp, Homo sapiens
gaggcatgaggcagcaggcagggttctgctgagggggcaggcggagtttgaggaaaccgagataagttttcctcttggaaagatagagattaatacaatacttaaaaaaatatagtcaataggttactaagatatggcttagcgtaagttttaacgtaattttaatagcttaagattttaagagaaaatatgacgacttagaagagtagcatgcggaaggacacagatacaagggtttctaaaacatgacggaggtttgagatgaagcttcttcagtggagtaaacacagtgtcattacacagaacactggcagagcaaggactacagagccccgaattaataccaatagaagggcaatgttttagattaaacgtgaaggtgacttaaacagcttaaagtttagtttcacaagtggtaggtgattacaatactctgaaggcgatcttttaaaaagagattacacgaaggtgattaaagaccttgaaatccatgacgcagggagaatgggtcattaaaagcctagtaaagcatttactaaaggcagacgaaaatggaagatcactgggagtggtaggatgacacaatttgagaagatagaagttgtgaggtggaaaactgcacagccgaagtcggcagggcagacacgatcgcgagatcggactagagctcccacctcttttgaaacacaacaaacaaaacaaaattttggggtcgcgcgaaatttaacacatgtgggggcgccagtggaataactggacaggccagaatcgttc

SEQ ID NO: 710250 - DNA, 606 bp, Homo sapiens
  misc_feature (89)..(89): n is a, c, g, or t
  misc_feature (116)..(116): n is a, c, g, or t
ttatccgtagacttgaccacatcgtgatgacggtgaagagcatcaaagacaccaccatgttttattccaagatcctgggcatggaggtnatgacttttaaggaagaccggaaagcnctgtgttttggagaccagaaatttaacctccacgaggtgggaaaggaatttgaacccaaagccgctcacccagttcctggctccctggacatatgtctgatcacagaggtgcctttggaggaaatgatccagcacctcaaggcttgtgatgtccctattgaggaggggccagtccccagaacaggggcaaaagggcctatcatgtccatctacttccgagaccccgacagaaatctgattgaggtgtccaactacatctcctcgtgatggaggctggacctcctccattctgtcccccttgatgtcgccctctcctttccttcctgcaaacccccacccaggcccagagatctccaaagactgaggacttaggcacttcacacatcctgctgaggggggacccaagacaggtttgggaccaaacctacatgtctgtatgtcatcaaagttggcctaataaatgcataacctctcaatgaaaaaaaaaaaa

SEQ ID NO: 710251 - DNA, 473 bp, Homo sapiens
  misc_feature (3)..(3): n is a, c, g, or t
canccagaaaagatgccccagaccacagccatgaggccccttgtgtgacgtctgcgcacaaacatgccttgcatgtccagctcaaccggcccaacacgaggtctgctggggctcagacagtttgaaggcctgacctgccgattctggaggcctgcctgccgggggaggcggggccgtgggactgggtgaaagtggaacgctgtgggaagatggacatgagggcagggtattcccgccccatttctaacccttcactcgttgcttcacagagagatggcagaccgcttcaacaagatttcgagagacgctgactgtccggcggcggagatctctcgggcaggaaagacgttacctgcctgtgccatacactagcttacaagctcattgaccggggcaactttcctgcggaacctataggagcagtgcttctgaattagggctttaagcagcctcctgacttacacaactttttt

SEQ ID NO: 710252 - DNA, 511 bp, Homo sapiens
  misc_feature (6)..(6): n is a, c, g, or t
ccttgnagggaagttaactgcaaaactgcctcaggcaggtccttcaggagatattccagaagaagacatcattatcataggagatgacagctccacgcacgaacaccagtgattcatagggttttcggtcaggcttctgagcccaagcctgcatgtatacatccagatggcctgagacaactgaaaagtacaaaagaagtgaaagagccagctcctttcttaactgatggacaaaccttacaacattccattatgatttgctcctgccctgtcccaaatgattgatcgatggacctcgtgacattcttcttctggaaaatgagtcttatgatctccccaccaagaaccttgcgacgccaacccctgcccgcaagagaaaaaccccctttaactgtaactttccactgcttatcccagtcccataaaagtgccgcatctctaactcccttcactgactcctttctcagactcagcccacttgcacccaaatgaataaacagctttgttgctc

SEQ ID NO: 710253 - DNA, 564 bp, Homo sapiens
  misc_feature (6)..(6): n is a, c, g, or t
ccttgnagggaagttaactgcaaaactgcctcaggcaggtccttcaggagatattccagaagaagacatcattatcataggagatgacagctccacgcacgaacaccagtgattcatagggttttcggtcaggcttctgagcccaagcctgcatgtatacatccagatggcctgagacaactgaaaagtacaaaagaagtgaaagagccagctcctttcttaactgatggacaaaccttacaacattccattatgatttgctcctgccctgtcccaaatgattgatcgatggacctcgtgacattcttcttctggaaaatgagtcttatgatctccccaccaagaaccttgcgacgccaacccctgcccgcaagagaaaaaccccctttaactgtaactttccactgcttatcccagtcccataaaagtgccgcatctctaactcccttcactgactcctttctcagactcagcccacttgcacccaaatgaataaacagctttgttgctcctaaaaaaaataacgacattatgtaaatcattggccttgttgaccttagagga

SEQ ID NO: 710254 - DNA, 378 bp, Homo sapiens
agacaactctgttaagaaacaatctaatgacctggttaagaaaaagggggcaaaagatttgaatagatatttctcaaaaggagacctacaaatggcaaacaggtataagaaaaggtgctcaatatcaccgatcatcagagaaaatcaaatcaaaactacaatgagatatcatctcaccacagtttatatgactatgtatgtaaaagacaggcaataacaaatgctagcagggatgcagagaaaagggaactcttgtaccctgctcctgggaatgcaaattagtaaaaccactaaggtaaacagtctggatgtttctcaataaactaaaagtttagctaccatatgatctagcaatcctactgctgggtctacaccaaa

SEQ ID NO: 710255 - DNA, 256 bp, Homo sapiens
  misc_feature (217)..(217): n is a, c, g, or t
tgtaatcacgtgtgtggaaaggaccaggggacatcgtggaattgtaggtgcagcgtgcccccatactattctcgtgataatgagtaagtctcatgagatctgatgtttattataaggagtatcactttcgctagtctctcattctctcttgtctgtttaccatataagacatgccttacggccggcgctgtggctcatgcctgtaatcatagcgctnttgttttttgtggaggacggatcacatggccactcaata

SEQ ID NO: 710256 - DNA, 913 bp, Homo sapiens
gacatgcccgctcttgtgacgcgttgacaatcgccggtagttgtttgaggccgacgttgtaagcctccccgggcgtccgtccggagggccacaaacaattgttgttgggcacacgcatgtccactttttcttggccgaaaagaagtgcgcactcgataatgcccccttcttgtgcctttctcgccgcgcgcagaatagatcttgccccctctcggtagggtcgcgcggggcaggacccaccggctcacccactgggttctcgccagcgccggggagagggttaccctccacagactcgccgctcggcggccacggcacgacactggggcattaccttctctggggataacccctccctcgcttgcgggaccgcatcacctcggagcttctcccccccgttagtagggaccccttttgtgtactactctcctgccgcaatctctggatatgtttgtggccccgccacactcccttgtgggcctcgtgccactccaaaggatagcctgtgtgcttgattatcaaccgcgcggcgcctgtcgattgaattacacaatacatcgttcgttgcgctcgtgaaacgggggcccgacacactacatggactgctcccttttcccatgctttctcaccagaaggccccagtgttcttcaaggcgcactctctcccctccccccgaattgtccagtcactgtcgcttcttctccttattccttctttctcccacggagagaagaagctccgctgtcccgcaaggaagcccattctggtaacggcactcctatcttcaaaaacacaaatttccaatgtttgtaaacaatcggcagtccgacaaacagaaggagaaaaaaacaggtaaaccccccccacgggctaaaaaaagaaaaaacggggatatttccgacccacaaaaca

SEQ ID NO: 710257 - DNA, 293 bp, Homo sapiens
cttttggggtctttgctcttttgggactgcagcatgctcatgttccaggacgccacgtagatgaggctctcggccaccgaaggctcgcgggaatacagcaggatgaccttggcgctctgcaccggcacggggctcatgctggaaatctcggccgccagcgctaaggcagcatccagcatgacctctttgtctgagaacacccggctgaccagcccactgcccagggccgtcgcagccatcatcttgcggacggtgaaggccagctcgttgaccaggctctggttcccgatgac

SEQ ID NO: 710258 - DNA, 161 bp, Homo sapiens
agtttaatcagctgcaatgaaaacaaacgtcttttattaggcagaatccagatgctcaaggcccttcataatatcccttaatttagtagtcgaacttagggaacaaaggaacctttaacagaaatagaacaacaagaaagcgaacttagcgatactcgcgg

SEQ ID NO: 710259 - DNA, 251 bp, Homo sapiens
gaaggaaactgcatcgtgtgaatcacagtcataatcaaggcagtattccagagaaggatagacttcttttcctgtaggaaccgagtccctccttggaacacagttgctcttgttgcgtctgttgaggaagactcagtattgcacagaggtaggaatctgtgtgggtagcagttcttatgggacgtggcccctggcagcatttcagatttagggcgggagtacagttgactactttgcttcgagtatcgagt

SEQ ID NO: 710260 - DNA, 336 bp, Homo sapiens
cgagggcatctgaactccgctatatgacgcagcatgatattttcagagtcttgtccccggcgtattagcacctctttttgaacaggaaatacgctaccgactggacatggtctcctctgattatcaagtactgacgctgagggcattacaaatagtaagcctcccacctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgct

SEQ ID NO: 710261 - DNA, 671 bp, Homo sapiens
tttgaagccactccaaacaagaacaaaaaagaagggggatgcctgaaagcctcctggccctctcaaggcaatcacttcccacatatgtaataatccgctgaaattggtgccaagtatcagaatccgccttgtttctatatctgtaacatgtggggatcctagtatctgcttgtgaaataccctgttatgaggccatccccatagcactaataacatttagtcatgtgtcctgaagtgtcaccgccagtgccagccttatctcatgttactaacgtttcagatcatacaacagagtagttgtagtgcattatcgggttctttctgtctaagtgtttacaatgcttacctctgtcatataggctttccgccggcaaatgttcagtgtggtaggtgtagagtcagtatatcgttcagcatgctcatgcactaacagtctagcttctcctcatgtcactgtagagttatttggtagcaatcctccagttcactgcagtgacggctcatctctccgtagcttctcataccgccgcccactacaagcatcgttcatcagtgaggttcagtcttcacatagtcagttcacactcgcagccacctctcattctaactctggtccagtcagagggcacaggttacagcgatgctgagcgatgtggcctggtcggcacaag

SEQ ID NO: 710262 - DNA, 478 bp, Homo sapiens
actcagaatcctactctcctgactcccacttcaccattttgagaatgactgactaaatcagtcagtcatttgttcgtcattccaagggtcttttccttcccttctccttactactttcctttcattcttccttccgttgatgcatttctaaataagttttcaaaatagatttgttatggaactaagaattactggacacctattatgtgccaggctttatgcaaattactgagtatataacagtagaatagacagacttggatactgtcctcacgtagcttagaatttaacagattgttgctttgagtgtagtttagatttccttttattttctgcttcccctggtatcatgctaaaccagtcctatagcattgtgtgtttagaatgttgttacttatatctctgatccagatgataatttggaaaatttccagagagggtatttttaatacggagtatttattatcaaaaaaaaaaa

SEQ ID NO: 710263 - DNA, 1012 bp, Homo sapiens
ggccggctccgaggctccgggcggtcagttagggccgccctggtggattcctcccgctgcgaggctgggaccctatcaagcttcacagatcagtgatgcggcctggatccgaaggtctctcggtgcaggaaagtggagacgcttaggccgactccagaggtggtctcaggtcaccagggtggtcccgagctgagtcgggagccgtctggctgcagtctgtgcaagccacagtcctttgtactagaggcagtaggttaccacacacgcatgcgccagtgacctcgggagtacgtgccgcacccaggctctacgggattcccgtgcgcgctggccaatctactctcgcgagataccagtatcgatcgctagggcgatagatctctagtaccagtctcatgacgagccccccgctctgtgagaacggaaccggtcgatctgtccgtcccaaaggcctactggccgcgagaatgctctaggccagttgggtgcaagtgcccaagtgcttacattgcacatgggggagcaatgccaagttggcacgattcccatacattcgttgtaccacaggaagggcatggaacgtgtgcatggtccacgttatgagccacaccagccaggtctgcgagcgtagagggtcctacttcgaaggtggcgcccccattgggagtgagataacaccattttcacccggtaacgccacctttgtgatcaacccgttattccagcctacatacggagaaatgaccacccccgtttacagaatttccggcaccagttgagagggtttcgcaaagggacaacgcacaactgttcattagtacaaattcacgtaactagacagagaagcacaattatactcgagagagcttccaaagtaatacgacgattggtagaaccaaacggagatatcggtccacacccgcgcagaaaggctctccacagatacccaagtaacacccttctagacagcgccagacgagggtatttcccagcgctggatgcccagaataag

SEQ ID NO: 710264 - DNA, 224 bp, Homo sapiens
  misc_feature (22)..(22): n is a, c, g, or t
  misc_feature (51)..(51): n is a, c, g, or t
  misc_feature (178)..(178): n is a, c, g, or t
  misc_feature (189)..(189): n is a, c, g, or t
aaattccttttaccatctttgntggtattatgactccctaaccctcaattnaaaattgtaaatcagaccaggggcagtggctcaggcctgtaatgccagcattttggcaagctgaggcaagaggattgcttgaggccaggagttcaacaccaccctgcaacatagcaaggccctgtcncattaaaactnaaatttaaaatagtaaatcagtttggcccaggatc

SEQ ID NO: 710265 - DNA, 1093 bp, Homo sapiens
  misc_feature (190)..(190): n is a, c, g, or t
  misc_feature (1092)..(1093): n is a, c, g, or t
taatttagaaaattaaaaataataacttataaattggatctcattatcacaagggtaccttggaaaagcagcttatgttactctatggaagataatcaggtaaacatgttaccaaatgatcattaataatttaaggtccttcaagttcaagggcagggtaaatcgtggtgtatactacttataacctagntagagaatggattattcaagttatcagcaatattagtccttaaaagtgttatcgttgggtgtaggtgcaaaatatatatggtgtatatttgtacacaaacttaaactacgtggacaacaaaagagcaagggtaatcatcacaaactaagattttctgggtgaacaccacaaatccgagttcattcgggagggtcatccgagttccagtagtcttctgggaggaaaacaccattttcctcagttcagttttcttctccttcttggatagtataaatacaccaaccacggggcaataaaggggcatatgagggcaaaggttagcacaccaggagacatctcgaagggccaccaagagggtctcgtggaggggggctgaggagcagtctgcaatgttgatgtcgagatttggcctgcaaagccatcagcgttccagtttctgcagtctctgaaggacattctggatgtcctacctggaagctcatcagcacgagggcgaacgggcactgaagggatgccgggaccctcggtcggaggcccaggggtcccaaaactcccattccacacggcggcgccggagcccggccaaggatggggaccaggggacacacccctgtaaaatgaaagaacagcgagtatcagccaccgcatgcacgcgaggggggacgcgccgaggtaaacgcagcacactgcacgaagggaacaccttcgttaagggggaccgggcagatacacgatggagcgggggaggagcttatcagaacaaacaagggcggcgggaggcacgcacaacctgatggggagaacagacaaagcagcgacacaacaatcaactgatgaaaagcacacgaagtgatagagactcacgggacaaaaagtacaaacaaacgtccactccacacgann

SEQ ID NO: 710266 - DNA, 1734 bp, Homo sapiens
  misc_feature (471)..(471): n is a, c, g, or t
  misc_feature (537)..(537): n is a, c, g, or t
gcagtgcaggatgtgagcgagaagacacaggagcctgattgcatgctccggaatctatcgcaagtggattagactccgaagaacataccactagtcttccattacactcgacagcgagtctgtggtacgatgagaggcatcaacgaatgtcggttgccatcatcgtggtatgtcgcagcaggaattcaggaaaattggccagtgaacaggcaggactcgggaaacatccacactgtgcggcgatcttgtatcaccctagcgcaccatattacaagatgccttgctcattgatgcgcacatatatgtggacattacacgtgatactcgttcgcacaatgacacagcatatcacgtgttggtcgcaaggacgtatgctccatatcgacacataacgttacactaggaagtattggatcgatgtacgtcacaggtagatagacagcttattaataccgtcttcgcgattagccnatacattgttatcacagtgattatgcaaacatgtatctacaaagaatcgatatcagagagacacgntcaaagatggctgcgccttggagagataacactatatttccgcttgggactcggatcaatcagtcagacaattgcaacagggttataacgtaaagagaatatggacccttctcctaaatatatatcatatgtacagaaaccaaaaaggacacagatgaacaccataatgattgaggagaagagtgcgtgagtgcgctggttttccggaaaaagttaagcagttttctctcgcacccagggtgtgtgcccctcaccgagtgtataaacgtcgaatttgccacaacaagctaaatatttatcggtgtcgacacacggggacaggtgttgtaccttttttatggccagagagaagaacgggacttggtccccaatttccttaaatgtgcccgcaaaggcgaacatcagagttcgggcccccgggttaattaggaaataggcccgataatatcaaaaccgggtgcgggtgtacactacggttcttgggttaaagagcgccccaagagggtataccttgggttcttggggaaacaaggagtatctaacattggacatgggggacagaactgaagtaagccggttaacaacttggaaggcccccctcactttcccaaaccaagttgtcccggaacacactgactaggtcggttggtgacattaagcgccaagaaatttctgaaaattacgcttccccggaggtgtggtggttccaattccgttgttgcacaggcaccacacgcatcccagcgggttttaaaccccagcgaacgtgatttggtcggcaattcgccaactgacttcccctgccgcaacggaaccataatagtcgctttggaggcagagcactatatgtttttgcacccggccgagatgatctcgcaacagcaaaagcagccaacagagcggatgagctcacaaaaaccacaattttgggttccctttccaccagcacccactacatgttgcgcgcaggcaacggagggtgattcaaaggttgataatattcaccaggtacgaccagacacatacgatcatacaacacaacaggggctcacccacgtagtgtgccactatacatcccacggggagctaacaacagacgtttggcacgcgtgtccagcgccaacctaacagtaacacgacgcgcaccggcagaagctgaaaattgtgagattgaaggagagacacaaccacgaaagc

SEQ ID NO: 710267 - DNA, 620 bp, Homo sapiens
gctgctgctgggagcgcggaggggaagggagcccccaggcctgctgggccggcccaggcccctccgcggctcccccttccactaaccgactgcccggaaaccactccccagtggttgttgaacaccccgggactccccaagaccagcctctgtgtgcagcagcacccgaggcgggactaagtctccaaggatgcccttggtggatttcttcatgcgagacctgacgtcataagccttggctggtgggcatggtgggaccagttcacacaggatgttgaaccgtgagctcacaacaactgtcagaaatgagcaggtccggaaaccaggtctcagcgtacatttccaacaaaattcctggaccacacagaatgaagtggagatccacatcaccccaccgaatgacaggcacgagaaaataacacaaggcaatgcgcccgaagacccaaagaacacatcccagaaggccaacaacccaggccccacgatggataaccgacactcgaacaacgcgcgcaatggccgccaacatcagacaagagggacggacaaaacacgaaggagagcacagagacacagccgacacacaaaaccaggaaacccaccaacaccaagagaggaca

SEQ ID NO: 710268 - DNA, 143 bp, Homo sapiens
cattacttatacttcctcagcgctcatacatatctcaaagctaatactacctcaacgctttatacttcctcaacgctttatacttatctcaacgctttatactatctcatatcatatcccggtatgaagtataaagcgttgag

SEQ ID NO: 710269 - DNA, 390 bp, Homo sapiens
gagtgtcggaggaattcttttttattaggtgagcattatttataaactttgctatgaaaaagacattaaaatatgagatgtatgatgaaaatctaagtgaagagacttttatggttaacttataatattactctgaatgcctaacgcacacattgcttaatattataagttaaccattcagagtaatattctgcattatgagaaaacttaatttcatttataagtagattaaaattagtatattttactaatacttttatatagaatgcagtatatttttttaaatttcagattatatgtgatgttaatatattcaacctttttaacatgttaaatactattgtgcattcaatgaagtgttattatgccacagacattaacctattccac

SEQ ID NO: 710270 - DNA, 478 bp, Homo sapiens
  misc_feature (20)..(20): n is a, c, g, or t
  misc_feature (107)..(107): n is a, c, g, or t
taaaccagctccttcatganaagagggaaggcattaaggcaggtggcctagcacccacaggcagggagggacagtaaagaacgtggcattaggctacaatggggatntgggcaaagccccaacacacttcccagcaggtactcaccccaggagcttgctgtggtcgagctggtggctggggggcattcgacaggcactaaacacaatgatcttccgcccatacttgtcatctcctaggtgtggagaaagatggagcacagtgggttgaaggggaaccaaaagaagtggggtgaggaacttaaaggggccaggcctgctgatttgagccagttaccacaggggccagagtgcccatgcagacagacctccgggcagcctcctgcatgcaagggtgtgccactgaagacagggacagcttgctttcagggctactgagctggggtattaaaaaaaaagtgatttttttttctttgaaaaa

SEQ ID NO: 710271 - DNA, 1312 bp, Homo sapiens
ttaccggccccggacgttttcgggatatcggaaaactggcagacaaaccagacatgggggaatatcgccatgcttcggataaggccatgcgtgaacgaaaatggagacgcaggagaagaacaccctggccgaccatacgagaccattgagcaggagaatgcggtgtgaaatttcctaagatcctggaggatttccgtaggcacccgtcctcattcgagcaccccagtcgtgatgctggaggcagagctcacctgcaagtatggacacgagccacaagctgcactgtgaacctgggtcactccgcgccgatgccaccggactgtgggtctctgaagggacccgcacacccacaatcggactgccaaattctccggtattggccacgggatatgatagaaaattataagtaatgaccctcacctgcataagatcaacagcaagacccctcagctggacccacccaccgacacacttgccaccacgacagatagccgacacgagacccctggaaagaaaaaattgcctcaatcagaaacacggcgacgccacaccccccaccgtatacccacagttacaagagtaaagaaccaaagtaacctgcaacccagatcacccaagtaggaaacagcaaagataaacacaaaaaaataaaatcaaatacagtgaaagagcacctacaacccctcgccatacgcaaacacctcaccgagcccaactcacggaaacactgtaacattacccctgctcagcctctactattataaacagacccaagtcactcgtcacaaccacaatcataatagaaacacatacgtaaccaaacaatagaaaaaagaaaaacgatatacacaacacggcgaaataaaaaaacactaaacacgacacacgaaatacacaaacaccccttcacaaatctaacccaacttgtgacgaccatattcatgggcgtgtgaagacagagaagaaagagagtgatagaacgagcatgcgtattaggttgtcgatgacctatatggcagagtgaaaccaggtaccactgggtcatcgggaagagaacataaatgaaaacagcaacaaagttaacaaacgtaactatcgagaccgggtcctaagcccaccgaagggagcgggaaggaaacagaaagagaaatgcaacctgagacatccgaggcagcatggggacatcggagggggccaagagagtgagcgagacagggaagacacgagggaagcgcagggagaagaggaagaaggagcaaagagagaagaaggtggaacaagccacacccgaatacagtgcaaagcaggagag

SEQ ID NO: 710272 - DNA, 1144 bp, Homo sapiens
  misc_feature (493)..(493): n is a, c, g, or t
  misc_feature (818)..(818): n is a, c, g, or t
gtggtctcgatctcctgacctcgtgatccgcccgcatccgcctcccaaagtgttgggattacaagcttgagccaccgcgcctggcactagcctgttttttgataacaagactggcggtgcacaaagttgggtctctgtgttcaccgggaggtgggcattggccaggtgggacggtctccagcgcctggtgcaaatctccaccaaagtgcaggaaacagcatcaactattactgcaaagttttggtttggcgcagcgggtagacgttccagcgctgaaatgcgcaagaaagtttttgctgcgcatgtaggcgggtcaggcccaagcgcttcttattggctaatgtggagcgaacctgcacatccattgactgaaagctccgtctatttgaggctaaccgagagcgtcccttccttttgtgttgcctggaaacagactgtccgcctactaacatctgatcgcgtttcccattggtcggcgtttccggaagcccgnccttccgtttccggaagcccggcacaggctgggtctgcagatggcgtccgagtgcacagtggccagtgtgattccgcagtcttgggctgttcggccaagcgcccaccggacgtgggacgctggagggtcagcagcgtggagtcctggccttcagcgtccgcggctgggaaatcggccatcgccacggcgggaactaggactggctgcgtcccggcccttccccatccgtccaccggactcgtgggcgcccgcactgactgtgatgtagtttcctgacctctgacacgtattgtctcaagattaaaggaatcaggagcttcttttnctgtacttctgttttggatgcattggaaggtccagatttggaacaagtctctctagagattgaacagagctgcgcctggaacccgccgcagtgaggagacctgaagaccagaggaaacacagtcaagcgtacgtggcattcagggatgtggctgtgtacttcagccaggaggagtggaggttgtagagccctgctcaaaggaccctgcacagggaggtgatgctggagaattataaacatctggtctcactggaaattcatcttctaaaacaaaactcattgctcagctggagccgaggggaagcgccctggagatgaggagagac

SEQ ID NO: 710273 - DNA, 137 bp, Homo sapiens
gagcttgactcatagatctggcacggatgaatgagacatgcgaggtgtatagagtggtataaacggtagtgagttttaaagggtttacgacctcgatgttggatcaggacatcccggtggtatcagggtgtatcagt

SEQ ID NO: 710274 - DNA, 1298 bp, Homo sapiens
  misc_feature (161)..(161): n is a, c, g, or t
  misc_feature (311)..(311): n is a, c, g, or t
  misc_feature (502)..(502): n is a, c, g, or t
gtgctttcctctgtgcttttgtttttttttgttctttgttgtgtttggttatttctgttgtttgttgtgttgttcgttgtttctttttgttgatgttttttgttgtctatgttgtgtttttgttctgtctgtctgttattgttttgttcgtgtttatattntggcgacgaccgaaccgacgcagagcacgcgctgcagacgccgacggcgggaagcagagaggcggggacgacagccagacagaggaaggagatgcacgctctggtttatgttcgctcgtacgtcgacacagcgtctctctcgattctctntctgtggagagctccacatcatttctgtcgctcgtggctttattcactcacatgtgtgaggccgccatattggctccctcctccagtgtatggcgacgcacccgtccagtctggggggttgtcgttcccccgacggcgccggcgggtccccccacaccccgatacctccggcgccacctaactatcgcgancgtgtgctcccctgctacgcttggggggacgccctctttttggtcttgtgggtgtgcaccacacacccggattcgttgggcgcccactcccgacaactgtggcgaccccaccacgaggtcgggtttttcaaaatccggccaacccccacacaaggtacaactttttcttgggccccccttcagcccccaaggcccttctccccaattgtgcccacccggggacctcgatctcccatgagaccccctggggcctggcgtcttttcgtgccaccccttggaccaagaccaaacccagtctgggaccgccagattaccaagccagccaggcccctgctgccccaatcttcccatcttgtccaacaggggcctagaggtccccaggaagtggcccacaagcgtagaccagatcccccgttctcctgaccatccaccagccagcctctccaaccaccaggcgtcccagacctaggcgtcactggaacgagatgggaaggcaccacgggagaaagggataaaccctacaccccgaccccacggctggacactgctgactgtcctctcccctccagcctttggccttggcttttttatgcctatttaacctgcacggctgaagccacactcttttcccctttcccacgcactcacactcccccagagaagagacccatagttttcccccccaataatacctttctgccgacccctaggttcccttctgctccaccccagacttggtatccagcttttcagggccctggttcaccttagaaattaaaggttagttaacttagga

SEQ ID NO: 710275 - DNA, 498 bp, Homo sapiens
  misc_feature (2)..(2): n is a, c, g, or t
  misc_feature (157)..(157): n is a, c, g, or t
  misc_feature (159)..(159): n is a, c, g, or t
  misc_feature (195)..(195): n is a, c, g, or t
  misc_feature (206)..(206): n is a, c, g, or t
  misc_feature (234)..(234): n is a, c, g, or t
  misc_feature (242)..(242): n is a, c, g, or t
  misc_feature (252)..(252): n is a, c, g, or t
  misc_feature (266)..(266): n is a, c, g, or t
  misc_feature (298)..(298): n is a, c, g, or t
  misc_feature (306)..(306): n is a, c, g, or t
  misc_feature (315)..(316): n is a, c, g, or t
  misc_feature (323)..(324): n is a, c, g, or t
  misc_feature (326)..(326): n is a, c, g, or t
  misc_feature (359)..(360): n is a, c, g, or t
  misc_feature (362)..(362): n is a, c, g, or t
  misc_feature (376)..(377): n is a, c, g, or t
  misc_feature (379)..(379): n is a, c, g, or t
  misc_feature (381)..(381): n is a, c, g, or t
  misc_feature (392)..(392): n is a, c, g, or t
  misc_feature (407)..(408): n is a, c, g, or t
  misc_feature (429)..(429): n is a, c, g, or t
  misc_feature (493)..(493): n is a, c, g, or t
anaaatattttgtacaaaaatacaaagttttaaaagctctttaagtatatttcatattattactaatagttggcctatatatctgtatgtctgcatatttttcctacacttgggattttagaaatgtatggaactgtttacacagtatatgcttaantncttcccataactcaacgaccaatgataacctttttntgattggagtnttccatactttggaagacataatttgtntaatcgcncggttactgncgggggggaatctntgtgattcagtccatgtgcccaatgaaaatcngcttttcnccctggggnncattttnntncccaagtctttgggtaatggcgggtggcaaaanncnctagctgtcaattnncncnccgtgtttggntttccgtgcttttcnnttttcattctggtgggagggngttgcaattgggagggggtgtcctttgcctttgggagctgaaattttgctcatgtgatcccatnacagt

SEQ ID NO: 710276 - DNA, 595 bp, Homo sapiens
  misc_feature (371)..(371): n is a, c, g, or t
gtgcccattccccggcctttgatgcaaggggatacaatatcgggcccagagccccactctgggacacacacggagaaacaaacatagctggttgttatcgcccacacgggagtattgtactgcccggtttgagttgaaatgcccagtttttggacccccccctctaagagtctcacatctgtgtgtactcatcagatttcattgtattcccatttacctctccgcatcttttacttcgaaacacacgtaagtatgttaattagtaattcctctcccgagtaatacactccacacctcgtagtatcacattgtgtaaaactccccttattataaatatggaaagacatttttgcacctctcgcgcccatttnacagaaaattatgaggaaaaagcccctttcggtgcttctcactaaggcgtggtgtagcatagatactcctcgcgcccccttatcactatttaattcacaactcctactgattttatttctcattatatcgtcagatcgcaccgactagaagaagatattaagtaaagctttcgcttacatataaaacaaattctttttttgagccgaccacaaatagcacgaac

SEQ ID NO: 710277 - DNA, 838 bp, Homo sapiens
  misc_feature (714)..(714): n is a, c, g, or t
agcggagtgagcgggccgacatgatgcagctcaatgtaccgcttagccacgtctacttcgagaaggttctgcttcctgtaacaggcgaaaccaaggcgctggctgctgagctgaaccagctgcgggccatggtagcccactcaatctggcatgtacgtctaccagcgctagagctgcgagagctgcgtgctgcggctcagatcaagctcgaccgccaacgagcgcccgggctggaggtttgatagggactatctggcgacaggacctggtccactgtgagtgcagaacgctccaggatagatcccgaccttgaggctgcgtagcctatgaactatcctgtgctgcctattatacagtgatacgcagatgacatgccatccactggccctgtctgtagtcttggcgaggatagattgatgtcgctgtgaggacggagatccgagttccttgatgtgaagatctcaggaacggcaggaggttccgggaaactctcagcgagcaggttggccctcgaggtgtctgtgtcccatgtggccgccttgacgttgggccatatgccatgatgctcgtcgcgcagactcctgaaaatcacggatccgtcactgctagttatcgagtgcgacattggcggtaccatcgaatcagttgcatgcacagctcgaagatgttgcgtaccggttcgcaaggttaggcgagaccatgactgacggctgnctgcccagcaacgcggagcatgttcccgccaggccaagcactaagccgacgactacgcggcgccagttgctggtccttgacctgtgacctggcagtctctgtcgcggacacgaaccgagtccct

SEQ ID NO: 710278 - DNA, 255 bp, Homo sapiens
  misc_feature (23)..(23): n is a, c, g, or t
  misc_feature (75)..(75): n is a, c, g, or t
  misc_feature (118)..(118): n is a, c, g, or t
  misc_feature (165)..(165): n is a, c, g, or t
aacagagtaaacagcctacagantgggagaaaacatctgcaaactgtgcatctgacaaaggtttaataaccagantctataaggaacttagtaagcaaaaaagaaccccattaaaaantgggcaaaggacatgaacacttttcaaaagaaacataagaaaaaaantgcttaatatccctaattaggggaatgcaaatcaaaaccacaatgggataccattttacaccagtcagaaagggctattattaaaaaggt

SEQ ID NO: 710279 - DNA, 85 bp, Homo sapiens
ccccgggggggggggggggggggggggttgggcccccccctttttccggggccctttttaaattttggggcggtttttcccccca

SEQ ID NO: 710280 - DNA, 373 bp, Homo sapiens
tgcggacggtggacaggcggtgtggacggtggacactgtgatgcggacggtggacaggcggtgtggatggtggacaggcggtgtggacggtggacaggctgggtggatggtggacactgcgatgaggacggtggacactgcgatgaggacagtggacaggtggtgtggacggtggacactgcagtgtgaatggtggacaggtggtgtggacagtggacactgcagtgtggatggtggacaggtggtgtggacggtggacaggcagtgtggacggtggacactgtgatgcggacggtggacaggcagtgtggatggtggacaggcggtgtggacggtgttgatccgcccgcgaatttagtagtagtagtcgacc

SEQ ID NO: 710281 - DNA, 231 bp, Homo sapiens
gaaaacagctagtcagcagcacaacggagtccctgtcagcagctttgcctgagaagccaggtgacagcgaggtctcagcatcagcagcctcacttctagaggagcaacacgcagcccagcttccccaggctcctccgcaaacttctgactctgataaaaaagaacctgttcttgcccagcccgcagtcagcaactctggcactgcagcatctagtactactgaggtgtaag

SEQ ID NO: 710282 - DNA, 748 bp, Homo sapiens
ccgaggccgggagctcgcggaggcaaggccgaggataaggagtcgatgcccgtcaccaatgtggccgcttggtcaaggacatgaagatcatgtccctggaggagatctatctcttctccctgcctataaggaatcagagatcatgatttcttctgggggcctctctcaggggatgaggttcgaagattatgccagtgcagaagaagacccgtgccgcccagcgcaccaggttcaacggcatgtggtgcctatcggggacttacaaatggccacgttggtctgggtgtaaaggtgctccaaggaggtggccaccggcaaatccgtgggggggccatcaatccgtggcacaaagctctccattcgtccccgtgcgcaagaggtaatgggggggacccaaggatgggaaaggcccaaaattgtccccttgcaaggtgaaggccgtgggttctgtgatggtacggctcattcactgaccacagggcaatggatcgtctcgaacgtggtgcataagaaaagtggtaatgaatggtgtatgatgatgtaaacttcagcggggttggattgcaaccttgggaattccgcagggacactttgattgcaattttaagactaaagtacgtgacccgacttgagggagatgtatcacaaggtctcctataggagtcatgacacttgtaagaccaaacagagttcgtggagggatcaggtcaggtgggtacacataggttttacagaaaaaagtggtggc

SEQ ID NO: 710283 - DNA, 739 bp, Homo sapiens
agtggtggttcgtgcctataaacccagcaccttggcaggccgaagcaggaggattgcctgagctcaggagtttgagaccaccctgggcaacagagtgagaacctgtctacaaaaaatacaaaaattagctgggtgtggctgagtgcgcctgtagtcctagctactggggaggctgaggtggaaggatcacttgagcccaggaggcggaggttgcagtgagccaagatgacaccattgcactccacccttggcaaatgaacgataccctgtctcaaaaaaaaacaaaaaaacgtgttggaacggtaacaatggctttttgccttcctcttagggaaacctagtataagtcctgtgggcaataatacttgcgggggtgctggtaaaggggtcataattggggaagacggctactaaaccaattcaccaaaaaaccatcccacgaaaggaacacaccgcgttgattgagaacacttctgggcagattttgaaacggggcccaacgacgcggtgagtggggttaactctccagtaatctggggggacctaatagaggaaattaaggttcaagccctttttaaagatcacccatattaaagagagcgacaaaatcatttggtgtgggcgacgctgatgagccctccggaaagaagacgttttagaaaccaacattgtgtgggggcggagcgcggccccccagtgtatgtatgtaaagacgtgctcagaggttgtccaaggagac

SEQ ID NO: 710284 - DNA, 440 bp, Homo sapiens
aaaaataatcagtttattaatttacaacaggggtagcatcaacatggtagtagtcaacactaggacatggtcgggtgacattaaaataaggagttcctccacactgtgtcaacaggcgcccggggtgtcccagagaagtgaagaaatgatgggcattagggagtccacacaaccagggcaggcattcagggccccagacgcccagcgcatgtggacaagcacagacgccactgagtgtgagggaacgagcttctgatgctacattccaacatcgctgaaaacggaaaggtgctcacatctacgggataagaaagggcttcatctcctcatccatacaaggggagagcaagggagtacccctcgggcaaatcggggccccttaaaacgtttatatcaggtccccaccccctgggaaggtcacagggggaaccagacacagt

SEQ ID NO: 710285 - DNA, 139 bp, Homo sapiens
gggcacggtggcttatggctgtaatctgcaaactctgggaggctgaggtgggagaatcgcttaaccccagaagtttgagtccagcccaggcaacacagcaagaccccatctctataaaaagaaaaaataaagaaactgc

SEQ ID NO: 710286 - DNA, 128 bp, Homo sapiens
tcttgtcggagacactcatcttatccttcttgtcttggagcgagattccaattttctttatctttctgtctcttctcgctctctatctaactctttctctttctctcgttgaagaagtttatctctgt

SEQ ID NO: 710287 - DNA, 260 bp, Homo sapiens
taatataatagttacattaagactggttctgttcgggttgtcggtagacctgctcttcttcgtcctatgtgggtacttgaggcgtctgctcagcttttgcgtagctgggtttggtttagtccacctcaactgcctgctatgatggataacgacttgagacgacgtgacggacgacaggcttaccgtttacgtgagggagagactttggtatatgattgacgatgggggctacgtttttgtcatgtgagaccgaagcaggc

SEQ ID NO: 710288 - DNA, 278 bp, Homo sapiens
  misc_feature (33)..(33): n is a, c, g, or t
  misc_feature (199)..(199): n is a, c, g, or t
cgctgatccggagccctgatcttgcagcatgtngaagaaaggcgcattcgtactgggtacaccttcaacgccttggtcagcaaataggctcgcaattgatcagcaataggcttgctaaccagccaaagagcatcctgtgtcagccatccatctgacggtccatcgggttgattcagtttgaatgtatctcggaccaggngacgcaacccatctgctaattgacgctgcaaagactgtttgggcgcgacagcgcgcgggggggatttccaccgagctcc

SEQ ID NO: 710289 - DNA, 128 bp, Homo sapiens
acgtgtatacacagtgcggtgcatcttcttacaatgtcctgtcgacacagtgacaccgtgctgactccaaatattgtcagctggagctggacgagtctagaggatcgtcgagtacccgagtctacatt

SEQ ID NO: 710290 - DNA, 266 bp, Homo sapiens
cacttgtgaaagcaactcaatttggtttatgcccagggtaatatttttccaaggatcatccaaaattccccccagacaaggcttttgtcctcattaggggttggcctcagcctaaccctctaggactgttttattaaattgctgccagaattttacatccagttacctcccctttttagaacatattctttactaatggtattgaaacccatttttacttcatactgatgtttttggaaacagcaattaaagttttttttccatga

SEQ ID NO: 710291 - DNA, 101 bp, Homo sapiens
atcattcagctcgtacccgacagtatggactgatttccctatgctcatttcgtcctctttccccagaaccccccaaagtgtccctgatgccagcaacaatg

SEQ ID NO: 710292 - DNA, 1747 bp, Homo sapiens
  misc_feature (324)..(324): n is a, c, g, or t
  misc_feature (348)..(348): n is a, c, g, or t
  misc_feature (418)..(418): n is a, c, g, or t
  misc_feature (682)..(682): n is a, c, g, or t
  misc_feature (766)..(766): n is a, c, g, or t
ctcatctcctccatcaaccggtataccacggtacaccgtattctgcctggcggatgcagcaagaacgcgcgtaatcacggaggacgtgaggacacacaaatcaggagctcgagggtacatccatgcagaagcctggtccctcaatttcacatggaagcatgatcctgagagaagtatgttcgatacgaaacgttcgaatgcgaattccggttagtgagacttgtgttgtatccaatcagtgagaatacccagactgccattcacactccagcgtggtgtcatataggaccaagtctggatccatacagggttactccaataganatagacatcggaggtgctactcgncgaggtaaatgcgctgaatcttcctcgcaaggacataccaccaaatgcttagagaggcctctcggtgagncatcgatgagtgctctccccccctgcgttcaaatcgcatagctttgccgtgtgccttccagacggtttccttgacttattgtaaagaggtgaggaggcgttcccgcgaacgaaggcagagcgaacccacgcgagtatgacacgtgcaagagtgcaatatgccgcgtacgccacgtgtatgccccattggggaagagcctacaacgttcgtctccacaaccaggtgcggcgagcccacatcccagactatccacaaagcgttganacttggccacccaacttttccggtgcagcattatgagtcgaggaacccgtaaagcaccaatggggcctggcattaagtgtcccntccttagcgtacgtgtattggggtgagcggaacaggcaccaaaccttgggtgcattgtggaggggaaaaagcaaaaagtaaacatttagggtacataaacccccgcgctcgcacatgtggacagtttaggactctccaaagtgtaagccgggacagccgaaacactctctctacgtataagagcttcgtggacaatgccccggatagggcaatacgggtgccaaaccaaggccccaagcctaaggataaagccgtgtttcctaacccttactttcttcccttgggcttccagcattgtccaggttacgatgtgggactccgggtactaaatcctagcgttgaattgcccctcacaatgacactagggaaaggccgtccaaatgggcggtcgccaaagcgaaaacaggatttcccaatgtgcggtttccccgggagagccaacacagaaccgcaggtggaggagcaagtttgaattgcaaagcgggccccatttctcccatgaaggtatagggccaacaggacaactacacttcacgagttcgccaaaggggagtctccaagataaaccacgagcgaggtgcaaaccacctcttacggagaattgtctaatttcacaaaatctaaccgtgtggtgggaatgatcggaaacatacccagaggtgtccccccccgtgcggagaaaggactctgaggcccatgagcctcgagcgtagtaatatggaggaaagatcggcgaaaacacagtacacacaggcacgacggaaaacagtggggagaagtgacaacagcgcagatggagaagaggggacagctactacaccaccgagcggtggggattcgatagggagctgtgacacgccacaagtttgagcgcgccacaacaacaatgtgcgcggatggcccccaagcagcgacgtagaaaagacagcgtgcatagcacgggacacaaggcagaatatacacctcaggagggggcgttgt

SEQ ID NO: 710293 - DNA, 434 bp, Homo sapiens
aaaaaaaaaaaaaaaagtgaacagaagactatactatactacatgaagattctgcatagtcctggagacattcttcttgtagtatagtatagtcttctgttcactttttttttttttggttaagacaaagtcttactctgttgcccaggctggagtgcagtggcacaatcttggctcactgcagcctcgacctcctgtgctcaagtgatcctcccacctcagcctcccaattaactgtgaccacaggtgcgctgccacgcccatctaatttctatattttttggaggaacggggtttcactatcttgcccagactggtcttgaacccctgggctgaagtgcggcactttgcctttctcggcctcacaaagtgctggaattacaagcatgagccactgtgcccttcctctattcccgtcgacgcggccgcgaatt

SEQ ID NO: 710294 - DNA, 152 bp, Homo sapiens
tggcggcacttagggagacctgcttctgcaaaatccaaaaactagctggtgcactggtggcttatgcctatctctccctgctacttgtggaggctgagacaggaggatcacttgagccaaggaggtcaaggctgcagagagctgtgatactg

SEQ ID NO: 710295 - DNA, 726 bp, Homo sapiens
tcaggtatccacaggcagcagaggtgagtgggtcccccgagctctgtgaccttatgctccacagctaactctggcagagcctccgttgtcctcatagaacaaagaacagccaccatgcgagcgtcttcctccgtcttgtgccatgggtgcttctcatgccctcaggggagcctcccttcatcgcgtccaccatcccccgggagatgaatgaatgcagagtcgaggacctccatggtaggtgccacggctgtgcccccgagcagacatgcaaggggactttatcctttgaaccgtctagcagtggccattggtcctatccggtctgacgcgcgctcagctctagaatactactcttgctttcttcccactgtgagtcatctccatgtagtcgctggtcgcagtagctcttccctgtggcggctcggtgtccacgcacaaaggatgcagtactcctggatgggcctgtggcactgaatgctccagaaaagctcagtagaaggagctgcagcacgaggcttgtgcatgcagctccgttcagcgaactgcaagcctagaccctagcagcatggcttccaggctgagcctcggtcaatgcccttttcaccgagctggtggtagacctgcaggacaccttcgtaatgtgccatgaagacgctgtacctggcagacgctttcgccaccgaagctttagggactctgcagggccatgaagcagatcatgatttg

SEQ ID NO: 710296 - DNA, 296 bp, Homo sapiens
aagcaggctgtacggcctggggtatggattcgtccggcgctggcgtctaggtctcggccctccccagcctgctcctgcgcccttggcggcccctgcgcctgcagcccttgttgctccctgcgggccccgccgaggccgcctgcgccctgtgccagctgcgcgccccgggaaccggtgcgcgccgactgcggccaccgcttctgtcgggctgtgcgtggtgctgcttcttggtgcctgatggagtgacgggcccttccctgtgcccctgatgtgcgcctgagcgacttgcttggcat

SEQ ID NO: 710297 - DNA, 104 bp, Homo sapiens
ctagaggatccccaaataaagagagtgtcttatcgctcacgagccctctctgtcagctcctgatgccatcattttctgtagcgtcttcaccttgcaaatgtcgg

SEQ ID NO: 710298 - DNA, 93 bp, Homo sapiens
ctagaagattcagcaaagtacttttgtgctcttggggaacccccctacctacgaacttactgggggatacgcagtatgaccgataaactcact

SEQ ID NO: 710299 - DNA, 992 bp, Homo sapiens
gggcgcggggggcagtgcgtgcgccgggcaggggcccggatcatatcggcgctcacgtccttgacgatgcccgatgtgttaccgaacctgccgctcatcgccatacacccgcgaatccggctgttcccgacgctttatcaagattatcgaggttagtgtaataatgaatgttggttgagtcttgcagagaagtgaaagttcgtctacgcccagccttatgtcggcgtcttatctaagagagagatgaccagcaatgagtcggatgtggtcgagatgcctgagatgaaagtctaccacatcgtgggccgtttgcccagatccatgagatgcagtgaccttgtggtgacaagtctgcgcatgatcgtcatgtggacacagaagagtccatatcagcagacagctggcggtggagcccgatggacgccggaggcggagaacaagcacaagccccgcaggaagtcaaggcggggcagaaaggaggcggaggacgagctgagcgcaggcagccggcggaggtggggatggagcccacccctgagctcccggctgaggtgctcatggtggaggtagagaaacgtgtccacgatggacttccaggtcaccggagtgagggtgaaagccctgactgcagagatcgtgcaagaccatccgggacatcattggcttgaacccctctctacagggagtcacgtgtctgcagatgatgcaaggctgtacagcgtgtggttggacaaccgccattatacctgagcgacatgggcgcccgcgctcaccgggactgggtcccagtgaagctgcagggagtcctggaagagaccaatattcctaaggcggcggacaacaggcctctcccttgtgaagcaaggaattggagctgatgcagccgcgcagcgcctggggcggatgtcgagcaaaattcaagaaaccacagtaataccgatgcggaaataagctcatcggagggactgcggaaagggcaaagaaccaaagaa

SEQ ID NO: 710300 - DNA, 81 bp, Homo sapiens
  misc_feature (68)..(68): n is a, c, g, or t
gccaccgccgagcagcagcttacagccagggcagctttgaatgcggcccaacacaaattcacaagtgntctcaaaaaactc

SEQ ID NO: 710301 - DNA, 792 bp, Homo sapiens
  misc_feature (20)..(20): n is a, c, g, or t
  misc_feature (98)..(98): n is a, c, g, or t
  misc_feature (110)..(110): n is a, c, g, or t
  misc_feature (141)..(141): n is a, c, g, or t
  misc_feature (148)..(148): n is a, c, g, or t
  misc_feature (150)..(150): n is a, c, g, or t
  misc_feature (275)..(275): n is a, c, g, or t
  misc_feature (345)..(345): n is a, c, g, or t
  misc_feature (402)..(402): n is a, c, g, or t
  misc_feature (415)..(415): n is a, c, g, or t
  misc_feature (614)..(614): n is a, c, g, or t
  misc_feature (757)..(757): n is a, c, g, or t
ccttcatatgtaaatatttnagaaaacaaatttatattcaggttcttaacttcattagggaagtaagaagttgcagctcagcgcaccatgaagttganacaaaaatgganacatccagcccacttctctggaacaggaaanatgatcngngagggaacacaggtcagtatggggacaggggtcacggtggacacgggggtgggctgtctctccacctcctcacattatgctaacaggaacgcagacacattcagatgcctttgcagaaaaaaatnccataagctcttgaagtcacaaaggagaggtgtgaagaaatcctgcatctcagtcccacacaggcagctntctcaggctttacaagcgatgagagactcatcagagccctgggcactgttgctggangcagcctgagatnttttccctccttttccacctgagctcttcctcctacacatcacaacagccaccacagctcctaggacagctaggacagccaggacagccaggccagcaacgatgcccacgatggggatggtgggctgggaagacggctcccatctcagggtgaagggctccggcagcccctcgtgctgcacatggcacgtgtatctctnctcttctccagaaggcaccatcacagctgcccacttctggaaggttccatctcctgctggcctggtctccacaagctcggtgtcctgagtttggtcctcccccatcccactgccaggtcagtgtgatctccgcaggtaagaanccagggcccagcacctcagggtggcctcatggtca

SEQ ID NO: 710302 - DNA, 100 bp, Homo sapiens
caacgatggtcctcagctgttgcctctggggctgtgcgttgccgtgcgagctacaccgaggctgtatatgagcgggaatacacaggtgagcatgctagtg

SEQ ID NO: 710303 - DNA, 105 bp, Homo sapiens
cgcggggcaagatcaagtcaagtcatcagtcaggcacatagcattgcctgtacagaggtgatagatcccgttctggtgtacgtaggtaattctttccaagcatag

SEQ ID NO: 710304 - DNA, 173 bp, Homo sapiens
gggttttgcggtctgtagcggatggggtctgtttcccagccactcggtgggcgaggaaggagaatagtttgaacccgggagggcggaggttgcagtgagccaagatcacgccgctgtactccaatctacagtctgggcaacagagtgaagccttgtctcacacaaaaaaaaaa

SEQ ID NO: 710305 - DNA, 112 bp, Homo sapiens
gctccgctcagcagcgccagctcgacgcatttctaccgcaagctctggcctgaaagtcatatagatggcacgctccggagaccaccccgccctttccgaagctggcaaaggg

SEQ ID NO: 710306 - DNA, 235 bp, Homo sapiens
agtacatagacctggcatatgagatcacacagtgcacaatcatctaactgcacatgacggccttgaaaaattccagaggttaacaatgactcaccacttcatcacgcaggcagcggaagtgtgtagaacgatttaccaggggtgtcacgtcttagacactcagaacggcaccattctagccatcttgattggatcacatgtatatacttatgtccctacgatacgacattgtgat

SEQ ID NO: 710307 - DNA, 139 bp, Homo sapiens
tccagctttcgttcctgactgcggcgggctgacctgtagtaactacaagctgaatgcagagacaacaggaacaaccctgctgttgtgactgctaattcgtttcttccaaaatctgtatttcgagcgcaacaccgggcgg

SEQ ID NO: 710308 - DNA, 107 bp, Homo sapiens
aaagcggtctgaactagtgtcgagctcagtccttagagataggggagaactgcagccagaacaagccccctactcctgaccaccctccatcagcagtctcccctacc

SEQ ID NO: 710309 - DNA, 230 bp, Homo sapiens
cggttacgcgtatcgatgggcagtgcaggcggcgcatatgcatctaggctataatatccggaaatacgtagccggtaacgtaaacaccggtcctctagaactatagctagcatgcgcaaatttaaagcgctgatatcgatcgcgcgcagatctgtcatgatgatcattgcaattggatccatatatagggccggggttataattacctcaggtcgacgtcccatggccat

SEQ ID NO: 710310 - DNA, 310 bp, Homo sapiens
caagaaggtaagctagagaaaaaaaaaatgttattaaggaagtaatatattccctattcgttaggtagaagtgaatcatcctaaaggttttcatcctcattttcacgctgagtagtttgaggagcaaaaggagttggtctttttgtcccagtggcagaggtggaagaaaatccccaaaaacgtggacctgcgcagttcaaacctgtgttgtttgggtcaactgtattgtaaaagcattttaatgtttttttcagacttttacgagtatgaatttgagctttttttgaataaacccgccggctccccatta

SEQ ID NO: 710311 - DNA, 769 bp, Homo sapiens
cgtgttcagatgtggatgatattgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatgtattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcgggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggataccacatagcgtattga

SEQ ID NO: 710312 - DNA, 884 bp, Homo sapiens
gctcctacaagaaaagtcctggaagtacctcgagaaggcagtcggtcagtcccccttacaagggagccttcggtgctaccaggtccagcacccggtcaccgagcccctacagtaggcgagcagagatctgtcagtccctatagcaggagacggtcgtccagctacgaaagaagtggctcttactagcgggcgatcgcccagtccctatggtcgaaggcggtccagctagccctttccgtgagctaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactataccactcccgtaccggggatcctctgaat

SEQ ID NO: 710313 - DNA, 153 bp, Homo sapiens
ctgcttgccttctgaagacaactccaaggactcacttccatagcaaatgctcacagtgtcactataacctaactgttgactttttaaacctcagacagtagaaagtgactgcaacgtaccaatatgtgcataccgtgaacagaaataattcct

SEQ ID NO: 710314 - DNA, 645 bp, Homo sapiens
  misc_feature (421)..(421): n is a, c, g, or t
  misc_feature (500)..(500): n is a, c, g, or t
  misc_feature (583)..(584): n is a, c, g, or t
cacggtagctcacgcctgtaatcccaccactttgggaggccgaggcgggtgtatcacgaggtcaagagatcgagaccatcctggctaacatggtgaaacccccgtctctactaaaaatacaaaaaaattagccaggcgtcgtggtggcgggcgcctgtactcccagctacttgggaggctgaggccggagaatggcgtgaacctgggaggcggagagtacagtgagccgagatcgcatcactgcactccagcccggacgacagagcaagactccgtctcaaacctggctacttggaaggctgaggtgggaggatccctggagcccaggagttggagggtgcagtgagctatcatggtgccactgcacctcagcctgggtgacagagagagaccctgtctaaaaattttttttagcccacangggagcctgcagcagtggagggcagcccttcctggcagagcccccagggaagcaccgccagaaagcgtctgtgactggngggacttctgctcccctaactcatgctgccagctcaacatcttccagacaaaggtgactgggcttgctcttagtctaactggnnatatgctccaattcttctttaagcagaccagcatggtctgaccatttctgcaagaccactg

SEQ ID NO: 710315 - DNA, 872 bp, Homo sapiens
gctcctacaagaaaagtcctggaagtacctcgagaaggcagtcggtcagtcccccttacaagggagccttcggtgctaccaggtccagcacccggtcaccgagcccctacagtaggcgagcagagatctgtcagtccctatagcaggagacggtcgtccagctacgaaagaagtggctcttactagcgggcgatcgcccagtccctatggtcgaaggcggtccagctagccctttccgtgagctaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacgtctatagcagctcagtgaactcctccttatggtcataggtggttcccgttgtcaaccaaaggagact

SEQ ID NO: 710316 - DNA, 350 bp, Homo sapiens
gaatatttctaggaaggctccaacttgtagaatagctagggtctctgcaggagctacactgtgactgcctgtagcttcttggtcctggtcctaggagagctctacctatgtgacctaagtcccttctccagcctgagggttctcatgaagtcctatcctgctgtttctagagagtctagaacacttcatcaggacggggcattgataaactgatgttattatagatgatcggttatcttacttaaagtatggttccggcaaatgcaaacacaatgtgatgtgatcctcaccactgttttctcctcacgtagcctgcatgtctgtgggttttgttttagcatggttccatc

SEQ ID NO: 710317 - DNA, 156 bp, Homo sapiens
tattagttgttcttgccttccctctttctattttctctcctgttcccttttctctccctcctctgccctctccttcctccaacatcaggcgttcccctattgtaccacacccgttacatggaaaacaactcttgtgcggatttattggctctcatg

SEQ ID NO: 710318 - DNA, 374 bp, Homo sapiens
ggtgactattttcttgtacagtgctgaaatacctagtggcaatgcctttgagactctaagggaataccaggcaattgatagttattgaacaaattaataaactaattaatgaacttttccttgcccttcaatatctttctaaagtaaccacaaaaccttgtcatctgttttacgtgggtggtaatcatgcaggtactgaaggtatgtcacagcaaggtgaagggacaattgtcatttcattcattaactccagagtagtggagtcttatttatagtttctggaagtgactaatggtaggaaagggaacccaagaggaaactagtagagtttccaggctttctatacagtgacccatcgtgtgacccatcgcgtg

SEQ ID NO: 710319 - DNA, 727 bp, Homo sapiens
  misc_feature (8)..(8): n is a, c, g, or t
  misc_feature (10)..(10): n is a, c, g, or t
  misc_feature (12)..(12): n is a, c, g, or t
  misc_feature (555)..(555): n is a, c, g, or t
ggggcgtncngnggcgcatgcgcgtgagggctgcgcggcaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaaatgaatgagaagcctttccagccagccagtgatctcttgtggacccattaccttgcattctccatccagatgtggatcacctcccaccctgagggtccccaagacttttgaacagttcttcagtgatccttacagaaagacaccctctccaaacaaacgcagcatttatatacagtccatgtggctctctaggaaacaccagaattatcaggtgaagaatatattaacatggctcacgggctactgtaaagcatatttctatggcttgagagtaaaactcctagaaccagttcctgtttctgtaacaagatgttcctttagagtcaatgagaacacacacaanctacaaattcatgcaggggacatcctgaagttcttgaaaaagaagaaacctgaagatgccttctgtgttgtgggaataacaatgatgatctttacccaagagactcgtggaatttgtctttggacaggcctcttggacagatggtgtggggaattcagttgccaggtatggc

SEQ ID NO: 710320 - DNA, 134 bp, Homo sapiens
tggtgatctagaggatcccatttccttctttatgcacagcgaaaagatagaaaaatagaagattatactaggagatcaataacccaataagggcaattctagaaagagagagaagacaataaagaaggaaaata

SEQ ID NO: 710321 - DNA, 118 bp, Homo sapiens
gttagtggctattgacactcccaccaggacagggctatctaaagacacatacgaaagtgtgtcaactatacaaaaaaagacactgtacagtttaaaaacacatctcacacagacctta

SEQ ID NO: 710322 - DNA, 274 bp, Homo sapiens
accccagaggattcagaggccaagaagaggaaaagagccaagccctttgggattgcctgataaaaagttcctgatactttctgttctccagtgttttccctttctccccttctttttggtcccatatatgcctaaatgcacagtcatgtgcctacgtcctgcctcccaattagggagcatgtacccccggtacatcccttaacttcggcaccagtttgactttttgctgtttccgctttaaggttgttgtgtttttgtttttgattatgttgct

SEQ ID NO: 710323 - DNA, 259 bp, Homo sapiens
tttttccccccccggggggggtggcccttttcgcccccttgccccccgggggtgtgggccctttggccccccccccccccgggggcccagggggggggggggggccccccctgggggggggggggttcccccccctttccccccccccccgggggttcccccccccccgcgtgcgcctttgcccccctggggggggggggggccctggggcccccccccccttttttccccccccaaaacacccccttttcgcccccca

SEQ ID NO: 710324 - DNA, 937 bp, Homo sapiens
ccttgcatgttgaagttctgtatagctggggcttccaacaaaaaccacagtcactgacagagggaacagcagagaccttgttggtatcaggctgtgatggatatacagaatcagaggcaccttgcttttcacaatctaggataaatacgtagtctgactgggtacctttaccattccgtatttaggagggagtcctggctccatgagcccctcccgagtggactgtccacgcagtataggctacacacgagataaacatgctgcacgtgctgacatagcggcgcggggctcatgcgaacgtagccgcggtaaggcgagcatccaacgtggcggaacgattgccacgtgtgacactgctctgtgccattgccattttcaccaacagtttagattcgttgggttagattccaccaagaacttaaggttaacgagctaccacatttgtctcggaaccaggtagtcgatagcgattgcgcacacggcatagcgacccttcctttcattgggaactaagggcacttgagccaagctatagcaacatagcgacccccaaatacacttgcgaggatatacacccattaatgttacccttcggccatcgagggctgcccccaactacggtgcccgccaatactatcgggcggcggcgcgacttcgcaggaaacacgccgcagacaggccctatgggccgatggcacattggacgcttggccttttcggcccaacccccctttggggcggcccatttgggaaaccaatcgggcacggccggaccacgcccctcgagaaacccgcaccaaacgagccggatatggctcacccacaaccctccgcaaaattatcccctccttgggcttaacgagacccttttgactgcttcggatttcggcgtggtaggcgacatccataggataaacaccctatgctcacttaacgg

SEQ ID NO: 710325 - DNA, 1850 bp, Homo sapiens
  misc_feature (445)..(445): n is a, c, g, or t
  misc_feature (719)..(719): n is a, c, g, or t
gtccggctcatgctgacactggttgccgaggggcggctggaagatctagtggacaaatatgatcattgaggtctgaccgctttgaggaccttgcctcgcgtctattctcaagtgacatttccgatggtactgcgaaagcatcggggacatgtgagtagaatacggatgcgatagcaatgcaatgtcttcacgtctagtgacaattggtcactgtgcatccactcgactgagccctggcaggtgtcactagactgtgagctcaatcgaggcaacgtctcgatccccaccaagcacctatgcgcagtgccggcaaagtcctacaacaaagtagcgttaacgaatacgaatgccgtgtgggatcatatatgccgcgcataggggttgtagtcgaaaacgacgtagccacaatgaaaaccatcggcacactcgttgtatcagcatgagnttcaaattgcaacaccctcccgggaaaaagtaagcgatgtgattggatcatacgtggatagcttgggccagaaacaaggcctggttctcgaatattgtcctcgcgtcctcaacggcctcaaagaagcccaacgacgccacgggagaccgtcacgtatgaaactaggtgtcttttggatttcgccgtgggcaaggtgtacccatgggaaaaggcttgagcttataagcccgtgcggcactacgcgtgaacaaatctgcgattacttcgttggcantgcgatcgcttcacccaagggataaccctggcatgtcttcgcattttgggaggcattagttcaatggtttggttccctgttcccctgacactattggaagcgtgtctcaattgcgaccaattgaaaagccttcgccctttctgaacacgcttattcggttctccaaggttctcaccttaggaacccaggaacaaggaggaccgaaaattgagtgcgccccggggtcggttcgaatatgtaaaacagttaggttcgcacacctgggagactttgtggaccttccctcggagtatggccccgaaggattgggcccccacaaaggaaaatgtgtccccattcgattattccatatggggcggggacacacaaaggggtggcgcgctttaagcgggacacgcacccaatggataagcttcgctttgaaaaatgattcaggcaggtcacacggagagccccaagaaggggcacccccaaattttctcccgggaaaaccaggggcccctagggagaaaccattttccgagaaagtgggtcgttcccaccaaagttggaaaacggggcccgtgtgggaacgcaactgacgtggggagtaccaccatatgagcaaatgttaagcgcctctgtatgagaggagcaacacagaggcgaggagagccacactatacaaacactctctggcggcaaagggaggaacacctcggataatcaccagggggagagagcccagtcatagacccgaggtgggtgatgcacgccaactcgtacgagacacagtgtgtgagggggaggagcccaccacaccaatatagaagaaagagagggaggtccccacacaaagcgggggagaagaacacaaacacgagctgggaggcaccacacaacacctgtgacggcgacgcacacagcgggagtgttgctaaccccagccagacgctgctgaagagagacgcgcctaaataaaacaacgcaaggacaggaagagaaaaaacacacccgggcgacatagcatttactcgcgagcaagaacgacaacagcgaccaacgagaagagaacagacgagattagcgagtacgagaaagaaccacaagaccgcgtggacgaaccgacacaaaccgaacgaattacaagac

SEQ ID NO: 710326 - DNA, 353 bp, Homo sapiens
agctcgcacccccaccggcaggttgtactcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacaacctgccggtggggg

SEQ ID NO: 710327 - DNA, 117 bp, Homo sapiens
  misc_feature (84)..(85): n is a, c, g, or t
gttttcaagttatttattaagttcttcattggaaggttttttttatatctggttcactaccaccatttttttgtttcctactanntcagtggtgttcatttgaaaagaaattagaag

SEQ ID NO: 710328 - DNA, 596 bp, Homo sapiens
ttacgacgttggacctagtccatatgaccagcttgcagctatggtacttactgcttctatccgagcatcactctccagtacctcagactcttatacaagcatgcattcctatctggacctcagtaactaggactcagctgccccatttatctaggtaagtcccctgcacctatgagtatgcctgggtcatacttcagccctaagcctgaatggatagtctgcaagacagccatagccccttgacatctaggatccctgctcacaactaaggcagaagcttgctcagctaatgtctgagcctgttataactcatgttacacctctccagtcccatctcgcaaccatctctacctcatactcatccccagacactggctcagattctacagcatgccaagttccttcccaccctctgaagcctcctctggtactacatcgtggagaacgctttcctcctccattgttagctcctcctccagatcttcagttaaatgagggctcccatactacatgggccctatccatacgtacttagggtatcgaaaccctatttacgcatacgataaaacctaagaatccaatggacataatggctc

SEQ ID NO: 710329 - DNA, 394 bp, Homo sapiens
  misc_feature (13)..(13): n is a, c, g, or t
  misc_feature (259)..(259): n is a, c, g, or t
agctaactgttanatctctctcctgggcctgacagtttcagaatgctaaggcaagcaggagttgaatccagtgtcaagaggattacagagttctcatacattgctggtgggaatgtaaaatggtgccgctgtttaggaaagcagtccagcagtttctcaaaatgctaaacatagaattacacagtaactctgagtaacatcccacttcaaggattgaaagagaattgaaagcatatgtctacacaaaaacgtgtacatnaatgcccataggagcattattcataatagccaaaaagtggaaacaacctaaatgcccatcgatggacaaatggataaacaaaatgtggtatatgcatatgatggaatattattcagccaaacattcaagccgtca

SEQ ID NO: 710330 - DNA, 392 bp, Homo sapiens
gagttctttgctaatggcccgggtgttgcttgccagttggcctggtgttgctttctgctgtgacatggtaacactgagttccagtgcaaagtcccacaatcactgtgctccccctcccccaagcacacagattctttgcaccacacggccactgcatgggggtggaaggggtagtagacaatcgaaaactgtctttcctactctcttcagtgtctctttcagcaatatgaagttaaaatcaggtactgtgatcacttacctgatttttggttcttgtgaaggtgctttttttgtgtagatagttgttaaatttggtgttcctgtggtgggggcagcgattggttgaggcttctattcagccatcttgcttcatctccctccaatagattaaa

SEQ ID NO: 710331 - DNA, 116 bp, Homo sapiens
ccgatttgcgcacgcgcttgtacggcaggaggtacaaataggcctccatctcggctccagcccacactgtagatcgtgtctgggtgcacctctgggcccagggcaagcggccgcaa

SEQ ID NO: 710332 - DNA, 1083 bp, Homo sapiens
ggtcgttctgccttctgccatgggatgacacagcaagaagccccttgctagatgtgcgggctctcgatcttggacttcttagtcttgcagaactaggagccattgaagagtactgttgtcctatcccagaaggagcaaagcggatagagactgatatcctgacgcacgtaaccatccagcaccacttaaagccattgctctcctcttgggtctttcctggtacgcatcatacaagccgcacagatggaggactcgtgcacttgcttgtgctcgtctgcctggagctctagtggcgtccagagtagactccgtgcgcaacgtccgttcgccttgtccaaggttaccgttcatgtaacatgtcagcttaccactgtgtgccgtactttgtgccctacgctagaattggcagaggaccgtcgtcaccaggtgggctcccagttctccttaacttaatgccacttttagttctcatagatagagccacatatttatgctgattatatcataatcgtgacggtatgactcctagtattatcacttatggtgtgtatagcttactggaatgatgcggttcacgacgggtgtaagccccatgagaccaagagatcttgggactgtcgattcacctgatttatgccaatgttggagcaacaatggccggcgcataggtgacggttgaaaaattcccaagatgcggaatgaacatgctctttttgcccaaagtttgtgaccctgaaggaatgggactctaatggggggggaaagttttgtcggaaacgcaacatgtggtgtagaccaatttaaacggggaaaaaatggctacggcaaaagcggggggaagaacaacgcacatataaaaataaaggaggcgcccaaacgtggggagaaaggtcacaaagaggggctgttaccaccagcacgacagtagtgaagtgaaagaggcgtgtcaacaaatgagtaggtcacaacaagaaagagcagatactattatcaaaaagacggacggagtgtctttttctgtgtcttcttcgttgttcttgtgtcttttgtcgtgaagaagagaaaaaaagcaaagaagaggca

SEQ ID NO: 710333 - DNA, 409 bp, Homo sapiens
  misc_feature (10)..(10): n is a, c, g, or t
  misc_feature (73)..(73): n is a, c, g, or t
  misc_feature (76)..(76): n is a, c, g, or t
  misc_feature (87)..(87): n is a, c, g, or t
  misc_feature (90)..(90): n is a, c, g, or t
  misc_feature (94)..(94): n is a, c, g, or t
  misc_feature (101)..(101): n is a, c, g, or t
  misc_feature (108)..(108): n is a, c, g, or t
  misc_feature (116)..(117): n is a, c, g, or t
  misc_feature (123)..(123): n is a, c, g, or t
  misc_feature (141)..(141): n is a, c, g, or t
  misc_feature (237)..(237): n is a, c, g, or t
  misc_feature (262)..(262): n is a, c, g, or t
  misc_feature (273)..(274): n is a, c, g, or t
  misc_feature (398)..(398): n is a, c, g, or t
gtcaggaggnccccctcaagtttaaatccccacacttacttacttactgctcatccgtcactttctctaagtnagnttaataattcnttntctngtccatnccgcacngcttgggnncgcagnggcccaggcctcatgtantttcccactcccgtaactgaacgtgctgacccatgttgatgtctgccttcatccaggtggcaaatcagacatgctacgctgcccccttcaaacganttcctcgtgttaggggcaaaggtcncagccaaactnnaccactgacagccagtgccttggcctggatcctctctgtggatgcaggcctacccctcctcagtccagcctcatctactagaccagcttggccattcacttttcagatgtctgtgagcagaggnctgcagactga

SEQ ID NO: 710334 - DNA, 132 bp, Homo sapiens
ttactctacacaagatatttttgtcaccaagaccctggcttctatgctctcctggtacttatgaattcgaacagcatacccccgattccgctgcaaaccattatcgcgaaaaccagccgcgcaaaccaggta

SEQ ID NO: 710335 - DNA, 358 bp, Homo sapiens
tcttgtttcctgcacttccacacacacccctagaggatattctgagaaaagaggaggcaaggggtggcagtgacttgtgatgaagagggttgcggttggagaccagaagggcctgaaagcagctgggtgcggtggctcacgcctgtaatcccaacactctgggaggccgagacaggcagatcacttgaggtcaggagttggagaccagcttgggcaacatgacgaaacccatctccaccaaaattacaaaaaaattagtctggcgtggtggcacgcgcctgtagtcccagctatttgggggaggatcccagctaaggtgggaggatcacttgagcctgggaagtcaaggctgcagtga

SEQ ID NO: 710336 - DNA, 145 bp, Homo sapiens
gtaacgttgcggatctcaccgacctaaagttaatgaagggtatgtacttggaaactgtgaaagtctttaaagaatatccggaataattttactgtgaacattagttctgatgacttagatatttgaatatgtcaggtctacctgg

SEQ ID NO: 710337 - DNA, 135 bp, Homo sapiens
  misc_feature (99)..(99): n is a, c, g, or t
tagagttcagctgagtaagccactgtggagccttaagtggtgaggtcttccaatttcagagtgatgggtcttcaactggattcatcatttaagcgaaanaacataaatttaattttggtgaaatgagattcatct

SEQ ID NO: 710338 - DNA, 235 bp, Homo sapiens
agcagtgtccgtattttcccctgggctagtcatactgactgtgctgtgacaggggatgcgactgtaggaggacctggggttgttgctataccttcacatcagcaggcacccgaggtcatctgacagcctggtggaatctctgagggactcgctccagccctcagcccatgcccaagagggaggtgtataaagagccaagcaaatggagtggagaaagaggacagccagagcctcc

SEQ ID NO: 710339 - DNA, 463 bp, Homo sapiens
acacctccctcggcctcccaacgtgttgggatgacaggcgtgagccatcacacctggccatgtaatactttttaaaatgtggattggtacagttacttagtcttcataataagataacattttattttgctgtcatgtagtaggttggagatattctattctgctccatgaagtaatacagggatccacttgtcatggttgtacaatttcacacttcagtctgtggggaggagaaggaggaaattcaggacagtttgccattgaggaggtgagcaggaagttctgctatttcttttactcacattgcatcattggtgagaacttagtgacacggctatgcctacctataagggaggctgggaaatggagcctatgtgactgattgtatgctcaggaagaacatgagaatagatgttttgggagacaactagtagtatgggttttcggcgtgtgcagggtaccg

SEQ ID NO: 710340 - DNA, 1268 bp, Homo sapiens
gggacaaagcgcggctgatttggaggattatcagtatcacgatttgcaggattcccttctgggacttcattctggaaacttttgtaagggctgcttattcttaagtgcccacatttgatggagggtggctgtcatgcagcagctgtgactgatgtgctggtttagagggtgtctcccgagaggacccagaaattcaggaacgttccctgtgaaattacgttgccccgtgtgtgagtggtctccatggcaacttgagagccagaccacggcatgggagtaggagagcagcaggaaggcaactacgtgggcagggcagcaggacccccacgaacacacaatccaaccatatacccccacaggacacatgaaggctcccaagacaaatcttgacagaacggagaccccacagaacagaacaaacaccacaatcagaagaacacgacagagaaaaagccacaacgacaagcggagaagagaacagcagcccgaccccagacaaaaacaccaaacacaacacacaaagggagacaacaaacagcaggcagcagggcagccaccaccacacaagcagcccagcaagccgagagacagaagagcaagacaccaagcaaacgccgcgccagacgcacacggcgcagcacacagacaggacaaaggaaacaaggccacacaacagcaaccaacaacacgcacaccgagggcacacagagcacaacagaaacccacacgcacgcccgcaagaacagaaaaaaagacagaacaacaagagcagagaacacgcacacgacgccggagaagcgaaacacgaacacacaacaacaccacaccgacaccaaaaacaaaaaccacacacaagcaacaacaaggaacgacccgaccgacagacgcacgaaggaaaacgggaagaacgaaggaaagaaaaaaagaaacacagggcaacaaagcaagaaaaggacaaacacgaaaacgacagaaaggggaggagcggacggagggaacaagaagaaaaagacaacgaggcaagcagcggaaaaacaggaaacaggaagaagcaagagggaaagacaagcgacgcgaccagcggaggcaaccaggcagcgagaaaggcgcgggcaacgagagggccaaacgcgccacgacgagcgcaacgggaggagagcagcacgcaacagaaaacagagacccaaacacaccccgccgccagcaggcaaaacgctgaccgcacaccccaacggaaagaggagaccacgcagcgaccggagccaaac

SEQ ID NO: 710341 - DNA, 205 bp, Homo sapiens
tttcttgccaacgatcgaaagcgcttctactgagtggcgcctccggtggggcttgtccctgggccctggagccaatgtgaactttttttttaccggggattataaaatgaacaacaatgatgacctatatttctataactggtttcaacataaattgattaaatgtatttatcatcacattttgtgcttccttgccccatgtatg

SEQ ID NO: 710342 - DNA, 857 bp, Homo sapiens
gtcaaccgggccacagacgcggcgtcaggagagagagcggggagaggtgactgcacactgccgcgtccattctcttgaattcccacaaagactgttattgctggggctcataaaattatactccaaagtatggggctggggcatccagagtgctttgaactaaaggagactgaaggccccagaagccaagtttccctctgaccttctcctgccttcctgtcttccaccccctacttttcccctgaagtgagtcctggaaaccagaattcttcttgcccaaagcaagccggggcgccctggaaatatcactctaaccttccttgcctttccgtgtggcagctggccatgaagaaattctctgacctaccttgtttgatagcagatcacaagaccctgggtccagagcggtcttgctttacaccgagggaaaggaatggcattcagaaaggccaagaagaatctgaacaggtgtccaatcacctttggacggggctgcccattcttcattgaacctaagcattaaaatagaccggtggccctggggatttggggcttcatttctgaagactccatggccatggaaacttccgataaatgactggctcctgagaaaaaaaaaacaacggccccgtgggccttagcggaggagctctcgggccagtaccctttacggaggggtaccccatgagcctcagtaactgactcgttgcggtccggccgtgcggcggggggaagcggcctcaagctcactcacagggggcaataacggcgctccacatacctacggcgtacaccccggggaaaacatgggagccaacggcccgcaatagggcacgagccatacaaggcgcgcgttg

SEQ ID NO: 710343 - DNA, 1157 bp, Homo sapiens
ctccgggaccatcttctcggccatctcctgcttctggcgtagcctgaccagcgaccgtttaagtgtgttagctccttctgtgccaagcctagccatgagactcccatgattctgtcagagatttgattcgcaccgtacgatgtaggcgagccgtctaaccaggtctggtcagatttgtagcctgcagggcctccttacaccgtacctctctctgggcttctattgtcgaccgcgatcgatgtagtgctctggtacaggcagatgagccacatatttcttgtaccgcgtacattagggcgctgccacgtgagatcgcgggcgaagtgggactttcaccagaaggcgttactcctcgagcatggtagtgctaaaaaagccactaggtcggttgggctggggtcaggcgcccttctgcgttgccccggagtaccattcaagaaaagtcgcaagctggatatgactagacggtggggggcctaatggagcccctcaagtaaccagacacacctaggaagacggcgtggcactattgaggcccccactgggtaaggaacacctaaaagcgctttgattaatcgcaaggagtccccccttgttagagcgcagtacgttatccaatggccacccctgggcgctttcggtagcccccggcgaaccagggcacacgcatccaattcattcgtagatgaaacttttcccggtggagtaggcatcggtccaacggtttccccataaagaacctcgaaaggagaaaaagggtagatagatcgcatttaacatccacatgcgtacacggcaaataggtggggtttagtatcacgcaacccagttggaaggcctaatatacacacggtgcaccaaacgcacggggcccctggcgcgtatggtgaaccaccgcgggtagagagcgtagtggccgttgtgcagtacggaatgggtattcactgcatgtgcggcatcaaggggtcctcgacacgtcttcaactatgaacaccgcggaactgtaatgacaagacccgttccgtggaaggcccccaaacggaaccctattcgttggaaaagagcggcacgcgtgtttcacaataggctactaaactatgcgtggaatttccgttgtccgcgttacacgcatggcctggcgattcacgcatgccaag

SEQ ID NO: 710344 - DNA, 1296 bp, Homo sapiens
cctagaggcaagaacggcacgtgctcatcaagcatactgctgacaacagaatgcatcttccccagagaaacgccaacgggctagacactactggtgcctctgtatgccacctgcaaaagcagcaacgtttctacaacaagtactgaggagcaacgagctggacgacagagtatgacaacatgcagcaagaaggctggctgcgacgcactgccgcgacacacaagaactgacacgacatctcaacgaaaaccttgcctcctggcctaggcaaatagaggacaaccatgatgcaacgaaaatcaagctggacgccagggctcaaccaaagaactcaagattgagccgtatcccagcttttcccgccaccagcaactgaaccccgaaaattcaaaatccaaacaattccgtaaaagaaacccaagggcagggaacacttattaaaggggaacacgtgaaaacccttataacgacttcgcttgaaaaggcgtaacgtgaaaaaaaaggccaagatcccgtatccaattctatcccagtggtccccccagaaggagtgggactttacaaggggggaactggcttacccaagtgtgggtagtaacaggcccccattaatcaaaccgccattgtttcccccataaggggcaaacagcgcacatacaaggaaacaccacttttctggcacgtggaacaagcccaaggcatttgtccgttaacccacttacttgtttggcccccactatttgggccaaaccaagagcaaaaagggctttggaccaacgcaaccctgtccccaatttacacaacccggaaaaccccccccagttaaagagcaaggcaacataattccaacttacctggcaaaggggaaaggcccgaaaaggaaaaacgcggacatttgcgcacttacattataaacaccccctctgggattataacacccactattcccgaaagacaactccgtttatcaatgcgtggaaagccgaaaaggaaattcatcggccaacggaaaggaaacccccccaagcgaaggaaacgattccccggggtaaaccgtggtgcaaagagcgcccagaagaagaaacccggtaggtcacaccgggggcacctgtggagtgaaccccttgtgcaaacaaaagggataacaaaggcgcaggcaaagccctagtgacaagcgggccatttgcaatgaggtcaaacccctcccggaaaggaaaccacatatgtgcccacccccgacatattaacccaccagaattttcccgataccaggcacaacgggtttgaaaacccttg

SEQ ID NO: 710345 - DNA, 467 bp, Homo sapiens
  misc_feature (3)..(3): n is a, c, g, or t
  misc_feature (5)..(5): n is a, c, g, or t
ggntncccttgtctctaccagaaaatgaaaggaattgaaattaagagaaggaagagattgaagtatgtgagcaagattggaaggagaaagaggttgagggttagtgagggaggttggagaagagagaaaaacaggccacttaccagatttgaaattggtgagatgttccttgggctggtcagtctgaggacctgaggtcgtaggtggatctttctcacggagcaaagagcaggaggacaggttattgatttcccaagggaggtcccccaatccgagtcatggcatcaaattttacgtgcgtctgtgtgaagagaccaacaaaaaggctttgtgtgagcaacaaggctgtttatttcacctgggtgcaggcgggctgagtctgaaaagagaatcagtgaagggagatggggtggggtcgttttataagatttaggtaggtaaaggaaaattacagacaaagggaaaca

SEQ ID NO: 710346 - DNA, 84 bp, Homo sapiens
aggtgatctagaggatccctgatatgctgttcaacaaaaaagaaaaaaagaaaagaaaattaaaatttgtttgtttttaaattt

SEQ ID NO: 710347 - DNA, 157 bp, Homo sapiens
actaaaatgggagtgaggaataggaggagtgtgtgtataaacttgtatagttatatgttgtgttaggaagtgagggtgacagtttgtacatgaagagtacccatttgtttcagtcatgtgtgtgattgtttggctcttgccttgtggttaagactgt

SEQ ID NO: 710348 - DNA, 268 bp, Homo sapiens
cctctggtggatgtggagcgtgctttttagtcccaggtagttaggaggctgaggtgggaggattgcttgtcgctgggaaggtcaagactccagtgagctgtaatccgcgccactgcactccagcctggacaacagagcgagaccctgtcttcaaaaaaaaaaaaaaaggtgattttttttccctttgttttttaaaaaatatacaattgacagattcaatctggggaaactgggattagattcgcccccaggcattatacaggtacaa

SEQ ID NO: 710349 - DNA, 222 bp, Homo sapiens
ggccttgacgcactgacgtggggatgcgtgagttcctcaacgtatcggctagtgggctcccaggaggacttggcatcatggggtcatgagtattttaggcatctggcaggagaagtggctacggagtgtcagagagctggatgacgcaaagaaggtccagcgggagcctctgttcactctggtgacatggcacacatcgtcccctcataacagggccctgag

SEQ ID NO: 710350 - DNA, 524 bp, Homo sapiens
agagatagaaagaggggaccctgacgggcgggcgcgcggccaagcctttctgctgtaggtctgtgtggaaagtggacaggacgctcacccgcctgtattccctgcttctgaccctgctcgggtaccaataccaacgggacaggagctgaccacactccggtagccactactgcataaagctgtcccctcctgtgaccagctgaggacctcaggctgtagcgtggccatgcccagatacacggtgcacgtacgtggcgtatggatggcaatggccgtgcaggacgcgcaggtcaatgtggacatgctgggcacggatgcctataggcgctatatcaagaataagctctgcaacagccgatatacctttcggggtgactcgcactttcatgtgccgcggagcaaaggcatgggcctttggtcaactaggaccgagtattgatggcctatcacccagttcggcgatttgtaatgacggtgatgcaggggtactgcttcatacatctgaccggggggttcttatcggg

SEQ ID NO: 710351 - DNA, 148 bp, Homo sapiens
ctcaggcaggacaatctgtaggaattctacatcttgcctccagtgtgcatatttagatgaatgatgtcaattgccagctccctcataaaggccatcctcagagtttctctcgcgtatggctagaagtcacaatcttcccatagcaggc

SEQ ID NO: 710352 - DNA, 247 bp, Homo sapiens
tccacctccagcacgcgacttctcaggacgacgaatcttctcaatgggggggcggctgagctccaggcaccccgcagtcactttctatgtaacaacttcctttgatgacatcgtaacctgacacagtgtttatgacgtgtacatacatatacttattacctcattcagttattcttcgaaacaaagccctgtggaagaaattgggaagcttgaagaagcatcaaagtcattctgttaagctgcttca

SEQ ID NO: 710353 - DNA, 160 bp, Homo sapiens
tagtacaactctttctctttttccttcagacagagtcttgctctgtcacccaggctgcattgcaatggtgctatctcggttcactgcaacctttgcctcccaggttcaagcaatttctcctgcctcagcctccgtgacttgctgaattattctccagggt

SEQ ID NO: 710354 - DNA, 776 bp, Homo sapiens
tgtgtgtgtgtgtgtgtgtgtgtgtgtgtgtgtgtatatatatatgcatcaccagagaaataaaattataagaaaaatacacagcaggcgtggggccgagggtgtggtctcgatgcggtgtgaatcctacacattggaggaagagagccggaggcgggtggtgcgtcgcgcctggatgctcgaagggagttcagagaccagctgctggccacaatgaggtggatgaaagtagccgtgctctactaaaaactacaaaaattgaagctggcgcggtgggtggtatatacccattacgtccccgagaatacctgcggaggaggagcgtgggcggcggaggaagaacaatcaacgaagcaagcccgccggggagcgagcggagagaggcggcagcgacgatctgacgtgccgactgagtgcggccggccaacgtggcagactgaacgacgccgtgtggatcgacgacgaagtagcacgaccttcctcccgaggtcggtcttcagagagagagtccaacggtcggcaggcccgcgaggggcggctgtccgagggcacataagaagggtggggcaccaaccaattaagggggagaacctcctatccttcctacacacaaataatatttctaccaagaaacttcttattcattctcacttcaataactccttcactactacagacagcgacaaaaaccacaacggttggccgccgaataaattactatttggcggcgggacggacgaccagagtatcctcccctatggttgccccagggtgtg

SEQ ID NO: 710355 - DNA, 104 bp, Homo sapiens
ccccaccagtttcgcccacgtcacctcgtcgaacttgtccaccgccaccggcatcggcgcgcagaacaccggcatcaccgtcggcgccggcaacctcatcccgc

SEQ ID NO: 710356 - DNA, 379 bp, Homo sapiens
  misc_feature (62)..(62): n is a, c, g, or t
acccggaagccggccgcggagagagagaggaagaagggagggagggacgcctacaggagtgngggaaaggcaacaggaaaaggagggagggttcgctgcgaaccgacaataactgtgacaccacaggcatgtgcggagtccccgcccccccaggcactgtgccaaggccagcacctacatggcatgagaccctctcagcaactctgtaaccttgtccccaccagaacattccttgcacagctgagaaaacaacagcacagagaggatgaattaaaaattggccaacacgctgggcgcagtggctcacgcctggaatcccagcactttgtgaagatgaggcaggcggaacacaaggtcaagagagcaagaccatcccggc

SEQ ID NO: 710357 - DNA, 446 bp, Homo sapiens
tactccttttttttaggcatgtgtagtgtatagcagacagattgtaagaatatataataattgatctattcccacttaataaatttttttagttgtttccattttcaattacagaaaattctccaataatgaacttgtatatatttgccattttctacatgtgaagtctatgtgtctgaaggataaagtcccaaaagtgggattgctaggtaaaaggacataagcatttgtaataatgatggatattgccaaattacttactatgaaaattatagctacttatactccctcaggagcaatatgtctatttcctcacgatattgccaactgagtcttatctaacttttgatgtttgccagtctgatagatgaaaaatgtgtcctctaagtataatgtactattcttattatgagtgagttgaacatcttttgaatatgtcaaagcca

SEQ ID NO: 710358 - DNA, 281 bp, Homo sapiens
ataaacgactaagttatactaaaatctgtatgactcacaataatccatatgaaaggtctgtattctactatgtggcactcttgtggatccctatagtaatagtcaccgataacttttggttctgtgtcatgtaccaccgttagatgagcagcaggttatgagcttaaactcacctttccagggtcctataggtgataacgataagaatccaaaactgatagaatctagtactctactaacagcattactgataattagtgcaacatcaagcttgccataca

SEQ ID NO: 710359 - DNA, 1682 bp, Homo sapiens
  misc_feature (252)..(252): n is a, c, g, or t
  misc_feature (258)..(258): n is a, c, g, or t
atcatgaggtcaggagttcaaggagcagccctagccaacgatggtgaagaccgccgctgctctaggtaaaaagataactaacaccagattcaggctgggtctggatgggcgatgcggcctgtgatatcccagctgagctcgggcaggttgaggacaggagcacatcgcttgaagatccaggcggatacgaggttgcagctgcagccaagatcgcgccactgcagtccagtgctcagacaatgaggagtcgangacgtngtgcgtcaaaagaagagaacacaaaagacaaaaaagtaggcatgccctagattcctagaaacttacccgcgataagatgtctattgtgcaatacggtgtcggccatattagagggaactagatcatcgagacgaggggattctagagccatcctaggtggtctttgcgtgaaccaatatgagcgctgtgcgcggtggcgatcggcgtgggagggaggcgatcgcgcgatgtatgcttgctatggggccgattggatcccacgcatatgagatccacaacgagagagtccgagataaggaacgagggacaataatggcactgggggcattaataacgctcctcgcaagataggggtatacaagcgggcgctcataggggcgcccatagttccctgttgtgtccataggcggccactgtctctgattggctttgggtcgcaccgataccataagggggcccatactagggctgcgggctacccccccgtggggcaataagagtgaacatcggcagggtgctgaccaagcaccgggggggtccaaacgctgtatgaagggttgaaaccccacttcttggggaggaacgtgcccgtgattgtgttctgttcccccacaaaaatgtgccccctgggcctgaaacatttcttgggggaccactgggagcggggggacaggaaaaaacggggatttcggcaccctagtgttttgcatccccaagggattcgctaacactcggaaatagggagcgcaaagaaacacaacaaagcgaggaatatcgagaggcggaccccgaataacaggaggaaccagcgaagaaggcgggccgagagcaacaaacgcggggcggaatgggaagacgacacatagtgtaccccccacgtccgtattaggtgtaaaaccaaggacacacatgattcgacgaacagagaggagaatagagacgaccttatacaacagggagaagagaagagcccacaaaaggagcgacccaaaagagaccaggagcaaagagccgacgtagcgggagaaaaacaagaacaacccgagcggagcagagagcagccaagccaaacagcacacacaaaaaaagagaggtagacaccccacaagacaagagaggggcacgaacaaaaacacaccaaaaaagagaggaggcggagcagagaaacacacaaaagggaggacgacacaaaagagcaacgagtagaagaacagagggaaccacatcgacgacaaaacaaacaaagcagctaccgaccgacacacactcagaccaacagcgccacaaccactagcgcacaagcacaagaggaagagccgagcgactacacacaaccaggcgaacaaagagaagactagacacggtgactaggaagcaaacggaggacactaacaaaacgaccacaaccagaatagcagatagga

SEQ ID NO: 710360 - DNA, 105 bp, Homo sapiens
gaagatgacccagatcatgttatgagagcttcaactgtgccctgccatgtactgttgccatccaggcctgtgctgtccctctacgcctccggcaggatcacctgg

SEQ ID NO: 710361 - DNA, 121 bp, Homo sapiens
ggttacatgcgtgcatggaggtcgacgtgtatacacctactgcgatgctatgcctccctgtacaagtccggtcgacacgtgagcaccgtgctgacctccaaatatcgtaaagctggagcct

SEQ ID NO: 710362 - DNA, 408 bp, Homo sapiens
gctatgctcaacgcgttgcggagctctccatataggtcgacctgcaggcggcgcgaattcactagtgattgggagctgagatcgcacctggcacctacgtgtaactagtttgaggaagcagtaaactgtattccacagtggctacattgtatttatattcttgcagcggtatactaaggttcccatttctccaaaccctcaccaacactttttgtatactgatgatagccatcctaatttgtgtagagtaaggtacagcatctcatttgttttgattttgcatttccctattgagtagtcatagctgagcatctttttacatgcttattgaccatttgtatacattcactggagaaatgtctattcaaatactttgcctggtaattttatttatattttttttttttc

SEQ ID NO: 710363 - DNA, 441 bp, Homo sapiens
gtaatcttggtcaagatatctaatccccagattccatctgctcatctgttaaaactaaatggttttcctgggaactctgactctggccacaagatcaagactgacaaatttcctttctctgtttatggagggagacttcacaacattcactgaaagaggagcaaaggacctggtttttgccatgactggctttggccccgtccatgaatgcccctatggcggtggaaaggggatagccaaaagagcagaaccacaaatggggtattatgacaagtgttcaatgaaggaaacaaaatctagggcacgatccaacataggacaccatctcagcatgttatgtcatttgcccacccaagtaaagcatttcttagagttatctggcacattggcaactaagagctttttgtgaataaagcctgtggccaccacgttaactgtaaa

SEQ ID NO: 710364 - DNA, 341 bp, Homo sapiens
gacgtcgagaccatcctggctaacacagtgaaactccgtctgtactaaaaatacaaaaaattagccgggtgtggtggcaggtgcatgtagtcccagctactcaggaggctgaggcaggagaatggcgtgaacctggggggcggcttgcagtgagccgagatcgcaccactgcactccagcctgggcgacagagcgacactccgtctcaaaaaaaaaaaaaaaaaaaagttttccttattctctttcataattttatgaggagaatatgcacttatggatattcactcacggatcaatccttccagatgagcctgttaattttgattatgcacattgtcgac

SEQ ID NO: 710365 - DNA, 771 bp, Homo sapiens
  misc_feature (41)..(41): n is a, c, g, or t
  misc_feature (52)..(52): n is a, c, g, or t
  misc_feature (75)..(75): n is a, c, g, or t
  misc_feature (107)..(107): n is a, c, g, or t
  misc_feature (161)..(161): n is a, c, g, or t
  misc_feature (166)..(166): n is a, c, g, or t
  misc_feature (171)..(172): n is a, c, g, or t
  misc_feature (174)..(174): n is a, c, g, or t
  misc_feature (189)..(189): n is a, c, g, or t
  misc_feature (195)..(195): n is a, c, g, or t
  misc_feature (463)..(463): n is a, c, g, or t
  misc_feature (466)..(466): n is a, c, g, or t
  misc_feature (482)..(482): n is a, c, g, or t
  misc_feature (499)..(499): n is a, c, g, or t
  misc_feature (510)..(510): n is a, c, g, or t
  misc_feature (523)..(523): n is a, c, g, or t
  misc_feature (544)..(544): n is a, c, g, or t
  misc_feature (550)..(551): n is a, c, g, or t
  misc_feature (554)..(554): n is a, c, g, or t
  misc_feature (558)..(558): n is a, c, g, or t
  misc_feature (560)..(560): n is a, c, g, or t
  misc_feature (572)..(572): n is a, c, g, or t
  misc_feature (584)..(584): n is a, c, g, or t
  misc_feature (591)..(591): n is a, c, g, or t
  misc_feature (599)..(599): n is a, c, g, or t
  misc_feature (604)..(604): n is a, c, g, or t
  misc_feature (621)..(621): n is a, c, g, or t
  misc_feature (633)..(633): n is a, c, g, or t
  misc_feature (644)..(644): n is a, c, g, or t
  misc_feature (646)..(647): n is a, c, g, or t
  misc_feature (669)..(669): n is a, c, g, or t
agcggacagaagtccactcattcttggcaggatggcttctnatcgtctgctnctcctctgccttgctggactggnatttgtgtctgaggctggccctacgggcaccngtgaatccaagtgtcctctgatggtcaaagttctagatgctgtccgaggcagtnctgcnatcanngnggccgtgcatgtgtncagaanggctgctgatgacacctgggggagcccattttggctcttggggaaaaacccagttggaagtctgggagagcttggcattggggctccacaaacttggaagggaggaacatttggttagaacagggcattattcccaaaggttgggaaataagaacacccaaaattctttacctgggaaaaggcccctttgggcattcttccccatttcccatggacgcaatggagaagggtgggtgatttcacaaggccaaacgactcccggggcccncgncgctacaccattgccngcctgctgagcccctantcctattccancacggctgtcgtnaccaatcccaaggaatgaggnacttcnnctncagngnacctgaaggacnagggatgggatntcatgtnaccaagantattncatttttactaatgcantgttttcacctnatatgctatgntnnaagtccaggcagagacaataanacattcctgtgaaaggcactattcattgcggacaacgagctgtgccgtcaaaggcagtggaagcagaggccacgctgagagccataacataactcggggtgg

SEQ ID NO: 710366 - DNA, 983 bp, Homo sapiens
  misc_feature (177)..(177): n is a, c, g, or t
  misc_feature (181)..(181): n is a, c, g, or t
  misc_feature (195)..(195): n is a, c, g, or t
  misc_feature (215)..(215): n is a, c, g, or t
  misc_feature (276)..(276): n is a, c, g, or t
  misc_feature (281)..(281): n is a, c, g, or t
  misc_feature (284)..(284): n is a, c, g, or t
ggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgcngcgntcctcagccaccgntccctcttcccacggatgtngatctttcgtggtggaaagctaaattttaaaaccaccccaatggatgcagacagtgatgtngcatnggncattctaattacaaatgtagtctgtgtattatcagaacaagatgtcatttaacacttaaggacgattgcttcggacaggagcacatgtacttgataaccgtgatgtaggaaaagtattcaatgacagcttagacaaacctaggaacttacagctacaatttggtcctcaggaacacacttcatttgcactggagcaacaatgtgaagaaagaaagcctaaacttgggtgccgagacgcttatgcccgtaagtcgtgcagaaacgtaggttatcaggtcactatctaccagattctaagggaggtaaacagttctggcagtggtgtaaacatgccatttggaactcccgtttgccagacatttcacaaaagaaacaactagacctccatggccagtttaacggaaccctgaactttcattcctaactgtgtgctacatcgggatcaaacttcttctaaagaggcttacattacgaggacttattctaccaacacagggaaacgtatttcacagggatacaaaggggtcccaaatgttcaaaccgctgttggctaatggatgattggacaccgaattgccccacatcatggaggagtcggacacgcatccgcacagcaagttgcaataaaatcccgaataaaagtggaaacaaaaactcgtaaactgaccaccttgtagcacactggattgcacattggct

SEQ ID NO: 710367 - DNA, 706 bp, Homo sapiens
  misc_feature (41)..(41): n is a, c, g, or t
  misc_feature (52)..(52): n is a, c, g, or t
  misc_feature (75)..(75): n is a, c, g, or t
  misc_feature (107)..(107): n is a, c, g, or t
  misc_feature (161)..(161): n is a, c, g, or t
  misc_feature (166)..(166): n is a, c, g, or t
  misc_feature (171)..(172): n is a, c, g, or t
  misc_feature (174)..(174): n is a, c, g, or t
  misc_feature (189)..(189): n is a, c, g, or t
  misc_feature (195)..(195): n is a, c, g, or t
  misc_feature (398)..(398): n is a, c, g, or t
  misc_feature (401)..(401): n is a, c, g, or t
  misc_feature (417)..(417): n is a, c, g, or t
  misc_feature (434)..(434): n is a, c, g, or t
  misc_feature (445)..(445): n is a, c, g, or t
  misc_feature (458)..(458): n is a, c, g, or t
  misc_feature (479)..(479): n is a, c, g, or t
  misc_feature (485)..(486): n is a, c, g, or t
  misc_feature (489)..(489): n is a, c, g, or t
  misc_feature (493)..(493): n is a, c, g, or t
  misc_feature (495)..(495): n is a, c, g, or t
  misc_feature (507)..(507): n is a, c, g, or t
  misc_feature (519)..(519): n is a, c, g, or t
  misc_feature (526)..(526): n is a, c, g, or t
  misc_feature (534)..(534): n is a, c, g, or t
  misc_feature (539)..(539): n is a, c, g, or t
  misc_feature (556)..(556): n is a, c, g, or t
  misc_feature (568)..(568): n is a, c, g, or t
  misc_feature (579)..(579): n is a, c, g, or t
  misc_feature (581)..(582): n is a, c, g, or t
  misc_feature (604)..(604): n is a, c, g, or t
agcggacagaagtccactcattcttggcaggatggcttctnatcgtctgctnctcctctgccttgctggactggnatttgtgtctgaggctggccctacgggcaccngtgaatccaagtgtcctctgatggtcaaagttctagatgctgtccgaggcagtnctgcnatcanngnggccgtgcatgtgtncagaanggctgctgatgacacctgggagccatttgcctctgggaataaccagtgagtctggagagctgcatggtctcacaactgacgaggaatatggagaacggatatacaaagtggaaatagacaccaaatcttactggaaggcactggccatcttccgattccatgagcatgcagaggtggtattcacagtcaacgactccggcccncgncgctacaccattgccngcctgctgagcccctantcctattccancacggctgtcgtnaccaatcccaaggaatgaggnacttcnnctncagngnacctgaaggacnagggatgggatntcatgtnaccaagantattncatttttactaatgcantgttttcacctnatatgctatgntnnaagtccaggcagagacaataanacattcctgtgaaaggcactattcattgcggacaacgagctgtgccgtcaaaggcagtggaagcagaggccacgctgagagccataacataactcggggtgg

SEQ ID NO: 710368 - DNA, 139 bp, Homo sapiens
gcctagaagcacctgaatcacacttttccctcatctcctttccagcgttccaatccacatgactgccttattcccaaaccctgggacccaaggcacattcacaaaacggagagccaggcattgggattacttaagataa

SEQ ID NO: 710369 - DNA, 516 bp, Homo sapiens
  misc_feature (254)..(254): n is a, c, g, or t
  misc_feature (256)..(256): n is a, c, g, or t
  misc_feature (259)..(259): n is a, c, g, or t
  misc_feature (262)..(262): n is a, c, g, or t
  misc_feature (266)..(266): n is a, c, g, or t
  misc_feature (269)..(269): n is a, c, g, or t
  misc_feature (271)..(272): n is a, c, g, or t
  misc_feature (277)..(277): n is a, c, g, or t
  misc_feature (280)..(280): n is a, c, g, or t
  misc_feature (283)..(284): n is a, c, g, or t
  misc_feature (289)..(289): n is a, c, g, or t
  misc_feature (292)..(292): n is a, c, g, or t
  misc_feature (296)..(296): n is a, c, g, or t
  misc_feature (313)..(313): n is a, c, g, or t
  misc_feature (319)..(320): n is a, c, g, or t
  misc_feature (337)..(337): n is a, c, g, or t
  misc_feature (347)..(347): n is a, c, g, or t
gctcgacgtgaaccagacactgtctgcaatcccggcacctccggagccgaggctggcggatcactcgcggttaggagctggaggccagcccggccaacacagcgaaaccccgtctccaccaaaaaaatacgaaaaccagtcaggcgtggcggcgcgcgctgcactcgcaggcactcagcaggctgaggcaggagaatcaggcagggaggttgcagtgagccgagatggcagcagtacagtccagcttcggctcngnatnagngggngangnnggtgnggnagnngaggnagngggngagggaagtccaggatnttcttnngtggtgatgaaaatgtnttcgaactanatagaggtgggtataacattatgaattaactaaataccccgaattgtgaactttagaaataattgaattttatatttggtgaatctcacctcaattaaaaagaaaaattagaaaacggccaggcatggtggctcatgccggtaattgcagcgcttgggaacgccacggt

SEQ ID NO: 710370 - DNA, 515 bp, Homo sapiens
cacgcctgtagtcccagcactttcggaggccgaggcgggtggatcacaaggtcaggagatcgagaccatcctggctaacacagtgaaaccctatctctactaaaaatattctttaaaaaattagctgggtgtggtggcaggtgcctgtggtcccagctactcgggaggctgaggcaggagagtggtgtgaacccgggaggcagagcttgcagtgagccaagatcaagtcactgcactccagcctgggcgacagagcgagactccatctcaaaaaaaaaaaaaaaaaaaaaaaaaaaaaaaagaaatgtaagaactggaagaaaattcaggaggcatttttaaaaataatttttaagtggaaaagatatttctaagcaagacacaaaactcagaagcccgaaaaggaaagactgatgaagttgagtacatgttcatttgtggagaacaaacatacagttaaaaaaacaaaactgggccgagagttattcatgcctgtaatcccagcaatttgggag

SEQ ID NO: 710371 - DNA, 166 bp, Homo sapiens
aaagaaatacaggaatccaaattggaaaggaagaagtgaaattactcattatttgcagatgacatgatactatacctagagaaccctaaagactctaccagaaaactgttagagctcatcaatgaatttgacaaattcacaggatacaaaattaatatacagaaat

SEQ ID NO: 710372 - DNA, 446 bp, Homo sapiens
  misc_feature (232)..(232): n is a, c, g, or t
  misc_feature (276)..(276): n is a, c, g, or t
  misc_feature (329)..(329): n is a, c, g, or t
  misc_feature (431)..(431): n is a, c, g, or t
gatctagagatggagtctcacactgtagcccaagctggagtgtagtctggtcactgcaacctccacctcccaggttcaagcgaattctcctgcctcagactcacgagtagctgggactacaggcacgtgccaccacacctggctaattttggtacttttggtagagacaggttttcaccatgttggccaggctggtcttgaactcctgaccttgtgatccacctgcctcggnttcccaaagtgctaggattaccggtgtgagccagcactcccggncttcctagaccagaatttatgcgggctcttctaagcccatttctcaactaggncccaagaatgccagacgtgaatagcccaatgttagcaaagtcctgcttatcagtttagtgagaaccctccaagctattatacatctgatcaaattcctcatntcccccgattccatc

SEQ ID NO: 710373 - DNA, 103 bp, Homo sapiens
gtatcgtttttatggtttgctgggcgcctgggtggtactgctcaactttagttccaatatggcaggttgggtgggtgggggcttgaatctggccctcatcatc

SEQ ID NO: 710374 - DNA, 223 bp, Homo sapiens
tgttcagctcggacccagatttctccttcaaacccaggtttcttacctagtataaatttccttaaaatgtgactatttcttcactataccctgataaaacaaaaaaggaatcataccaacagttcatattctgactctgcaccttagaatatgtgaggcagacaagtcattccatttattcaggctgatttcctaatattataaaaatgagggtaaagttaga

SEQ ID NO: 710375 - DNA, 878 bp, Homo sapiens
  misc_feature (581)..(581): n is a, c, g, or t
gtatggaaacagtgataggcagtgctgtatacaatatactctgaaaagtagtgggggtcaccaaagaatattttaacaagaatatagaagcgtcttcaaggaacatctttaagtgtagtactcttgaggaacatgattataaatgataatcatgtctgataatcaatttttatccagtccttaactatgtaaaagccgtatcagtagaaataactgtgctggtgtcgtgtctaacagatggtctaaattacttatggaattatatctttggagaccaacttgtatgcaggcagagtttgccgtcgtacgagcttggaaccagaagaaaacttcactctagatttcaggtcctaacaggcgtatgtctctacattttgccaggggtaaagtgacttcagagatacagcagtggatgtctgtgtatctagtagaatattgtgctagcgatctaagaaaacgtggatttgagccttcaaattgggccgtttctcaagttgtctagttgaccttagtacaattgacgtgtccactggctttccttttgttatgcccatactgaggaacttaaactacagctctanaatgtctgtggttcaagattctggatgcttatatactactattaagaagtaggaaccccctcaaatagtaggggagaccaggtaatattggaattacatggttttttatgcaggatttggtgccaccggtgaattgatcaggaaatcgatacaaccagtgggacaccgctccgtctgttgttcactaattcgcgtaaagtgtgaaaggctgacgcagggaacgcttgttgaaggggtggaaagcggtgaaatttaaaacttggtgacagggggattggtgcccagtttgagaggtct

SEQ ID NO: 710376 - DNA, 161 bp, Homo sapiens
cgatgcacgcggcgccaccgatggcgtcgtcgtcagagtctgaggatgactcgagaggtgagacaaagggaggacccggtaggttggaacttccagcatttggtgtggagtcagtgatttccagacaaatttccaacagattactaacgaagaacggaaaa

SEQ ID NO: 710377 - DNA, 383 bp, Homo sapiens
atgcacatcccccattctggtccagtgtccatccattgcagaggggcctgcaggatgctgaaggagctcagagccagagcacaacggggggacctggactcacagagaggcaggacaccttttgtatatctgactgtctaggcgaaagagatcaagatgaatagcaccatgcaaacaagttcgtcagtgccaccattgccacctgagtattgggtgctcaagtgagaacaggggactatgaggaaaggtggggaagcagtaggagaagtgagtggtagaggcaaaccgaaatagggcccacccaggacggaacagctgggtttctcaaacctatagcacgagtgacatctatgagccccgatcaatatccgtctatgcaacga

SEQ ID NO: 710378 - DNA, 1457 bp, Homo sapiens
  misc_feature (828)..(828): n is a, c, g, or t
gtcggcaggttgtctccgcgactgcctccggtgctgtgggtggcggaccgggggtgagacccttctaggaggtgtctgtctggtcactgtccgctaggtcgacttttttgtggagaatgaggttgagagtgctgggttctactatagaccctcttcctgttgtatagtaccgcccacgactgtgctggggtgtgtagtacatgtgtttttcatgctggggggttaccacagcggcggcgctttcctcgcgtgggttgcacaccggggggggtctcataataagttgcgtctcgtcgcgagaacgtgcgtgtgtcagcgtgtgggccacagaccaaggggggcgcaccgacgggggcctaccgttcactatattggggggccgcccagcggggtccactcagttgcctcccctgtggaggcccacctggtggtgttgcctcctcaccgggtctgcgtgcgtatggtcctcttttgtaacgctcggtctgcaggggttgggttcccgctggcggaagattggtccccctgctcctccgcggcgttcttgttaggtgtgggcagtgtgccccccgactttgtggagctgcgcctggtgattgttgtcagccccgcgtggttgctcccgcctcgcactttagacgggcgtctcgtcaagctgcctggggagttgttttgtcgcagccaaccgacggggttattcattttcccggcgcgtaatttttttctcgcgctgcgttgttctgggttgtgagcacacacgcggggggcacacagccccgcatgtcatggcggggcctgtgtttataatagtggggccccctcttgttncgactcgcagggtcagcacacttgtgcccacgacatcgcttcggcggtcacgcccccatttgtgccgagccacgcaccgactcgtggtgcccgctcttcgcttggtttgtttgcaaggtcccccacccttgtgggtggatacataaagggcttccggtcgcacgagctgcctgccccacatggtgtcctgttgtccccggtggagagatgtgttggttgccttggtcgtccttgtgggggaggaccaccccccaccctcccgtcgctccactgtgggcaccacgatccccagcacccagcgcgggggattgttctccaccgcccccccgtggcgaccagcaccaccacgaccccaccacattctggggcttgggggcaccccttcacgtgcttggcctcccaattccggcctctctgggccccggacgtggctgtcgtcctcgtcacccctccgtcggttcttgcctggcaccttttgcccgccttccctcgcggggttgagacccggaggcccgttcacgagatggaccctcggcccgatcgtgttggccccccccccatttttgcgcttacaatccccccttctcccccattttctccttcccactaaagccctttgataacaccca

SEQ ID NO: 710379 - DNA, 150 bp, Homo sapiens
ggctcagtgatctcgcttcttaattctcatgtctggattgattcagaaaacttctgagtgagcttcagacggtagtcacgaaaatgacagattgacaaaatgatgatgtcacaggtccatgaagtccagatgaagcctgctcaagtccaa

SEQ ID NO: 710380 - DNA, 435 bp, Homo sapiens
ggttcgtatctagcaggatacccaaagactgaaagcaaagactaaaataagatgatcaaaaaagaacaactacacgactatccgagaactgcggaaaactaaaaaaggtgtactaaacacactaatgggtaataccagaagacagaaaggaatagaacaaaaatttgaagctctaatgactgagaatatccccaatttaatgtcagacaccaaaccacacattcaggaaggtcagcgaacaccaatcagagactgagtgtgaattggctcacagccaatccaagactggtgtgattagactccttatgcaaataaatgtcctggaatgaaccactcattggccagagtgcaggtctggcccatggtcaatcagaggctgatgtggtttgataccttatgcaaattaaggtcctggaatggaccactcacaggcca

SEQ ID NO: 710381 - DNA, 216 bp, Homo sapiens
cttcccccacaggagtccactcactttctacctaggcccagtcatgtgtgctccttttctgatcccagagccatgccctgataattgaggggtttgtacgttttgattcatgttctatttactcacatgaatgtacttaaaatatgaagaattccatctgaattctgagataccttccagcctgggccgaagagagcctcaggttgactgcagccc

SEQ ID NO: 710382 - DNA, 468 bp, Homo sapiens
cgccgctgggtgggttcgcaggagcagccagttgaccatgagaacgctcgtgtaggcggccgacagcagtaagatcgcgcagcccacaccgaagattcctaccagcggcgcactgctgaaggcagtaatcgaattgaccagttgccccactttctttcccagcgtgtaggtcgtctcgtcacgactgcgcttgacgatggcctgcgcacgctgatcgaagccagtgatgacccacagacccgccatgaacaactcgcgttcgtcgtgctgaatcaacgcgtccacgtagcggcgcgacatcagcctggcgacgacgatattgtcgggcatatccagcccgctgaggaaacggaagagtttgtagaacacctgcccggtccagcgcttgaagtgcttgccttttcgctgctgctggacaccatagaccacatcggccctttcgcgctccatttgctcgctggtcgacgc

SEQ ID NO: 710383 - DNA, 257 bp, Homo sapiens
  misc_feature (5)..(5): n is a, c, g, or t
cgtantggcagcacccaggcagtctgtgtatgaggcatagcccctggacacacattcacacagacacacacactacctggatagcatgtatgcacacacactgcgcgcaacacgtgcatcaccatgaaaagtgccacacgtacgcacacacgcacatgcacagatatgccgcctgggcacacagtataagcatgcccaaatatgcacgcacacgcacagagacatgccagaacatacaaggacatgctgttttgaac

SEQ ID NO: 710384 - DNA, 107 bp, Homo sapiens
gacatggtacaccgtctcacttatccaactgaccggcatttataaatctgtacaggtctttgtagaaaggttataccacgcgctgaatagcgttcaacgttatcccc

SEQ ID NO: 710385 - DNA, 1169 bp, Homo sapiens
ggtgaacgcggagcagcacgccactgaaggcctcgagcacgctaaggatgagtagcaaggtagtgtgtgtcgctgccctagcaccactccaccaaatagccatcacgtccgcccctactagcctgcatgcgcaatgctgttagacgcctaagtacattgtacagtacgactccaatgtctctctgccctgtctgtgcgtgcactatctagctcaatactaacgacgtatctaaagaagcaagacgtattgcatacgaagacggttacttataacctagcggacgccacgcatatgtgtactcgactaggtaaggagtcccatgcggtcaggtgccttcaagaaaacaatacatcgtacaccaccacaccccttagaccccgagcggcttacgcaggcgtgaacaacccttcacctgcgctgagcacttaacataatagaagacatatacgcactctccgtttacctaaagcaactcataacctccaccccagcttgcggcgaccacaagtggaccacaacacacacacacgacaacaccacctagctcatggtctacaccccacaaggagagcaggagacacactgcaacacacaccgggcaggcgagcaaccgcaccccttctaggcagcgcgcaccaacgtcgctccagtgcagaaccagacgagcaggcccgcggtccaacacggaatgaccaaaaaccactcccatacggactcgggacccctttaactaccgcaggtaagggccaaaccgccacagtattggcagccgcgatctgcggcccgcccctaggcacgtccccagactcgcgagtgagaccgacccatcagggggacagagcgtacacagcccaaacaacacatcacccccaaaaccgaccatcagaacggccacaacccatccacacacgttggcaaaacaccggacggcactcggcaaagcaccacagcgcgccaacagcacacagatccagcgcaacggagagaaaccaaaaagtaggcacaagaaacgggcataggaccccgcaaggcgatcaacccaaggtagcaccgctcggcagagccaaaactgtggaccgctacaagccacaacactcctcaacctagccgagacagaagccgacaacatccgcggacaacaacacacacaatccgcaccaacaaaccc

SEQ ID NO: 710386 - DNA, 452 bp, Homo sapiens
ctaccgcacagccggccaggtgaaggaagaggcactgtgctcctcagagcagtcggagaaggggggaggcggaggcgtggaggtggtttgtgtatcttactggtctgaagggaccaagtgtgtttgttgatgtttgtatcttgtaattctgatcggagcatcactactgacctgttgtaggcagctatcttacagacgcatgaatgtaagagtaggaagggggtgggttttagggatcacttgggatctatgacacttgaaaaattacacctggcagctgtgttaaagccttccccccatcgttgtaacttgcagagtttgagctgccaggggaggggctgagagggtgggggttgcaaccccttccccgggaggagtgccattcttgggtcttccatcttagaacttgtttacatgaagataagatactcacttgtcatgaacacaccatg

SEQ ID NO: 710387 - DNA, 198 bp, Homo sapiens
tacactgctttgctggtatcctctcttaggcacctggtggtccccgctacctggagtcaccatattagatgccgagcttagtgcggacacccgatcggcatagcgcactacagcccagaactcctgggctcaagcgatcctcccacctcagcctacccgagtagctgggactacagtgcacgcgccaccgcgcccggc

SEQ ID NO: 710388 - DNA, 264 bp, Homo sapiens
  misc_feature (97)..(97): n is a, c, g, or t
  misc_feature (198)..(198): n is a, c, g, or t
ttagagggtggttttaagtttaagaggtgttacatatccattgcctttgaatcattggagtagggcagaggatttaagtagtttaaaatgggctttnggttttataggtgaataaagttttttaattagtttctttagccaaaagtggatgagtttggcaattgatttttaagtatattatagtaagaaatggctaantggtttgtttcatttcataaacaaactttgcatttagataactattaaaggttgttaagatgaaga

SEQ ID NO: 710389 - DNA, 215 bp, Homo sapiens
ggacagcccccaccccatggctgtcaggggtgggggcagtagtgtctccttcacccctgacagcccccaccccgatggcttccatcgtttagcatcaccgaccactccttgaacccccattatctgatttgtcagaattgttttttgtaacaagaagctaaaaatgaaacacatgtgtctgtggtatctataagaaaaaaaaacaacaaaacaaa

SEQ ID NO: 710390 - DNA, 367 bp, Homo sapiens
  misc_feature (57)..(57): n is a, c, g, or t
  misc_feature (82)..(83): n is a, c, g, or t
  misc_feature (102)..(102): n is a, c, g, or t
  misc_feature (117)..(117): n is a, c, g, or t
  misc_feature (137)..(137): n is a, c, g, or t
  misc_feature (179)..(180): n is a, c, g, or t
  misc_feature (197)..(197): n is a, c, g, or t
  misc_feature (205)..(205): n is a, c, g, or t
  misc_feature (241)..(241): n is a, c, g, or t
  misc_feature (270)..(270): n is a, c, g, or t
cccccccgttccggcccaagggttaaagacggggccccccccccccttccggcccangggtgattttgggggcccccccccnntccgcccaggggtgattcnggggcccccccccgngacccccacgggtgattcanagccgcccccgtccgcccacgggtgaatccggggcccccccnntgccccccacgggtgantttgaggntgcccctgtgccccccacagatgactccaaggaagntcagatgcctgcagtcattaggttttagngtcccatgagccttggtatcaaaaggccacaagagtgggaccccaggggctcccctcccattttgagcttttcctgaataaagcctcatacccctga

SEQ ID NO: 710391 - DNA, 2846 bp, Homo sapiens
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctggaatttaaagttgggtgcaggttttagaaagctgttgctgttaacaataattctcccggccatctccactccactactcaaaaatgcctgaatccttgctcagaggagcaaaggtatcttctcgtccctttcttacagccattttcttgcttttccacaaagatattatttaaagtggaatatttttgtaactgggataccaatgagcttttcggtcttttcctgacttggtaaggtttatgggtttctaaatctaataactacagtcataccaccctga

SEQ ID NO: 710392 - DNA, 315 bp, Homo sapiens
aaaaaatggggccccccctttttaaatttaaggttttgccctcaaaaaccactcccgggggttttttaaaaagggggggtctttcgcccccaaataaaatgaaaaaaaaattttaaaatggggtttgtttttccttttccaaaaccggggaataggggagggggggggtgaaaaaaagtttttccctttttcaaggggaaaaggtccacttttctttttggtccctttataacaaaaatcccggaggaaacaggttgggtttgtggcccctttgggagggggtccaggaggggaaaaaaacccccttttttttga

SEQ ID NO: 710393 - DNA, 868 bp, Homo sapiens
  misc_feature (6)..(6): n is a, c, g, or t
  misc_feature (13)..(13): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (24)..(25): n is a, c, g, or t
ggctgntacgacngnganttnggnntcggggcgctggcgggcggggcggggtctgtagttagcggcgagagtgacaggaggacaggggttgtttcggcagtgacgcctggggagtgacgcaattgcacccctgtgcagtgatgtcacggcaggcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttt

SEQ ID NO: 710394 - DNA, 671 bp, Homo sapiens
  misc_feature (509)..(509): n is a, c, g, or t
  misc_feature (671)..(671): n is a, c, g, or t
tatcctgaaaactggaggtgccttcaaggctctcatcgctgctcagtacagcggggtctcaggtccgcgtgctctcgcagaacatcccagcttccattatcggctcatagagccagagcgtcacccctagaagtttcgtcctgcaaatttgccgtagccgagcaggaggtcccgagcatttagagaggtgatgataggacttctcgtgatagttttgaggaggcaaaacagactcgaatgtgcgcgttatcgtagatgagttgtagggcaataattgggacagggaagacttgggccgagggagaataggtataactttctcaagaatggtgtcacggtctaggcacctaggaggtggggttgacatggtgggggctagaggcatttttgctagaagtgtcacgagtgataagtggtcacgcctctaaggccaaggttttaacctccaattaggtggcgggggattgggggggttttatttcccgcgcccgccctaccgagaaaaagcnccccggttttactctcgggggcggggggggcacccaaagatttttccaaaagtttgggtgccaaacctcgaacgaaattcgaaaaaactagagacgcaacgtgtaggcaagttgccaacaagtgagggaaagctcgaggggctgaagttctgggagctgctn

SEQ ID NO: 710395 - DNA, 5806 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaaaaaaa

SEQ ID NO: 710396 - DNA, 4938 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaaaaaaa

SEQ ID NO: 710397 - DNA, 232 bp, Homo sapiens
gagctatctcattaataatttttattttgataagatgttgaagtgatattttggataatgctaacattttaggcgaaataaaactaatttcacctgtttctttgtaaccttttttttttttttgagatggagtctccctctgtcgcccaggctggagtgcagtggcgctacctcggctcactgcaagctctgcctaccgggttcacgccattcccccttctgtcgtcttctc

SEQ ID NO: 710398 - DNA, 187 bp, Homo sapiens
acggcccccggaaccattgcatcgtgtgtgtgcggtgtgtgcctgtgtgtgcgtgtgcagtgcatttgtgtgctgtgtgctcgtgtgtgtgctgtgtgtgcgtgtgtgactgtgcgtttgtgtgtgctgtgcgttggtgtgtgtgctgtgtgtgcctgtgtgtgcgtgtgtgtgtggggtaccgcgc

SEQ ID NO: 710399 - DNA, 3978 bp, Homo sapiens
  misc_feature (6)..(6): n is a, c, g, or t
  misc_feature (13)..(13): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (24)..(25): n is a, c, g, or t
  misc_feature (386)..(386): n is a, c, g, or t
  misc_feature (429)..(429): n is a, c, g, or t
ggctgntacgacngnganttnggnntcggggcgctggcgggcggggcggggtctgtagttagcggcgagagtgacaggaggacaggggttgtttcggcagtgacgcctggggagtgacgcaattgcacccctgtgcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatncactgtaaactgtgaaagccatcagtgtagtggaaggagcatnaatttagagtagagagacatggttttggaccctggttcctgctttccttgtttcatctgtgctgccttagaaaattgtcatgagcccgggcgcggtggctccggcctataatctcagcactttgggaggccgaggctggaggatcccctgaggtcaggagtttgagaccagcctggccaacatggtgaaaccccgcctctactaaaaatacaaaaatttgccaggcgtgatggcaggtgcctgtaatcccagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaaaaaaa

SEQ ID NO: 710400 - DNA, 542 bp, Homo sapiens
gggctgcgttccgagggtcccggatgtgcggtctcaaagcaaacaaggaataataagataaatgagctttgaaaagtaggaactaatttaacttaaatcacctctatgaaaacttaaaatattcactagaaagaactcttgggaaaaggaatgggctatgtttgtatgtggtggtttgaataagtcaacagaattgaagtctgttatataaatatataggaacaagagaaattttcacattaatataaattaagaagatactgttattcacaaactgggtaagtgtatttagactcttccctagtatctaattcataataaaataattaagctttactttacagtcactttggtgtattgcttccttgtctgtaaggtgagggtgttgaactacatgatctctacaatctttttctaatttttaacattctcatattattctgagactatcccatgaaaatctttccagtcaagtaaatggctataaagactctggatataggttaataaattatataaagtttatcgctagaatagtaatt

SEQ ID NO: 710401 - DNA, 5719 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaaaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaaaaaaa

SEQ ID NO: 710402 - DNA, 5585 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaatccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaaaaaaa

SEQ ID NO: 710403 - DNA, 371 bp, Homo sapiens
  misc_feature (154)..(154): n is a, c, g, or t
  misc_feature (163)..(163): n is a, c, g, or t
  misc_feature (305)..(305): n is a, c, g, or t
gatgattttgtatctttttctatttattgagataatcaaatgatttttgtccttcgttctattgatgtgatgtttattgatcatgtttattgatttgcatatggtgagccatccttgtattcctggtataaatgccacctgatcatggtatatnatctttttnatgtgctattggatttggtttgccagtattttgttgagaattttttcatctgtgtctattacggatattggcctgtagttttttttgctgtgttcttctttggttttgatatcaggataatgctagctttgtagaatgagtnagggaggagttatctactcttcaatttttgggaacagttgcagaactgttgtgtgttttagaacag

SEQ ID NO: 710404 - DNA, 4890 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccaacgcgggagacttaaggggaaaggctcagacttcttctggcaacgcccccccttgccacgc

SEQ ID NO: 710405 - DNA, 1271 bp, Homo sapiens
gatgttgatatggtgtgtgcgtcattcatccgcgaggacagtctgatgtccatgaagttaggaaggtcctgggagagaagggaaagaacatcaatgattgatacagcaaaatcgagaatcatgagggggttcggaggtatgatgaaatcctggaggccagtgatgggatcatggtggctcgatggtgatctaggcattgagattcctgacagagaacggtcttccttgctcatgaagatgatgattggacggtgcaatcgagctgggaagcctgatcatctgtgctactctagatgcatggagagcatgatcaagaagccccgaccccgacatcgaggactgacggcatgtgatgtggccaagtgcatgtcctggatggagccagactggaatcatgctgtcatggagaaacagccaaaggggacgtatcctctgggaggctgtgctgcatgtcacgcagctgattgcccgggaggcagaggctgacatctaccatgttgcacattctagagaggaacatccgccgacctggcgcccgattaccaatgcgacctccagcagaagccacacgacagatgaggatggccagagggaaggacctccagttacaaggctagcatagcaggatgagggaacaataagtcgaacactcgagcaaacgttcttgagacagagacatagcgtcaagaaccagcgtgaaacaagaataacgctgcaccagcagatgcaccccgcgaaacacatacgcgattcgcgtgcaccgcagggaacaaatcaacgcgccaagcacacaagacgtaccagctcacaggaggacaaccaagacctaggacacacagtaacggagaattcaaagcacccgtggccagactagatgcaacgtggacaccgacagagcacaagagggaagtggacattaggagcacgcgaacgacgacccggatgggcgagaacacacacaccggggagacaacggaaaaaccagatagaggacccaaaaccgccaacaactgcgaacaaagagagaaagaacagggcgcccacagcgcaaggcgcactcaccatttcgcaacaaggaaagctaggcgaccagaaaactactggtagacacaaacacgagggaagaaacaagaacccagggcgacagtaggacggacacacagtgaggcagcaccagccgacataggcaaaacgcacagacgcgagcaagttcgcacgcgggacggacaagcaccagagacacgacaagcgtagaacgtgcgagccaccaa

SEQ ID NO: 710406 - DNA, 5371 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccgggaggcagagattgctttgaggcgagattgcaccactgcactgcaacctggggcgtcagagcgagactttgtctcccccgcgcccaaaaaaaaaaaaaaagaaatttcatgaagtcgttttctcaacgttaaattaccgtgtaccactttcgggatttttgcctaatggcagtactgcttgaacttttgattactagatgtgtttttttgtatagctatgtcccatttaaaaattaaattaatttccttgaaacaaaatccttatggtgaatgggaagccagtgtcacttgccacaaatggcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaaaaaaa

SEQ ID NO: 710407 - DNA, 3543 bp, Homo sapiens
  misc_feature (6)..(6): n is a, c, g, or t
  misc_feature (13)..(13): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (24)..(25): n is a, c, g, or t
  misc_feature (386)..(386): n is a, c, g, or t
  misc_feature (429)..(429): n is a, c, g, or t
ggctgntacgacngnganttnggnntcggggcgctggcgggcggggcggggtctgtagttagcggcgagagtgacaggaggacaggggttgtttcggcagtgacgcctggggagtgacgcaattgcacccctgtgcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatncactgtaaactgtgaaagccatcagtgtagtggaaggagcatnaatttagagtagagagacatggttttggaccctggttcctgctttccttgtttcatctgtgctgccttagaaaattgtcatgagcccgggcgcggtggctccggcctataatctcagcactttgggaggccgaggctggaggatcccctgaggtcaggagtttgagaccagcctggccaacatggtgaaaccccgcctctactaaaaatacaaaaatttgccaggcgtgatggcaggtgcctgtaatcccagctactcaggaggctgaggcaggagaattgcttgaacccgggaggcagagattgctttgaggcgagattgcaccactgcactgcaacctggggcgtcagagcgagactttgtctcccccgcgcccaaaaaaaaaaaaaaagaaatttcatgaagtcgttttctcaacgttaaattaccgtgtaccactttcgggatttttgcctaatggcagtactgcttgaacttttgattactagatgtgtttttttgtatagctatgtcccatttaaaaattaaattaatttccttgaaacaaaatccttatggtgaatgggaagccagtgtcacttgccacaaatggcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaaaaaaa

SEQ ID NO: 710408 - DNA, 384 bp, Homo sapiens
ggactcccgcactcagggcgagtctgtctctttcttaatacttcccagtagggtctctgtctggcatgatatgaggacttgaagctcggttgggttgtgttagcctcaggggacccttatccgctcttagccctggacccgattcttctagaagcctggagggaactgagaactttccaagtggaggtcgcatgaggcgaggtccctgtatggtgggatgtcacactgtcttgttcgtcccttgctctgaagggggtgcccttggtcggaatcagtgtctgggtgctgcgaatgccgatctcacccgctccgcagggtgttcagcctgcctgcagggggccagtctggtcctcctgggatatggcacggaccctgcagctcgcc

SEQ ID NO: 710409 - DNA, 182 bp, Homo sapiens
ctgggcgcggtggctcacgctcatgtttcctcagcacttcgggcaggccaagcgggacagatcacgacggtcaggagatcgagaccatccttggctaatacggtgaaatcccgtctcttactacgtattcaaccaaattggcccgcgcatcgcggcaggcgcctgtcttcccagctgctccg

SEQ ID NO: 710410 - DNA, 398 bp, Homo sapiens
taaaattccctaaacccaaaagggattttaaacccctggggtatggagtcctgatggggaaaccaaaacttttttgccctattttaggatagattaaaaatttggggaaatttggatatgcccttagccactttaaaaatttctttgccggtcccggttaagttttaaaattatttttttaacttcctaatttttgaggagggtggattttgggaaaccgccaattggaattggaagttaatttggaccccattggggggaaaatggggaaaaattttaaaaggcttgtttttttaaccggattgtaaaaccttttccggggtggggttttttaaacgaaaggggatttttgccaaaggtttactatttggaagccattaatttttgttaacccttta

SEQ ID NO: 710411 - DNA, 197 bp, Homo sapiens
ttatcatcagatgacattgaggacgtctctgcccggacctcagatcgtgtgtccagaccttaccctgccaaacagagctgtacgtggcacagtgcacgcagcgtgccgtgcgaaatatgtcttacctgctggacggtccgagcggctgggcgagcagaacttccacaagggccggtgcttcgtggagcatgtgacgc

SEQ ID NO: 710412 - DNA, 284 bp, Homo sapiens
aacgatggtaatattaatttgtttgaactgaggccccccactgattttttgacaaattgaatttttatatttaaaaaattttatgggaatgttccctcataatttttaaatcctttataaatcaagggagcctttaatttgtatatgtttcaggacaaagagattttattgcctctgggaagctgtttagtttgtattttgttgaacgtttttatcctaggaaaaaaaacctatgacttggggacctagatcatctgttacattaaaaaactgctctttcagca

SEQ ID NO: 710413 - DNA, 150 bp, Homo sapiens
aatcgagctcggctccgtttcgccctcggcggcgtcgccagcttgatgtggacgcgcatggggttcgcttcatcctccgggcgcaggcggaacgcatagtcccgcaaatattcgctggtcttgatgtagtactggtccgcgttggcccag

SEQ ID NO: 710414 - DNA, 387 bp, Homo sapiens
tctgtggctgctggtggctgttgctggcctggggctcgctgtctttgcgctgctggacgtctgtacctggtgcgccttccgtgcgccgtgctgcgcgcgcgcctgctgcagcctgcgcgtctgtgacctgctagctgagcagcgcttcccgggccggtgctgccctcggacttgtgacctgctgctgcacatgaacaactgcgctgctacctgctgcgaggccgactttgctgctgcgtctgcgcacctgaccctgctgcggggtgctcggggcgctgagggagttgcgggcgcacacgggtgcttggctggcctcgttgcgctgcggccaccgccagttcgcttgcgccttgctggaggcccttcgagggttgctgcacccgcctg

SEQ ID NO: 710415 - DNA, 770 bp, Homo sapiens
ggtggtcgtggccgtatctgtgtgccgcccagcgatttaccggggccagctgtctctgttgtcgtcgtgtgcgaatgttggtggtcccccgtcgtatgttcttgcagctcggcgtggatcgttggtcgccccgatgtgttggacacgccctgtggtttggttgctccccccttcgctggtggggttgttctgcacggggaccagccacagctctgatagtgtagggtcgccctgcgggggagtaccctccgctcgtggtgtggcgtctgtcggctgctcgctcgctcctcttgtcgggacactcgttttccgccgtgggtcggctttcagttacctccgctgtgggcaggaggtccgccgtctctgcgggccgcccgcactggtgcgcgcgttctgtgcgggccctccctggagtgtcgctcagtcgcgggtgtcggacgctgcttatgccccccccttttgtgcgccccgtcggttgaagctcgctgggctggtagagccccgacgtgctgcagtcgttcgtctgtatcacgttccgcccgctgttcccattgttccttccaactatgtgtctggccagcccatcaaccagcccgcgtgtctgaagtgttccccccatccaccggggggtgctttcgtgccccccccctgtgtgttgcccctccgtttgcgcctcgtcgaccctctcggcggacacccccttttccccccctttcccccgttccccccttccccccaccccgcccccttcccgggtccccccccaaaaa

SEQ ID NO: 710416 - DNA, 1040 bp, Homo sapiens
taccaaacccaacatttattggaaaacaaaaggaaccagtgggcttaaaggcccgatttcaattctcattcaaacttcaacttgaggatgtggggaacacggggggtgtggccagcccttgaagtttgcccctcccagggaggaaccagcctctgtgggaggagaggggcttgtcagacctctccagggccgtggcgtgggactcctcgtggctcagagaatgtgtgtgtgtgaaagggggtgggtgggagaagaagaaaagatgtgtgcagaacccccacagggccatgtggcgctgtgcagaacacacgctgtgggtggcaaagaagagacgtgccggtgtgacaccgtgtgtgcgccattccaatgcgcgttggagagaacacagacagagcggtgtgtggacacgcgggtcacccccagtggtgtatctggcaacagggggggcccagaggcaacacccgaaagcacctcgagagccaagacacagaactccaagaggcgtgagaggagacacacagggcgggggacccacaacacgggcactactgacactacccaggtgggaacacagtagtgacatctcacacaacgtttgataaagctggactatgagacaagatatatattcaaagaagagacccaaaaaatttttggtcacacgattgtgtacacatactattggggcgattagcggaaagtgtatccccgaaaaaaagcgtggcgatcgcccaataagattacaaaacgccttatatatctcctatccaacaacgagcacccggggaaaagtagacacagacgggagaaaaccgtgaaccacaaagcagcgaacagcagtagggcacaaacatccggaagaggactcacagagagacagcaacagcagacgacaacaaaaccccccggataccgcgacggacaaactgaactatgtaagagagggagcaaccaaccaaaacaagagtgaggacgaactagaggaatagaaagagcgaccggctatgaaacatgtattaacacccaaaagagcaagacaa

SEQ ID NO: 710417 - DNA, 950 bp, Homo sapiens
ggagcggggaaggacagcacgagcacccccaacaacctccctcctagcatgatgacccgagaaacacctacgttgcacagaacgcccgggggctgagcgcccgtcactgttgcaaatgggaaagaaaacagctcaggcaccccacgggtgccccctggctccccctccagtcacagcctggcacccccatcagggagcggagccgcctggcacgcggttccaccatccgcagcaccttccatggtggccaggtccgggacggcgggcagggggtgggggtggtgggggtgtgctggaatgggcccctgctctcgcagagtgtgccatgaggctgacccctgccgcgggggccctgaccaccaacaactcttaacaagtgaactcaaatgacccgaagggtcgcagacgaacctgagagaatcgggggacctgaggtcaccaagtgtggcatctaccttgggatcaacacggaaaccgcccccgtgtgtccgattcccctggagtgtgaagcatgaccagttcggccctcctgaagcctgatggaggtctggcgcaggcacaagagcgccgttgcgtgcgcaagcacagcgtcctgttggctgctgaacgggaagtgcggcgggcccgagcccggtcccattcgaagtggaggtttgcagttgtccagacaaggttggggggaattctattcagcgggttggtgggaccgcctggcttcgaaaactgtgacacgatttcaaagacctacgagattgaagccaaggccagggcttatattctttcctgggatacgttacgagggagggcagaaggatttcctattataccataatccggataataggggaaaattccatatttttgagagcaaagaaagatacgtatggagtggacgaataataggtttataatacgtaaatataaggataaagaattaaacatgataaacg

SEQ ID NO: 710418 - DNA, 353 bp, Homo sapiens
tgtgtctgtgtatgagggagggaaggggagtgattcaagaactgattaagaggaacagccccagcacacagtgcagataggtaacgcaaaagtgtgttgctattgtgtaatctatagcaagggaaatgctggagtgtttcgttgtctggttttgttttctggaagtagcttccagcaagattgggaaaaaagacaagcctaattattccaaagtacacactgattattccctggctttgtgtagctgtgtattttccttttaaaaataaaagcaccatttagatgtcagacttttaggtaacttcaaagtttatccagtcagtcagagtgtgtctcctggggcacctggagac

SEQ ID NO: 710419 - DNA, 875 bp, Homo sapiens
tagcatttagcagttctaactaatttagatgtgaggacaagtaaaaatgccattttctggacatgaatttgaacaatcaaatgattatcctccagaatgtctacaacgcttgaaatactctctacgggatcagagaagtcaaagagctatgtgtgtctcagaataatctccttcttctggtcacagtatctttgtctcgtgccaggtggctctttcatttcttggtagctatttttagacttacagtcattcaccaatatacagttagcagtgttctgatagacacagtatcagtcatattctccatttgagtcataatttcaaactcaacagagatttcagaaaggtgataatcatgtaatttctcatattaaaactgagaagagaggccaggcatggtggttcacacctgtaatcctagcagtttgggaggccaaggcggacagatcacttgagctcaggagttcgagaccacctagggccacaaggcgagaccctgtctctacaaaagaatacaaaaattagccaggcgtggtggcacatgcctgtagttccagccacccgggagcctgaggtgggaggattggttcgagtctgcgaggttgggtgctgcgtgagcccagatggcgccattgtgctccacgcgggtgacgaagcaggcgccggctcaaaaagaagagcgaggggccgggctttgttaaacaaacttttttaaacagagggaacccgggggtggaccctgtggccgctaacaaaagaaggcatcctcggaaaaaaaccagcacagcgggatgagaggggaaaacgaatccccgaagaagaagtctggtcacaatacccaagggcgggaaacccggacacgccccaatgcacgc

SEQ ID NO: 710420 - DNA, 103 bp, Homo sapiens
tagactctgtgcttgagcgcccagacaccccttcaggaatcaagggcacatcagcgtcacgtggcagctgtcgctgagaattgccctgagatgaaaaaaggtg

SEQ ID NO: 710421 - DNA, 323 bp, Homo sapiens
aggtcatcaaaaataaagtgtgagaaattgccacatttaaaaagacatgacaacttaatgtaaagtggtatctgagatggaatcttggaacagagaaagggcattgaataaaagctaagaatctctaaataaactatgccattttaaaaataatgatgtgtcaatattggcttattaatcataacacatgtatcatactaatgtaaagtgtcaacgatggggaaactgaatggaaggtatctgggaactttctgtactgtctcctcagttgtttctgtaaatctaaaactgttctaaaaaataaagtttgtcaaaaagaaaat

SEQ ID NO: 710422 - DNA, 630 bp, Homo sapiens
  misc_feature (31)..(31): n is a, c, g, or t
  misc_feature (90)..(92): n is a, c, g, or t
  misc_feature (98)..(98): n is a, c, g, or t
  misc_feature (103)..(103): n is a, c, g, or t
  misc_feature (105)..(105): n is a, c, g, or t
  misc_feature (109)..(109): n is a, c, g, or t
  misc_feature (119)..(119): n is a, c, g, or t
  misc_feature (130)..(130): n is a, c, g, or t
  misc_feature (158)..(158): n is a, c, g, or t
  misc_feature (162)..(162): n is a, c, g, or t
  misc_feature (168)..(169): n is a, c, g, or t
  misc_feature (185)..(185): n is a, c, g, or t
  misc_feature (188)..(188): n is a, c, g, or t
  misc_feature (192)..(192): n is a, c, g, or t
  misc_feature (205)..(207): n is a, c, g, or t
  misc_feature (214)..(214): n is a, c, g, or t
  misc_feature (216)..(216): n is a, c, g, or t
  misc_feature (221)..(221): n is a, c, g, or t
  misc_feature (226)..(227): n is a, c, g, or t
  misc_feature (232)..(234): n is a, c, g, or t
  misc_feature (236)..(236): n is a, c, g, or t
  misc_feature (251)..(251): n is a, c, g, or t
  misc_feature (254)..(254): n is a, c, g, or t
  misc_feature (266)..(266): n is a, c, g, or t
  misc_feature (274)..(276): n is a, c, g, or t
  misc_feature (288)..(289): n is a, c, g, or t
  misc_feature (291)..(291): n is a, c, g, or t
  misc_feature (294)..(294): n is a, c, g, or t
  misc_feature (303)..(303): n is a, c, g, or t
  misc_feature (313)..(313): n is a, c, g, or t
  misc_feature (318)..(319): n is a, c, g, or t
  misc_feature (323)..(323): n is a, c, g, or t
  misc_feature (327)..(327): n is a, c, g, or t
  misc_feature (335)..(335): n is a, c, g, or t
  misc_feature (344)..(344): n is a, c, g, or t
  misc_feature (348)..(348): n is a, c, g, or t
  misc_feature (366)..(366): n is a, c, g, or t
  misc_feature (373)..(373): n is a, c, g, or t
  misc_feature (378)..(378): n is a, c, g, or t
  misc_feature (384)..(384): n is a, c, g, or t
  misc_feature (387)..(388): n is a, c, g, or t
  misc_feature (390)..(390): n is a, c, g, or t
  misc_feature (396)..(396): n is a, c, g, or t
  misc_feature (401)..(401): n is a, c, g, or t
  misc_feature (403)..(403): n is a, c, g, or t
  misc_feature (422)..(423): n is a, c, g, or t
  misc_feature (429)..(429): n is a, c, g, or t
  misc_feature (442)..(445): n is a, c, g, or t
  misc_feature (451)..(451): n is a, c, g, or t
  misc_feature (491)..(491): n is a, c, g, or t
  misc_feature (504)..(504): n is a, c, g, or t
atttatttatctttcttttttcacatctctncctttcataaccattacctatcaattttttttttcaaacaaaaactaatactttccctnnnaaaaanccatntnttancaattaccanaaatttttatngccaaataatacaccactatatccatanaccncatttnntttatccactcatctnctnattntttccccctcttnnntattatnantaatnctatnnacatnnntntacacatctctcttnaantcccttcttagntcctttannnatacatatccannancanaactactanatcacatatnctaanntctnaatntccccccnccaaattcntatnttgaagcaaccaccaacntgatagntgagnctttanganntnattatntcatnanagctccatcctcattaatnnatttantgcctttataaannnnctcaanggaaccaattacctcctttttgcccttcgattcccttccnccatatgaggacncagcaacaggccccgtcctagaagctgagactgggccctcaataaatgaaaccagtttgccagcacgctgatcgtgggcttttcagttttcccaactatgagaaataaattcgtacttttaaatta

SEQ ID NO: 710423 - DNA, 138 bp, Homo sapiens
cagtagcatccttggctctactacaggagatgctagatagcaccgctaccagatgtgacaaccagaaatgtctaccctggaggaacacaaacataccctgatagagaaccattgtactaacctaacaaaacgtgctta

SEQ ID NO: 710424 - DNA, 215 bp, Homo sapiens
acctagaggatgggaagccagggcgtctactgaggcttgactggtgaggatggcattgtccgtatggaccttgatgagcagctcacgatcctccatcctccgcttcctggggaagctcctggaagcctgaagcatgcaggtccggtggacttcgtcggatgaagcgtgatcctccttccttccctggcccttggtctgtgacccacgatcctccg

SEQ ID NO: 710425 - DNA, 373 bp, Homo sapiens
aactctgagttggcactacatcagtgtctaggttgctgacttcgattctcacaaagcagtcatttccgcacgtttgagtaatcagtcgctaatcagtcattccgcacgacatgttacatatatccggacagacgtctatatgacctgatgcattcgacgactgtgtttcagcatcatgcactcatgcttcatcttcagtgcagcaaggatcatgtgttacaatcaggtagtatgtactcagaaaggctacgatgtatgcatcctcccacatcttgatcagccattgatccggtactatatagctgggtgtcgtattaatcctccgctggaatgagtagagcttgctatcaacattggggatacagcgtctatc

SEQ ID NO: 710426 - DNA, 670 bp, Homo sapiens
tcaacgggctaaaaaaaaaaaaataaaatcaagcatagaaacaccacaacaaacctgccctttttccttgtttcaggttacgtgaaaagcatccagagaagatatcccaaagactgaagaggtgtagttggctcattcacgtcgttcgtttatattatcaaggaaggggtttttgatcggctcgaacaagactcgcaagaatccgttttctattgttttttttgaggattccaatatgtcaaattccaattcaaaaaaacctgttgcgaattacgcataccgtcaacagcaagattataatgggatgaacgccatggtgggaaatccaatgatgtatcatcctgttgatttcgtaaacggtgccggccaatatggtccttctcaacacccagcatattacaccaactcaccattacctaatattccaccaacaccttttgatactgcatacggtgccagtcttttgccatctcacctattgatgggatctccatttgtttcctcgcctaacatgcaaagtggctataattctgcaagatcatctaatctcaaaagaaaggcttattcgaggcccgtttctaatcataacggttacaacggaaacagtaacagtaaccaaaacaatactaataacggaatgagtaacaccctcgaactattatagaatggg

SEQ ID NO: 710427 - DNA, 264 bp, Homo sapiens
  misc_feature (161)..(161): n is a, c, g, or t
aaaacaaaacaaaacagaacaaaaaatgggaggggggaccggtcgaaaagaaccgaagggtggagcgagatcgaggaaaggggcggagaattttttttttcttcttcccatttctttaaaaaaccaacacaagaaaacacacacacacacaaccaacgttngttccccgagtagaaacataaataggggggaatcgaacactctgttcttctctcttccaaagaaaaaaaaaaaaggtcacagtacagggaaaggccgggtttt

SEQ ID NO: 710428 - DNA, 399 bp, Homo sapiens
acaatatattctacgagctaaagggagaatgcagtggaaacgttctctttggtagatctggcagggagatgagcgaggcggcggactcttccagtgctgaccggcagacccgcatggagggcgcagaaatcaacaagagtctcttagccctgagggagtgcatcaggtccctgggacagaacaaggctcacaccccgttccgtgatagcaagctgacacaggtgctgagggactcccttcattggggagaactctaggacttgcctgattgccacgatctcaccaggcataagcctcctgtgaatatcctttaaacaccctgtagatatgcagacagggtcaaggagctgaggccccacagtgggcccagtggagagcagttgattcaaatgtccgctg

SEQ ID NO: 710429 - DNA, 220 bp, Homo sapiens
tgatcacgacccttctacgcccctcactgtgacgtgcggaccagaccggtcaaatctcggctacatgctggctcgcgaaaactcatggccttgtcgttgcgaaccaggagttaagacagcgcttggggatggatgccctggtagctggcgaggaggaggaaaccaaggggaatgaagtgaggccagtggacgggtctgctgagtccgcagaactcagact

SEQ ID NO: 710430 - DNA, 136 bp, Homo sapiens
tgtcccgcgagcctctggtccagcagccttgcctgtcgacggaacagtacactccgacgccggtcgcgctggggtctgctgcccgtcgagctcccctcttcgttcttctcaccagcgccctacggggtacctgacg

SEQ ID NO: 710431 - DNA, 329 bp, Homo sapiens
ggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctctccacatagtcccatatttattggaggcttgttcatttctttttactcttttttctctaaacttctcttctcgcttcatttcactaatttgatcttgaagaacactagtgttcttcaagatattaagtcttttgattaggaatacagcacaagactttcttcaccta

SEQ ID NO: 710432 - DNA, 294 bp, Homo sapiens
tcagaccttggcgaatctctctcctcgctgggtcccacagattgaatgtcacctttgagatagatgtgaatggtatcttcgagtgacagctgaagacaagggtacagtggaacaaaaataagatcacaatcaccaatgacccagaatcgcctgacacgctgaagaaatcggaaagggattgggttaactgaatgcttgaggaatgtttggcttgagggaaagacaaaaaaaggcttcaaatgggaggaagggagggaaatttcggccccggggtaccctgaggctccgaaattt

SEQ ID NO: 710433 - DNA, 1387 bp, Homo sapiens
ggatcgcatataactcttaaccacaaaacacgaagggagtatgacttcgtgcatactattactcatgcttacttgattctgagcagcaatgaactcatcgcgaaggatacgcacaagggccagcaagacttgcaaaaaggccagtctctatctatttcggtaggcctgaggacttggtgtctcgataactagcgtcggatacaatatcggtaagctatgcgcgaacagctattcactatctcagagaacatcagaacggcaaggacacactacctgcatctagttcatctaagtcttctcctatcagtaagatcccctacccatgtcgatatccttcgagatcaggcattttgagagcagagctgagacaataacggtcccacaccctaacaaatgaggtccagcgatgaccacccccagggattgaatcgtaccggtgatctacacgctcagttctttgagaaacgctacacaaaggtgacggtcgtccccctagaagaattccttttagttcgtcaccgcttgcgtacttgactctggaacattcacccgaaattacaggggattaacctatgtggaaacttacagtcagtataggcgccaccagagacagggtcacaagcggaaattcgcagcggttttttggaaaggcaaggatacatttagccctcgtacaccgcgtagtagagcctatgtggagcccaccgattagcattcgctccaaagcggctcttccggtggaaagtactccgttgcgcagatggaggccaccaccaagtccgatcgccacagtacagttgtacgatcatctctaattattctatggccctttagggacattgtgattggatcaatacgtgatccagaagaccgcaaatagaggcgagagagcaaatatcacacacccgatattgtaaaggtcacggcgaatacggcagcagattttacatgtcctacacaggataagcgtacaacagattctgccgccccgttgaagcgaacatagattgccgctagagaatagcgcatacacatctgttcccttccctatgtcatttggcaggagactagtagaagctcaccacgaagatcgtcactataataggtagatacaacagtccgatatggtccccagtaccccgaatgtcggtaacgcattattatacttatagaaaagcccataggagggttctcggaatatgccaatggcactctggagcaaagatatttacagatatggttaaccataaaggaataaaaaatacacgacaactcactttaattacgacccgtacagatagtcaagagcgaagctccaagttcagttatcagaagacacccaagtccaacgcggtaggggataaaggggaccaaaaccagagagaag

SEQ ID NO: 710434 - DNA, 88 bp, Homo sapiens
  misc_feature (25)..(25): n is a, c, g, or t
tcaacgcttctaacaattgtacggnggacatgttttattggaacatgctgttcatactttaacataaagctttcttaatgcaaaaaaa

SEQ ID NO: 710435 - DNA, 555 bp, Homo sapiens
cagaaaggtaactcccctaacatatttggaagttcacaaatgggtgctccatagtagatgctttggatacccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagggaataggaagaacgtctgagaaataaaattcgagctgatcatgagaaggccttggaataagtgaaggaaaaattaagacagtcacgagaggcagatatgatgagaatatcagacagcgaagaataaggtagtccaagaaatgaagataaaagagaacaagccactgacaacagtccatattcccaaccttgtaggaatacgtggtggagacccagaagataatggcataagagagaaatgttgacaaatacaagaaatgatgaaacatgcttgtgataaatatagtgaatatgggtggagaataatgaactagactattgaaggaa

SEQ ID NO: 710436 - DNA, 1376 bp, Homo sapiens
agcggggcagtggctgctgggagtgtcgtggacgccgtgccgttactcgtagtcaggcggtggcggcacgcggcggcggcgggatagcgcacagtgcgccttaacaagtaagcagcagcagttagctagtattcggatggtacccccgactggtcgcagcaccccggcgtcgtgtgtgcacgtcagccctcagctaacttcatgcgtcttccgtcccttcgacatcgcagccatggcatgatcagaatgaaccgaagacacaagagttgctgaggttcgtcatgggaagccttcggtccctatctcttgcattagaatgattggcagcatggcggcgcatccactagactaacaggacactatgggagacatgtcgatgaggtcacactgggatccatcaacctccagacgagtatagccttgaagtttggcatgcgaatatcgtatcacagtgacatgctgggattggcgttgaattgggttaatttggggcaaacgcgatgtagagcctgtgcactcactgtacacctgggtatcgtagcctattgggaattagggtcattaagggatagacacatttgggaccccgggacttagcgaggactcaccgttgaaaaggaacacgtaaagacttcgcagattgcacgggcaaatttccccggaggctactttcttgcatcctataggagtagaggcaaatgtaggtggtttcacttacttccaaggttagtccatggcggatgaaaggcataaccgcgtcctatctgatgcgatttgaccgaaaaagcggttataaggggacgaacacagtaaaagggttacccccagagattgcacagcgaaaggatatatggcattgcagagatctggagtctcaggattcaccaaggccggtagttccttgggatttggggaggaaccaggcggagcgaaagggtcgataactttgagtttgcacttggaatatttacaggtcaaccgcagggatttcccacttggggacactgtggcgcgttataatcattggaaaaggaagacgcggttaaggcgtttttccaaaatactttgcccttttatattctcaccccgcgcgtccttaaggaaaggcgcaattgtccacggggttgggccatatcctggttgaaaccgttttaccccgtcggttgggcaaaaatttgggcagagggagaccgcaccggcaaagaacatggtttccacttttcagtttcgcatgcccttggttatcttaattatttagggcaagaaaacttcgtaatgtgttcaacagtatggtttacctctttctgtgggtcctaaaaccacgactcaagaatctgtgcagggttattctggatgaggaggaccactgttccccc

SEQ ID NO: 710437 - DNA, 370 bp, Homo sapiens
gcaaagctgaaaacaaaaactcgttgaactcgtaaactgaaaatgatttacgagttattcgctaggtatcaactttatagcacttttattaaaaacaaattagttagaaaactctaataaaactactatatatactaacacaataactaagtaatgttgtttaatgagattattgttagtatagctgtaagtactggtactatgggataactcgtaaactcgtaaaactcgttggttgcgacaggttattttttttattgttgttttagggtaacgatttacgagttcacgcattttagttttttgaataaataatatacggtgcctagcaaccaaaaaacgttcaatgttatggctcgcattaacgtaa

SEQ ID NO: 710438 - DNA, 466 bp, Homo sapiens
tgcgagtgtcccggcggcttcctgctcgacgcctcccgcgcccgctgcgtggatatcgccgagtgccgagagctgagccagcgcgggctgctgtgctagagcgagcgctgcgtgaacaccagcggctccttccgctgcgtctgcatagccggcttcgcgcgcagccgcccgcacggggcctgcgttccccagcgccgccgctgtccctgccgcccccgccctcggcccggccttcggttgtcccctgagggttttccgcgagctcggcctcgcttctgctccgacttgtggctcgggcccagggaccttcagggcccgcagaccctcccggcgcctttagccccggggcgccccttccggcccccctccccggttagcgggcggttgtacggtttccggcgggccctgcttgccttcctcccaaagggtgattcatagaaaatgataaatcagatcgtacataaaa

SEQ ID NO: 710439 - DNA, 1437 bp, Homo sapiens
  misc_feature (1272)..(1272): n is a, c, g, or t
gacctgacactgtcatgtccgggtcccagaactcaggacggtgaatggctctcagatgctccttggtgtttgtgttgctctcgatggttgccggcaggtgtggtggctccactgtcgtctgagtcggcgcatggctgagcacgctgcctagtgttcttgcgggaaccgcgtcatcagattgccagctcgcgacaagactcccagattggccgaggaatctggtctggagagaggagcgtacatagagtaccctgtctaaacacacgtgtctgtcgaggtcgcagaccgaggaggcttggggcaaaggatttcgtagaccaccggaacctcggttccgtgacaccttggcgaggtcccggaatatctacttcgactcagagaatttcgggggcttgggaatctcaggcggcacactctgtacactgctgtatctcttcgagtgcacgacgcttacccagaagagtggcttcccacgtaaggctcattccccgcgattgcgccgttggctctagttgccggctgtcactccgtaccgagccgttcgatagtgtgcgacgcggaactttcgacaacggatcgcggctgaccgcgacgtgcaagctgcatgctcttaggcgagagtacctccgagtgtctgtccccggcaggcttgtctaggctgggagtagttcggtcgctcgggtgtcaacatttcgtgaccaattggatggtcatatatacttcgaccgtaggggaccaccagtctgggagtggcaactttggcggtcgaaagcgcggcgcagggaggctgccgaagagctgctgtgtctgcagcaactgagggactcacatgtctcgactcagggcaccagggacgtttggtagccagtcctgcaacagcggcccctgcagcgggtcagcatggaaaggaaccgtgggtgccttagggaccagtactttggggggtgcgtagtacgcctcacggtgtgtataggttggcgaagttgactctaattgttgtcaattccgtggagctgttggcccagaataaccgatcttccctgggcggtgcaataacaactcgcatcgcctcacgcatcaagagaactgaagtcgttggaccctggctttagttcccgcgagaacgggtggctcaggcaggaccctgctcgtgggtggcccgtacttagcctagaactccccattgtggtgtcttgtgtttcaaaatagaaggccggactgccgggggttgtttgtttccaagaaaccttattgaatgaactcggcttagtntcagagagcttggcgactggccctaattgaagagagtcctgaggtccttccaccctgtggatgccttgtcaagcgtggggccgccggacccttctgtgttgtccttgggcgcttgtggtaatggcgcgtaacggtgctgagagagagccgcaatatatgtcccaa

SEQ ID NO: 710440 - DNA, 482 bp, Homo sapiens
  misc_feature (352)..(353): n is a, c, g, or t
  misc_feature (464)..(464): n is a, c, g, or t
  misc_feature (466)..(466): n is a, c, g, or t
aaatgtgctcccagcttagtgatgtgggtatactagggaaagcataaatgaggcctcaaaaggtgtgcggggcccaaagatggcaaattcataaaactcatggttctccatttatttaaaagagagcgggctctgaggaatggatttatattaatcagagctataatagacggattaataaaatacaaggccatttattcattaccggtgaatgtggtaactaccaggctgaaattcaggtcggtgggtcagcacatgctcttccgggtaggaaaaatctatttaagaaaccatattaaaatcagaaggttacatgttatatatggaagctgaacaaatcaagtgggacgtnncgaaaggctatttccagccgggcgcaggggctcaggccggtaatcccagcacttggggaggccaaagcaggcagatcacgaggtcaggagatggagaccatcctgaccaananggtgagaccccgtctc

SEQ ID NO: 710441 - DNA, 191 bp, Homo sapiens
  misc_feature (58)..(58): n is a, c, g, or t
  misc_feature (67)..(67): n is a, c, g, or t
  misc_feature (85)..(85): n is a, c, g, or t
  misc_feature (102)..(102): n is a, c, g, or t
  misc_feature (114)..(114): n is a, c, g, or t
  misc_feature (117)..(118): n is a, c, g, or t
  misc_feature (138)..(138): n is a, c, g, or t
tcattgtgaccaatggcctttttacaacccggcctgtggcctgttcaaggcaaaaccncgacccttnactcccgggtggggaggnggccaaggatgctgganttgaatcaaacnctnncagtttttcaggcatttttntttcccaatcgaattgaacccattggccaaataaagttgaaattttcccccca

SEQ ID NO: 710442 - DNA, 134 bp, Homo sapiens
caacccggagccccccaggacttgctgtgtggggtccaggggggctcggttgtcctgggggccccaggctgggcaacaggcggcctcgagggctggaagatgaggacgatgtgctactggtgccacttgctgag

SEQ ID NO: 710443 - DNA, 711 bp, Homo sapiens
  misc_feature (414)..(414): n is a, c, g, or t
  misc_feature (444)..(444): n is a, c, g, or t
  misc_feature (456)..(456): n is a, c, g, or t
  misc_feature (491)..(492): n is a, c, g, or t
  misc_feature (548)..(548): n is a, c, g, or t
  misc_feature (554)..(554): n is a, c, g, or t
  misc_feature (560)..(560): n is a, c, g, or t
  misc_feature (564)..(564): n is a, c, g, or t
  misc_feature (570)..(570): n is a, c, g, or t
  misc_feature (578)..(579): n is a, c, g, or t
  misc_feature (587)..(587): n is a, c, g, or t
  misc_feature (600)..(600): n is a, c, g, or t
gggctcccgcgtctcgctgcaacatcttgtcctacgactactccggctacggtgccagctccgggcaaggccttccgacgaggaacctctatgcccgacatctgacggccgcatggcaaggccctgcgcatccaggtacggcatcagcccggacagcatcatcctgtacgggcagagcatcggcacggatgcccaccagtggacctggcctcgcgctacgagtgtgccgcggtggtgctgcacctcgccgctcacctcgggaatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgngcgctgccccaaggcggtggagccgctgtngggtggagggcnccgggcacaacgacatcgagctctacagccagtannctggagcgcctgcgtcgcttcatctcccaggagctgcccagccagcgcgcctagcnggcggncccaancggncggacntcagcaannaaggcggnccccggacctcancccacgcgcacaggcccccacacatggggcatgcatgtgacccccgcagggcggcaccagggagccccgcccagatccaaaggggctgtggacgatgtacaggcaacataa

SEQ ID NO: 710444 - DNA, 585 bp, Homo sapiens
gtattaaccaattgatgaacataaatagacacataattatcgtccaaactagattgtagtccgtcaggtgacactcttgggatcgcacattactatgggtacggataaatatatagtgacatgtatccacccttctgtctacctacagaatagtttcactgtcttaaaaatcctctagcactctgcctatatatccctccttaccctcaacccctgacaaccactgatctaataatgtctccatagttttgccttttccagaatgtcatatagttggaatcatatgattggcttctttcacttagaaatatgcatttcagtttcctccatgtcctttcatgtattgctagctcatttctttacagtgctgaataatattccatagtctaggtgcgccataatctcttctctcacctactgaaggatatgtgggttgcttccacgtccgggaaattatgaataaagctgctataaatatcagtgtgcaggttacagaacagatatatgtaacgaactcattttgtacataccaaggaactggatggctgaatcatatggtcagagtatgtttaattatatcagaaa

SEQ ID NO: 710445 - DNA, 966 bp, Homo sapiens
  misc_feature (414)..(414): n is a, c, g, or t
  misc_feature (444)..(444): n is a, c, g, or t
  misc_feature (456)..(456): n is a, c, g, or t
  misc_feature (491)..(492): n is a, c, g, or t
  misc_feature (548)..(548): n is a, c, g, or t
  misc_feature (554)..(554): n is a, c, g, or t
  misc_feature (560)..(560): n is a, c, g, or t
  misc_feature (564)..(564): n is a, c, g, or t
  misc_feature (570)..(570): n is a, c, g, or t
  misc_feature (578)..(579): n is a, c, g, or t
  misc_feature (587)..(587): n is a, c, g, or t
  misc_feature (600)..(600): n is a, c, g, or t
gggctcccgcgtctcgctgcaacatcttgtcctacgactactccggctacggtgccagctccgggcaaggccttccgacgaggaacctctatgcccgacatctgacggccgcatggcaaggccctgcgcatccaggtacggcatcagcccggacagcatcatcctgtacgggcagagcatcggcacggatgcccaccagtggacctggcctcgcgctacgagtgtgccgcggtggtgctgcacctcgccgctcacctcgggaatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgngcgctgccccaaggcggtggagccgctgtngggtggagggcnccgggcacaacgacatcgagctctacagccagtannctggagcgcctgcgtcgcttcatctcccaggagctgcccagccagcgcgcctagcnggcggncccaancggncggacntcagcaannaaggcggnccccggacctcancccagtagctggtctccgagcctggggctgcgtgtgtgactcgtgctgctcgatccagggggacctggatcctttccaggggctgtcgactatcgtgcaggcgatatcacctagtgactgcgcttgaccgtatgagtgaaagcttccactgactctatcgtgaggaaccggaagattctgacgcattatgaggagtcggagagcaggtgcctagtggacggaggccagcgagtaaaagccgaagcagtggggcgtgcagtacagtggacgacgtcagcgaagacccgggtccaacgtggacccaggtgttctttgacctaatgcagagaaatcagaacgagcgacccatgtcagaaaacaacgacc

SEQ ID NO: 710446 - DNA, 119 bp, Homo sapiens
tattccaaggaataaatggtcaaatggtcacaagagtccaatcggtttatacgcaaaggaaacagaaatagtaaattgtcgtttggaacatctgcaaagcctctcatgaatttttaaca

SEQ ID NO: 710447 - DNA, 144 bp, Homo sapiens
cagcatgcgcccccttcatacttacttatttatttttgacagtgtcttgcttccccacatgctgcggtgctttcctaccagtgtagagttccaaactccaagactgaagtacacaaagtagggggcgggccctgtgctgggggg

SEQ ID NO: 710448 - DNA, 205 bp, Homo sapiens
tctgtgtaagacggagctcgctctgtcgcccaggatggagtgcagtgagccgagatggcgccattgcactccagcctgggtgacaaaagcaaaagtccatcttaagaaatatatatatatattatatatattcttagttctaaggatttcctttaattctatgattctctgggatttaaatgcattattcatatttcttgaaggc

SEQ ID NO: 710449 - DNA, 569 bp, Homo sapiens
  misc_feature (255)..(256): n is a, c, g, or t
  misc_feature (258)..(263): n is a, c, g, or t
  misc_feature (267)..(269): n is a, c, g, or t
  misc_feature (276)..(276): n is a, c, g, or t
  misc_feature (281)..(281): n is a, c, g, or t
tctagtgtatttgtgtaaagactccccaagagctcaagagggagttgctgctctgcaaatgacaaaaggtgtgtagctgcaagccaatcaggcagaacatttaacatcgtcctggccattaatgactaagcctgcgccagctcaaaagcggtcggaaacagacgtcagactatgggacagctaaaacattgattctcagggatgtcgtccaagaggaggtctctgaagctgggtgtcatcctttagggtggcccnncnnnnnnaaannntaaaaantaaantgggtgacacattatgcctcctggcgagttcataaacactttgaacggcaaagacaccaagtcccggggacttccaacgaagatcttggggcaagaagagatgtccaccagcactttctgttctgtgactgtaaagtgtaaatggatctggggttgcgtggggaagggggggcagagggagagaaacaatgtcttgcggctgctgttgctctggctgctgctccacggggcttgttttggatccccctgcagtgaaacaggtcctgtacggctccgccactgtagtag

SEQ ID NO: 710450 - DNA, 786 bp, Homo sapiens
agcggggacgtggttctccgcccctgtccactggtgccatggatgactgtggcacagtagactgtagtagtgaggctcgcgggggcatgctgtgccatggcatgtgccgtgctgaactgagctggtgtctgtgagaggacctgctgatattttgaaaaggaaatttcacgtctgagaaggcacgcaggctcggctgtccaagatcacgcagtttgacgtacgcctggtgcctggtgcggagcaagttacatattgactgacatccgtaaaggcatcgtgctgctcgaggagctgctgcccaaagggagcaacggaggaaccacgcgggattacgtcttctacctggccgtggggaactaccggctcaacggaatacgagaaggccttaacagtactgtccgcgtggtttgctgcatgaccagacgccccacgaatcaagccagtgcctacacggtaactggcagcgtgctcattgactatggccatgaagaacgatggactcgtgggcatggccatcgtgggaggcatggccctgtggtgtggcgggactggccggactcatcggacttgctgtgtccgagtccaactcctgaatggagacgcgggagcccactggagaacgctccaggagggccctgtccatcctcgctgtcctttccctgttctcccctgccccccgtctctatcctctgtggccttcagctaatttctgctcccctgagattcgtcctttcagcccatcatgtgctttgggatgagtgtacataaacggggctgtggcttggg

SEQ ID NO: 710451 - DNA, 134 bp, Homo sapiens
ccagtggttggtaacttgcccaaaataaccctttggttttggagtattcataaaatgaaggtgttgccatctcccttaatgctgggggaatatatttcaattgactcaagtcttcattgctgaatgatatctta

SEQ ID NO: 710452 - DNA, 363 bp, Homo sapiens
ccaacggcctgcccccaaaagcgcaaaaaattgtaaggcaacggcaggaggaactgtgcctggccaggcagtacaggctgattgtccccaacggtttctgcgatggcagatcaaaaaaaaaccctttgtagcaaaatcaaaaatctagtttcattttaaaacttttgattagctctcagttttcagctctatttattttaggagtttaatttgcccttctctccccattttccctcagtttccataaaaccttcattacacataaaaaaacacgtggggggcagtgaatttgcttgcctttcctgaaagtttttgggggttaaaattccagacttttattcatttaactatagtcccccgtga

SEQ ID NO: 710453 - DNA, 286 bp, Homo sapiens
  misc_feature (1)..(1): n is a, c, g, or t
ntccccgacgtgatacaccctataccaccaaggctgcagtgagccaagatcgtgccactgcactccagcctgggcaacagaatgagaccctgtctcaaaaataaaataaaataaagactttttaggccaggcacagtggcttatgcctgtaatcccaacactttgggaggccaaggtgggtggatcacttgaggccaggagtttgagaccagcctgacaatatagcgacactccatccctacaaaaaaattaaaaataaaaaaataagctggacatggtggtatag

SEQ ID NO: 710454 - DNA, 145 bp, Homo sapiens
cgtccattaaactcacattttcacaagtagcaaataatcctaactgtatagaatctggaatacaacacgcaatgggatgccaatgaagaacactggcggagctccgccctgaaagtgcatcgccctgatatagttgtccatgggg

SEQ ID NO: 710455 - DNA, 445 bp, Homo sapiens
  misc_feature (1)..(1): n is a, c, g, or t
ntatgtcggtaccatacattgtctgatgacaggagaatcgctgggcctgggaggtggaggttgcagtgaggtgagattgttccactgcattccagcctgggcaacagagcgagactctgtgtcaaagaaaaaaaaaaaaaagaaatgaccccatatcctgtccccccagtttccccaggggtaacatcttatttaaccaaagtacaccaccaccaccaggaaactgaccttgatccaacgcattccgccttattcggattcaccagcttcacatggtatggtgtgtgtgtgtgtgtgtgtgtgtgtgtgtgtacaattctcgtgcaatgtctcacctatgtagcctccgtgtgatagcccaccatagccaacatatctcatagctccataaaaaagatcctaggctcatactcttgcgtccctgcagagacctccctccgtgctc

SEQ ID NO: 710456 - DNA, 606 bp, Homo sapiens
  misc_feature (173)..(173): n is a, c, g, or t
  misc_feature (271)..(271): n is a, c, g, or t
  misc_feature (281)..(281): n is a, c, g, or t
  misc_feature (305)..(306): n is a, c, g, or t
  misc_feature (324)..(325): n is a, c, g, or t
  misc_feature (333)..(333): n is a, c, g, or t
aactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttncttcggaaattctttttctcgggcccccgaaaattccaatatgaaaatcacctcggagctggtaaaaagaggcctaacccctgtctttagatttacangtccaatgcnttcactcagccattttacctcacnncccccactgaattggggnntttttttntttcccggcccgggcaaccgttgactattctctacaaaccacaaagacattggaacactatacctattattcggcgcatgagctggagtcctaggcacagctctaagcctccttattcgagccgagctaggccagccaggcaaccttctaggtaacgaccacatctacaacgttatcgtcacagcccatgcatttgtaataatcttcttcatagtaatacccatcataatcggaggctttggcaactgactagttcccctaataatcggtgcc

SEQ ID NO: 710457 - DNA, 741 bp, Homo sapiens
acaaaatctatctaagaaaaatataatgaagacccaaataaataaaatcacaccaaaataaagagacattacaactgatgccacagtaatataaaggatcattagagacttaatgaaaaactatatgccaataaaggaaaacctaaaagaagtggaaaaattcctggatacattgtctaccaagattgaaccatgaagaaacagaaaacctgaatagaccaatatgagtaacaagacagaggcagtaataaaagaaaagcccagcacctgatggcttcgttgctaaattctatctaacattaaaaaaaaattaatagcaattctactcaaactattccaaaaaattgaagaatattcccaaactcggttctgcaaggccagcattaccctgataccaaaacaagacaaagacacaacaaaaaatgaaaactacaggccgatatctctgatgaacacagatgcaaaagtcctcaacaaagtatcagccaaccaaattcaataatacattaaaaagaccattcaccatgatcaagagggatccatctcagagatgcaaggatgattcaacatatgcaaatcaataaatgtaatacatcacattaacagaatcaagaacaaaaatcatgtaatcatttcaatagatggtaaaaaagcatttaataaaattcaacatactatcatgataaaaactctcaatgtgccggatatggtggctcactcctgtaatcccagcacttaggg

SEQ ID NO: 710458 - DNA, 431 bp, Homo sapiens
caggcactgaccttcagcgcctcggctccaccgccatggcgccctccacgatgtccttcgttggggggaactgcaagatcaacggccggaagcccactctggggaaccttatcggctctctgaacgcggccaacgtgccggccgacaccgaggtggtttgggctccccctactgcctatatcgacttttcccggcagaagctacatcccaatattgctgtggctgcccacaactgctactgactaatggggctttcactggggagatcacccctggcctgattactttggggattcacatgatcttgctgggcacaaagtgccccatgctctcccacagggacttttcgtaaatcccctgtattgtggcaaacttttctataaacgtaaccttccatcattgcacgttgtttttcagcatacgcttctgcc

SEQ ID NO: 710459 - DNA, 205 bp, Homo sapiens
gcagctgctgtggccctgtgagagacaaggcctgcacaggagtccagcagggttcaaataagtgaaggctccggctcctcatgccggaggaatgagggctcttcacgtctctgccacatctgccaccccttcccatgaggagtgtctagttacccagaccctagagcggcagtgcggccagcttgatgacgtgctgctagtcgtt

SEQ ID NO: 710460 - DNA, 161 bp, Homo sapiens
acacttcctacccagtagtctccagatgtctaccagggtgccttcttatgaccttggaagtgggccctgtattcctccatgagcatgcatgcttggtccagatatggtgccccgaggtgtacccaccacactctcactccatccccccgatacagcgacca

SEQ ID NO: 710461 - DNA, 124 bp, Homo sapiens
ccccatcatcgacatcatgcgctgtcctggcaacgacatgtcgttggtccacgctgcattgcgatgcgcgggcgctccgacaagccggtgctttcgccgtggctccgagagtcccatgcctcga

SEQ ID NO: 710462 - DNA, 108 bp, Homo sapiens
aggcagtggtgggcagaggtctccggcagtgatcacaggtctgtatgacaaatgttcttatatctcacgtgaccgaggatgggtcgtgagtgttcacaccatcagtga

SEQ ID NO: 710463 - DNA, 1273 bp, Homo sapiens
  misc_feature (128)..(128): n is a, c, g, or t
  misc_feature (1273)..(1273): n is a, c, g, or t
ggcgtgaaggagatgaatgacgtagcacggttcctgttgggggtgtcacgagccttgggtgtactggccatcagactctagtcgtggaaccgaccctctatagcttcgcctcttagtaaatggctccnacatgtgcctatgaatccgaccatgtagggtgtagatcgcaaggttggtcgcgtagctcttacatgtctacgggtacacaaagtaggatcacctgcgtgtgaaacgccgcaattaggtataccatgcttcacgcgataggcactacattcacaagtagtgcttgtggagttgtgtcaatgagggcctttgtagcatgacttgagcagagttataagtgcatactcttgaagcgcaacatagatgaactatcgtgtagatgcgcaaggcactatagaatgttacgacatatatgtgaaacgatagatatcgataggtgcggcattttcatccactaagatccctgtcgcgcttccctccacgttccctagaggtatcgacgtttgcccgcgagactagtaactgcagatgggccacatgggcaccgagttcgaactcgagttgatctaggatggctaatcgctcgagatttctagaaagtaacagaggaaggggcccggattgggggagataactctggccttattgagattgggagcagatctatcgttcgcttccctaggttgggaaccaattgagaggttcatccatccaacaagaggtaggggaagggacaacaatttcgacgctgtttcccttttggtgaagagggacgtacttacaatcggtacccatcattgaaggcgagaaaacgcaccttcagaggtagaggtcacgaaggcgccatagtcccaagggcaactttcctaggccgcgccatattcgacgtggcacacccattgtacagagaaatatctcagatggttccgccaaaatcaagctcaacaggtgtgagaaaacgatatagggcccccctttgggtgaacacttgcaattagaacatgtagtgaacgaccttaaggatggagccttacctatatgggacaggagggcatgatcagcgttttgaagcgtagaggaaatctagggtgaacggagccaccaagtttaattccgaatcacattaaggcatagagcttgaacacaatcaaagcgggcgatggggaagttggggcacaggcagattggggacacccccatgatggggattgcaagccatgtatttcagagcaatagggcccaatttcccaatagtagacacacaggn

SEQ ID NO: 710464 - DNA, 305 bp, Homo sapiens
aacgagcatgcatatcttttcattcgaatctacagatgaaccctgagcagacgaacacagaaaagccatgaagacttactgcttaattcaggagcttacaggattcttcagagtgtgtgtgaacaaaagctatatatagtacgtatatccaggatacaaataagagagagactatggcttgaggtgagaatgtactgcattacaaggtctacagcacaattaagacacagaaagcagatgggaagagggtgtccagcatctggtggttggtttctcaagggattgtctgtgcaccaaattacttc

SEQ ID NO: 710465 - DNA, 170 bp, Homo sapiens
  misc_feature (21)..(21): n is a, c, g, or t
  misc_feature (44)..(44): n is a, c, g, or t
  misc_feature (55)..(55): n is a, c, g, or t
aaggtgcggggtggcacacgnccttttatgcccactactctggnagctgagaaanaaaatcacttgaacctgggaggcaaagattgaagtgaaccaagatcacaccactgtactccagcctgggcaacagagcaagactctgtctcaaaaataaatttaaatttaaatgc

SEQ ID NO: 710466 - DNA, 536 bp, Homo sapiens
  misc_feature (11)..(11): n is a, c, g, or t
  misc_feature (110)..(110): n is a, c, g, or t
  misc_feature (147)..(147): n is a, c, g, or t
ccatgcttggnaaaggattgattactaggatattaatccaggttcatactgctgtaaagactgcccgaagactaggtaccttataaaggaaagaggtttaattgacttcncagttcacagcatggctgggaggcctcaggaaacttncaatcatggcagaaggtgaaagagaagcaaggcatcttcttcacaaggcagcaggaaggagaagtgttaagcgaagcagggagagccccttataaaaccatcagacctcgtcgggtgcggtggctcatgcctgtaatcccagcactttgggaggccaaggtgggcggatcatgaggtcaggagatcaagaccatcctggctaacatggtgaaactccatctctactaaaaatacaaaaaattagctgggtgtggtggcaggcacctgtagtcccagctacttgggaggctgaggcaggagaatggtgtgaacctgggaattggagtttgcagtgagcagaggtcgtgccactgcactccagtctgggcgacagagcgagactcagtctc

SEQ ID NO: 710467 - DNA, 911 bp, Homo sapiens
gatgcctgcctgccggcgtgtgtcaagtactgcgggggaagcttcgccgcacaggatcctcgggcgaggcgccacaaacggtttatacgagcgcagctagtcaatgggagctctgttgtgctctgtggcggcttcatgggatgatgcgtccatatacttgtactacttgtgctgaggtgagctcagtcgatgtcacgaacgattggaaaaatgtatcttataattattaaacgacttaatgatccatacggaggtgagctataaagggacaggtcgaggtggtgacagtgtagtctatggaaagagtgttgaaggatgacccgtcatctcagattatgaaattcacgggggctgggaaattgtctcgtggaaggtcagatcgcggaggtcaagagtaaccgatgtgtagccagaatctttgtggaaccgtcgaccttcagcaagaggctgcgagggtatcgacagcatcctgggcgagcgtgtcagggctcggaatggtgaatcgcgtgggaaaggcaaacaaaatgcgcaagagccgcctggggcaagtgaagaccattgagcgccattcctttgggggagagggggaccccactggagaagtccacacgggaagaggctcggcgggcaggttgtgatgcacgacgcggtgggagcggcaggccgggggggggagcacccaccaagggccgggctgggaacacaccgagcccgcagagaggcgtaaggcccagaatagtccaattcagagccggagaaaaagtatataacacactcactgaaatggaagcaaatatctgtcctctgtttttttcttctcctcctttatctcactgctgtctacgttctttgctccacttcagaactcgacacagtgaccagaccaccacgaccagaacaaatacagcagg

SEQ ID NO: 710468 - DNA, 668 bp, Homo sapiens
  misc_feature (380)..(380): n is a, c, g, or t
  misc_feature (471)..(471): n is a, c, g, or t
atttatcttccacccacaccccagctgtcttcttgagcaggatttaaaggggctccaggatcgttctcttctgtgtgtcccacatttggtccatagggacactcaacacctattttgctctaataaactcaaagtgcagaccaatcctaccaaccgtgcagcctgttcagtcgccgaagaggctcaccaatccctctctcctgatctgtaggtttccagggctggagtcagacaacaatcccctatgctcccaacttacaggttctctgagtggcccacatggagaggaaaaaatagtatgagaaggattacttttcaggactttccgggactgagacaggaaaatactgggggtgggggaggggtctccagagaaatgnaaccaatggattatatagtcgtgaactatggctatatctgggtctatggagacttattatgaggaattggctgccacagattatggagctngtaagtcctaccatatgccatctgcaagatggaaaccccagaaagcggggtggttcagtctgaatccgaaagcctgcggatcgttagcagtaggcagaggagggcgaagttgtggttttggtctggtgaagcccccgcactaaggggatgcggcctgctgaagggaggcaagtactgggtcccctggggggcggggg

SEQ ID NO: 710469 - DNA, 282 bp, Homo sapiens
atgggaccggctgagacacaagcagtaagacataaaaaacaaagaaggtgtattaaaaagaaacaaaactttcctaaatttaaccaatgtggctgtctagtacccaagaaaatctaagtaccaaacatttagcatttaaaagaattcagctgaaatgaagatcaatgtactaaaattaacagtgtatctatattctaacagtagagaaaggaaatacaataattaacaaaactacttagggtatgggaggctgaggcaggagaattgcttgaacccgggagg

SEQ ID NO: 710470 - DNA, 202 bp, Homo sapiens
  misc_feature (191)..(191): n is a, c, g, or t
agctgaactactgtgtctgcctagaacccagagcagaatttagatctcagatttgaaagcttgcctgatatgcctgtccgtgggaagagcagtcaccagtcactacctaccgccctccaggctttggatcacggccattttatatccttcacatgtcttcaactcttgactacccactattgcttcagcgntcttgacgggc

SEQ ID NO: 710471 - DNA, 197 bp, Homo sapiens
gtttttagacacatttttgtccggagtttaggagcccggtttatctattgtgtggcaaggttccctataaccataacctaacaggaaccggttttgactggatttggtggggattctgtgttattgttgggaattggggaattgaaacctggaatttcggtcgaagtaataaaaaagaggttaatcgtttgcggccg

SEQ ID NO: 710472 - DNA, 374 bp, Homo sapiens
  misc_feature (191)..(191): n is a, c, g, or t
catgccgtaatttgggagcgaggcgggtggatcacttgaggtcaggagttcgagaccagcctggcaacatggcgaaaccctgtctctactaaaaatacaaaaactagccagatgcggtggtacgtgcctgtaatcccagctactcaggaggctgaagcaggagaatcacttgaacctgggaggcggaggtngcagtgagtcaagatcaccccactgcattccagcctgggagacatagcaagactccgtctccaaaaaaaaaaaaggtaagccttggggtttaaaagggcccagggtaaacccttggaaaaaactttcaaaatttaacacgtgtgaaatggggggcggcggggtaccagagaggctccagaatt

SEQ ID NO: 710473 - DNA, 282 bp, Homo sapiens
cagcagtgccaccataatattatgaattcatcagccagcagtggtggtttgcacctgtaatctcagctactcgggaggccaaggcgggagaattgcttgaacccgggatacagaagttacagtgagccaagatggtgccattgtactccagcctgggcgacgagtgaaactccctctcaaaaaaaaaaaaggaaggaacgaaatgaatattttgaaccaaaattttaagggggaaaaaaaatgcccctcttttattattttctgcctctgaggcttagcctt

SEQ ID NO: 710474 - DNA, 260 bp, Homo sapiens
catagtcgtctggaaacatcaccatctgtctgtcttgcccaagcacaggtactgtgcgcagactgagctggtgttggactgagcagtcccgtctccagggaaaggatctgtgatagttcagagagttcgactggtgcgttccaggcgccacagtccttatttccttgttcttggcttttgcctttgtaaaaaggctggatcacagcccggacaacagaactctgctcctgggaactctccctttgccgaaggttatgctt

SEQ ID NO: 710475 - DNA, 132 bp, Homo sapiens
  misc_feature (66)..(66): n is a, c, g, or t
  misc_feature (93)..(93): n is a, c, g, or t
gaaaaaacacacacaccctgagaaccaaaattgatctgaaaatactgtttcgcttcaatttcattncccccaacaatacctagggcctatccnctccgcagtactgatcatttctattttccccctctattg

SEQ ID NO: 710476 - DNA, 236 bp, Homo sapiens
tgacttggagatgcatcgatgtgcactcagcagtgttgccagatgtctggggggactgtccgtcacggtggtcagacggcggcactgcgttgccagtccacgggtacacttggtggtggggctaccacaatccggcgctccgtgctcgaggctccggctaggtcctccgcagcgcctggtcgccgcgccctcctccccgtctgctgatggccgggccttcggcgccgggcagtctg

SEQ ID NO: 710477 - DNA, 81 bp, Homo sapiens
ttttgtgctcttggggagggggccccgagggatcgctacggctgggactcggagagaaccgataaactcatctttggaaaa

SEQ ID NO: 710478 - DNA, 683 bp, Homo sapiens
gccgcggacctcgctatggcaaggccggcgataatgagtggatgcccgtcaccaagttggaccgcttgctcaaggacatgaagatcaagttcctggaggagatctatctcttctccctgcccattaaggaatcagcgagcattggtttcttcctggtacgcctctgtcaaggatgaggttctgaagatcatgccagtgcagaagcagacccgtgccgatcagcgcaccaggttcatggcattatgttgatatcggggactacaatgttcacgtgagtctgggtagacaagggctacaaggaggtggccagcgacatccgtgtggacatcaatctggccaagctctacatcgttcctgtgcgcagagtctactagaggaacaagatcgtcaagccccacactgtcccttgcaaggtgacaggccgctgcggttctgagctgctacgcatcatcccttcactcagtggcacctgcagtcgctccgctgtgcctaataagctgatcatgaagtctgttactgaggacgtgctcaacttagcactgcgctgcacttgcactctggccaattttgcaaggccacctttgtaccattgctatgactacattaccagaccctgacctctgaaggagactgtattaccagtttacctatagcagttactgccacccgtgacctaccaggtc

SEQ ID NO: 710479 - DNA, 168 bp, Homo sapiens
ctgtctggtaacttacatgctacgcgtctctaccgaagcatgaactcccagtatctgaagctgcttagctcacagaaataccagatccttttatatcatggagatgtgacatggccctgcaatttcatggtggtatgagtggttggtggattccctcaaccagaagat

SEQ ID NO: 710480 - DNA, 107 bp, Homo sapiens
agtctccactccacctgcctacgttatgaaccctccttctgatgtatccaccaataccagtactgaatgtggccgagacgttttcagtaaatcttattagctaccgt

SEQ ID NO: 710481 - DNA, 445 bp, Homo sapiens
gcagacagatgtcaatcattccatcccttgttttgctgggtggagtcactggagcttaaagaaggggaagtaaactcaagcacacatcctggtgacctctagccacgggtcaaatttcactgatgtcaattaaaaatgaccaaagacccgcccctgtgaaaaccctgtgggcagccattttgtctcagggaaactgcccagatctgatgtaaagtatttccggacgtctcttcgttgtatatggcatttccctgaaataagcaactctctgaaaaatatcatagcgcatatcaaaatgaagtactctgtggtgaagtagaagtacacagtcaacaaagaaacttgccctcaggctgcacagtaaaacgttggaaatcccagagcagcaacttggaaatcccacctgctacatatttgcctgagtactttaaggttctatggacaa

SEQ ID NO: 710482 - DNA, 604 bp, Homo sapiens
  misc_feature (59)..(59): n is a, c, g, or t
  misc_feature (85)..(85): n is a, c, g, or t
  misc_feature (547)..(547): n is a, c, g, or t
tgaaagtccaaacaacgctagggcaaaactgtccttagcctgtggcattcttagaaggnagcaggagggtgagctggagaagaanataggcatgccagaaatatcccagaaataaacctgatttacatgtcttattttcttctcctttatctgataactactttgtttttaccctaatccttcaggaaaggcttagagagaattcagtgttcaattacaactgctgtcacaaacgcccagtatctggtagctttacatcatagtacagttatgcttacttgggaagacatatttcttcatattaaatacaaattagtaaaatttcatattaaatacaaatgaataaaattatctttgttttcctacactcagtgttagttagtatttaacagctaaagtattaagagcaaaggagtttccaaacttatgttctaaaccaagtcaggtcagagaattcatattaaatcattctatttatgggcaaatgtagaaagttctttacatcgagaatcaacctagagaaggtatgagttagctttcttccttnctaaaacattagtttctgagacttgcagataaacgattttttttaatgaaatgctta

SEQ ID NO: 710483 - DNA, 700 bp, Homo sapiens
atggacaggaaagatttattaatggagtgtggtgtacacagacttaacatagctgaccaagatgaattgccgagcatgcaaagagcacatcaaacgacattataacccactggcttctgctaacccattggggagccctgttggtcagtatgttacgcatcatgtaaaaagttgcaagctccatctttctttggtcctaagtacctaatgctcttgttagctgcagatctagagctaatcacctgcatacatgaggcaaataaggtgggtgcctgtggggatatactctccccatgatgacagggaacttgtgctcgtggtcccagagcaccaagaggaagggctgctgcactctaaagaccagttaggtgcggtccacatagatagcggatgctgcagccgactagcccgcagtctctgtcacgtccaagacttgtctagtgctgcatcacagaaaacctggagaatgtggggctttattgaccccacacaagttatggcatgaagacaaaaccgatgaattccaatatcttcattgaactgacagcgtattccggcctgggcaatacttttaattgggggaagaggcccggagaggtgggattgaaaattggacaatttccggtttacccaaggattgcctctaaaaacaaaagggccttggagccctgtttcatgggtttcaaaaacaagagtttag

SEQ ID NO: 710484 - DNA, 427 bp, Homo sapiens
  misc_feature (388)..(388): n is a, c, g, or t
catgctgtatcagaggatcccctcagcacattaggggaatcggtcttaatggatacggtttcttcaccgactatttctccctcaaactctgggcctcggctttttctctggtagccgggtcctcgggtgtgaacaggagcagatgacaaatagcacctagctgggtgacaacccataggaggtatgcctattaaaatgccaggggccacggaggtgtcacggtgaggatgacactatgggcaaggatggatgattggtattgtgaactacggatgagaaatgctccagagggggtacggaccagccttctctaggtgtccagacaccggtctgagtttctgggggtaaagatcatttccagcaggttttgagtctcatcggggtgcanggacaagtcgggtatcttcggtatgactaaaggtgctga

SEQ ID NO: 710485 - DNA, 292 bp, Homo sapiens
cttttggggccccagggggggggccccccccccccctggttcccccgggcgggagaactgttccccaagggggggggcttttcccccaggagggggggggggggcggggccctggggccccccaaaggccccccccgggtgtttgggggggttttttcccctttgggccaaaggttggggcccttggggccctttggggggggccccccccccccccccggttttgggttggaaaattttgggccccggggttgggtttttttaacccaaaaacggttttttttggggccca

SEQ ID NO: 710486 - DNA, 551 bp, Homo sapiens
  misc_feature (429)..(429): n is a, c, g, or t
ggatggtctgaccctgactgtgaggcgcctgcgcgagacccaactggtgctctacggagacgtgcatgagcgtgaagaggagcgtggacgagctccccagcaccgcgtgatcactgcagaaggcgctctagcaggtgcacacgctgcttagtcaggaccaagcatacgccgcacgtatggcttgtcaggacttgctggacagactttcttgtatagacaacctgaaagcctcactcagtcaagtggaggctgactcgaaaatgcgtcatgactgctgaggacagttaggttgcctactcggccaaaatagaaaccaacgcgaacaatctggaatcagtcaagggtttactagatgacctcgggaatgatctggataggttgtttgcgaaaagtgacaagactcacgggtctaaatgaattgcgtgacanggcgccggtttgaggcatttccacgacctcttaagaggaactgtaccaacttgacagcgaggcatttgaattccatggcccggtgagctcaatttccatatttaacctgttttgttttgctg

SEQ ID NO: 710487 - DNA, 1067 bp, Homo sapiens
tcagtaatttttacagagtccatgttttgtgacaaccatctctaatagccaactctttattaaacacactcctaaacaataaggaaccatgacattgctagagtacttgtaactattgtacagtatagaaacctccatttttgccttcgaatgcatatttaagagttaacagaatgaacaaaaaaaagtctgtgtcggcgataactagtgtttgactagcgtttctcaagaacttgcacgagtaacaagcaacaataagcatttttctcaccctcttcctgcttccacccccaaactgagaacatcactcaattgttcgtggaacgaaactgtaggctcatatactaaattctctactttatacatggtactgctgtaatatacctaatcataattacagttctcagatgcagggaccgaagttgggcatttaatcattgaggctttagcgttattctgactgtgatcagactgggccatgtcaaacccggaattttcaccaacagttcactcaccctccgtggtacattgcccattccaaggaattctgagagtaggccaaaccaactttttgccttcatggtcaccagcttctcagcttccttcttatagcgagaaatatggtacactgtccataacgagtccttttactgacgcacttactcgcattttccatcgcctgctggcctcgccgctcttgcgccaaccagaacgtccctcatggccctgatcttccctcagcttcctactgacttgactcccctcttgaacgcccccccttcgccctggcccccctgtcgcacctctcaccgcccttgcgcgcgcgacactccccgggaccgctctccgcatcgctcctcgcgctcccgcggtcggccccacgtcgccgggctcccagcctttcctccgcgattatcaccgggtctgacgaggctttgccgaataagagagggcccccggcggtccactgctggaccccccctcgtacggagccgcccacgtggggcctgccgctcaggtgctctccccgcgcgcgcctccgcgacgatagcgcgggcgccgctctg

SEQ ID NO: 710488 - DNA, 123 bp, Homo sapiens
agactaagcgatgaatgaggtgggctgttcttcctgtcttcctgtgacttgcccccagtcgttctcacacatgctggaaatccaggggcacctctgagtcttcccaggcctccatcctgagct

SEQ ID NO: 710489 - DNA, 177 bp, Homo sapiens
gcgcaacggtcccaactgactgagggcagatggtgacatgttatgtgaggtgttgcccggtgccagccagctactgaaccaaggtgaagagcgctggcgatgttaaacccagacagagatgacaggtctgcactactcagagagtactcgttaccatatgtagaagaaatggctgat

SEQ ID NO: 710490 - DNA, 759 bp, Homo sapiens
tacaagcaagaatttatcgatcacaaatattgaacagtaagtggtcagcaatttgtcgtcgatgattctaagtatcacagtcggtccgcctgctttaacaatttctaaagtgtcgtggttatccatattgttcgactgctatgtgatccgaaagcccagatgaccccctagtggccgagagatggcaacaggatctataagaacacgacgagagataagtaacactcaatgaatatctctgggaatgggactcatgagagtatgctcactgttgactgtctacctttaaaatgtcagaaataaaccctgcacttatagtctggaagtaaagctttacaattactgatatccttatatttgactttacttatcacggacgtgctaccgcctatcaagacactcagtcatttttttaaatatgtcattctccattagtctatagcactgcgcactcgcacttcattcaccatgtcgtactatctgcagaaagaacgtataatgattcattacgcaagcatttggcagaataactgcattgtagaagactgtgagaaggtagttacgaagagaaagcgaggttggcgccaaggactcagatatgtttgtaatgatagaagaagggtggaaggcatgtggtataatgatggtcgcaaagttcttgcactctgaacttgggttgatgagtaccttaaagaaccattccttcactgtactctaaacatgctgaaagaaattccatctgagggggagtggtagcac

SEQ ID NO: 710491 - DNA, 436 bp, Homo sapiens
cgaccgggaacagccgccagaggtagctaggatgacaggcgacggccaccaagccgggcggataaaactataaacagtagagatggggtatcagcgatatcggccaggcgggacttgaaatccggaccgcaagtgagccagccgccgtaggcctcccaacagtgcgtcggatacacggtagggagatctcccatacatgtatcctagagagattactgccagactggaggtcgggttgacaaatggcaaaattctactgaagttcagatgagggcatacatagtataccgtgatagtaaacttaagaatataaggcgacagggtcattgctcttttactgcagcctctaactcccaggctacaagttatcctcccagcctcagcactctcaactgtagccgcttgccatcacacccagactattatactttttatc

SEQ ID NO: 710492 - DNA, 172 bp, Homo sapiens
ccgatgaggactcagaagttcaagctaacatattgttgacattctgtggtacactgtgaaagaagagaaacgggagtcctgcatattgcgtgggacacagtgtgttatcaccagtacatttgaagaaaactaataaagtcttacggtcacaaatcgtctagaatcctctaga

SEQ ID NO: 710493 - DNA, 821 bp, Homo sapiens
tcacacgagagacaacaaaagttgtgtgtcacaaaatcccccccaaagaaccgggggcaaaaaaatggccaccccaggatctgtcctattctccctccagtgccccccccacgagtgtttattctcccatttatacccgccctttaggagaaaccaacgagcccaaccaagggtgacactacgaccgtccccccacgaattaatttcttggggaatctcctcacccccctctttgtccccccgaggaaactcttcacacggcgcttctcgccccactcttcacaactgcgcaaactactccctctctcccgcgccccgacataataaatagaaacattcttcccccgccccaccaaacaaatctttctccctcctaggatgtttttagcaaaaacatgtcagtatctcctggccccccgattgatacagattctattcaacgagaacattatttaaaatgacacctgtggccccacctcctattatgaatcttctcaccgctgagccaccctgaaaaaatggaggctataagcgaatcgcccccaacactcttgggtgccccccagatgtcttcttgaccccctatgtacctctcctttcatgaccacaccagccccctctcctcggtagtcctcgaaccccttaaattgaaaccacgactatttgacgcgcctctaaatagggcatgtacaacaacacctgaatattcccccctccttacaattaggctaagcaaagaacattctttgaatgcatacaacaactataagaaaaagaaaaaaatattccttttccgaaaggaaagggggccaccacataac

SEQ ID NO: 710494 - DNA, 855 bp, Homo sapiens
tgcaagaggagacctcacattcaggactggcctagtgaacgtaatccatgctttaaactggccattaaacagtcccacatggttggatgccctgtttgattgtgcgagtggggcttcaccccaaaccctggttcagagacctcatgcaatatcacttgtgaaagttatttccggttatactacacaaacatggtaatataccggtaatactatttatatattgcaaggtataacacgggtaggcgcttcaaaaaaaacaccctctagtgtgtaggattttacctcagaatctctacaatatacggggagacagacttgtggcaaatacaagcataatctccatagcgtgcttcagataccctcgggagttctaacggggaccattttcccgggtacttttcacaactaaggcctgttcacaaactcattctggacattaagcgtcaatataccttggccaaaaggctgggtttgttggaccagtaagccgcgtggcccaatccttccctatcggtagatagtgcggcgagcctttaaatcacaaaggtcccagggtggcccgtctacccggactctcccgagataaactctttaccaaagtggtcttcctcaaacagggtcgctagaggtcacctctgtgcccgtatgcaccgatttggccaagctctacacagggggccacctatcgaggacaccgcatgggcatctttaaactttcacccagaacttttcgaggtttcacagggtcacgctcgcccttaatttaaattccggcagttgcgggtccaacggacgggggatttagcgtgcctgcaactgcactcaaggcattgttgtcccacgccatattcggga

SEQ ID NO: 710495 - DNA, 173 bp, Homo sapiens
cgcaatcatgtgggcagaataggtctggtgctaactcaggtctatggaacatgatgactcctacttcgctgttcaatgaaaagatctattgcacttatgtttgtgagatgcaaaatataaggcaaatgccttaaataccgtatcatctttcaaggaatgttgaagctcacaga

SEQ ID NO: 710496 - DNA, 834 bp, Homo sapiens
ctgtgggctggttgttggaggagataggctgttcgcctcccccctcctcgggggcgtagataatgcccgggggaaggggctcgccccccccccgttgctgtgtgtagaggggtcgcgcggtggggcgtgccccgcccctcttcgtctctatagtggagggttgctctccctcggcgcacgcgcccccccgcctcttgtttgtatgaagcgtttctccgcgcgggtgccccgcccaccgggggcgcgcctctcttcgtctttgctctcgagagagagataagcgcaccccgccgcctgcccgcggggggggcggtctcctctctcacaccgcgccgcgggccacaccacacagatggcgctgcgcgggaggggcgcgcccacgtctcctcccgcgcgttgtctctccccgcccctctcccgcgcgggcggagcacaatgagaatatatatcctccccgcagatactatccgccccccccccgcctttcttcccgctgctgtgggtgtgagaaaccccgctgctctctcacagacacctttgtgttttctctctctcacgccccccctctaagtgtgttgtgtgatttgtataaaagcagagcggtggtggatgatggagagacacacacccacgcctctctgtgttctacacacctctctctcctagagagaaaaagaataaatagtgtgtttgggccccccctcggttttttttttgtgtgggggcgcgccgttttagggtgtatttgtttttttaacacagcgtgtttttttgtgtgggcaccaccccgcccccccctttttgcccgccggctgttgtgtgggcgccccccta

SEQ ID NO: 710497 - DNA, 283 bp, Homo sapiens
  misc_feature (144)..(144): n is a, c, g, or t
gattgagcgtagaatgatcagtagttcgagataacagttgtgcacttactgtacattatgtacgtcccattggtaagactatcacactgatctgtattggaagactataaggtaatgaggtatgacaagcatatagacacgcanacttgactagacttactcatctccatacatcattcatccagcgctatgcgtgaccactcacatccacacatcatcatactatctacaatttggcgactcaggtacagacccgtaccattacatctggttcttactggcg

SEQ ID NO: 710498 - DNA, 783 bp, Homo sapiens
gaagtcctcgcggatgtcaggcaagattccagaatgaatattatctagaattgccccttgttagatgatcttcccgctgccatcgaaaatgggtcctcagattttccataatacctgctgtcgcctgttccttcccaggcttgacgagctgtgcaccgaacgtcgtgtcccagaccaagggacgtagcgtagagacggttaggacgcaataacgcgaagtagtagaaggacattgttagtgggttgggtggatgggtgttcgcagctctcattttggctgtctggcacttcatataacaggcacgctgactcgcgcacatgacttgttggctgagagcatgccgctgtcacagggttggtgggtcgagtcggaccagtagtccctaaggaagtagtgtcgattatatctatctttggtacagttattcaggaagtgaaaacaagcaatgttggctacgacgaggctgcccttggagctggcgttctctgactaagactccgtgctcacactgtcaccatgggcttgtatctctgtcgaaccaagccatgaccacaggtgtgggtttgatggcttctggccagtgtgatgtgatcgtggcaggtggtgttgagttgatgtgcgatgtgcctattcgtcactcaaggaaaatgaggaaaactgatgcttgatctcgaataagggcaaaatctatggggcagagaatggctttaatcctaaattccgattgatttcctagcactgaattccggggggcttggttccaccagtggacacggcacctt

SEQ ID NO: 710499 - DNA, 136 bp, Homo sapiens
ttcttaggctttacaatcaccctcacgaaagcagcaactccgctttgcacattcctcagtctgctttaatctctccagcgcttacttactacctgatgtgctccatggccatactatcagtctcctcatacataag

SEQ ID NO: 710500 - DNA, 453 bp, Homo sapiens
ctgtgcgttgggacggcgggggcaggagcgtgagcatcggcagcagctgcctggagcatcttttgccttggccatgtggagccttgccccaactctacgggctgagtctctcctccccaggggctggagtgacagcacaggccccatgacaccaggtggcatggtagggtggtgggggaaggctagttgaacccaaggcaccatcactcacatggaggggctaatagaaaagacaggaggacagacggatggtcacctttccctctagcccaggccaagaaaaaacccttgagggtccaaagctccttgtccccatgcacgctggtaagcgagccagtcattctctcagcctggccacagatcccctgctcagtgcctggagactgcccaggcaggggctactctgcagcaggcaggccaaaggccccattgtgccgccgtcccaaagcacag

SEQ ID NO: 710501 - DNA, 283 bp, Homo sapiens
cattgtcccgctttactcatgtctcccgctttactcatcgtctcccgcactacaggaaatttatccgaaaacaaaacacaagcagttatagaaccccattctctagcatcagaagtaatttcagagcaagtaaacttatgaggtgacaaccagacatacttgaacagttaaggatgggacgaagaggcttaaggatatcacccaaattaaacctgtacagtgcagacaaagccttggcgaaagggcagggtcaaacaatcgatgcaagtcccagcatccagtg

SEQ ID NO: 710502 - DNA, 815 bp, Homo sapiens
gcacaggtgtcagtgagaagtacccctagaagccaacaatgggaaaggaagcagactcatatcgaacatgtacgtcattggacacgtagattcgggcaagtccaccactacaggtccatctgatctataaagtgcggtggtcatcgactataagaaccattgaacagaatttgagaaggaggctgctgagatgggattacgggctgccttcaagtatgcctgggtcttggatgaaactgtagacagcttgaggcgtgaacgtggtatcagcattgagtatctccttggtggaaatttgagaccagttacagtgactatgtgacgtatcgatttgatgccccaggacacgagagactttactgcaaaaacatgcatgtacaggggacatctcaggcgtgacgtgtagactgatccgtgagttgttcgctgctggttgattggtgacactatgatatgctgggtactctccacatgaatcgggcatgaggccgatgacgcatgcccttctgagcttagcaacactggagatgatgcaacatcaatgtaacatggtcggtgtgtgctcacaacactggattcccacatgagacctaccctacacgtccagacacacgactactgacggacaacttggttaacggacatgtcagcagcgtgcaccatgtacagccaacgacatgacgcgatacaaaccaccgtaaaaccagcacagccagtactgatggccacagcgtacctggatatgggaaatggttcgaccgaacgatgctggcaagccaacgcgcgacaccactgccctgggactcaaggggatg

SEQ ID NO: 710503 - DNA, 227 bp, Homo sapiens
gctccctcttcattcctctccttctcacatctgaaaaaaggcttctacagaccacagaggcctggtgtgaggggtaggagtcaggtagttcagtatgaacgagggaggcacgcagcaggacactgaaggagaaggtggtactgaggaaggcctgggatatttaaatccttctgtctgccaaagacaaaaataagacataaacatcacaacagtgtcctggcttccca

SEQ ID NO: 710504 - DNA, 332 bp, Homo sapiens
agtgtggtatgtatagggactgatcagaaaatgttttaaaaattaggctgggcatggtggctcacaccctgtaatcccagtactttgggaggccgaggcaggcggatcacttgaggtcaagagattgagaccattctggccaacatggtgaaaccccatctctactaaaaatacaaaaattagctgagtgtggtggtgcatgcctgtagtcccacctacgcgggagactgaggcaggagaatcgattgaaccggggaggcggaggttgcggtgagctgagattgtgccactgcactccagcctggcaacagagtaggacttcatctcaaaaa

SEQ ID NO: 710505 - DNA, 346 bp, Homo sapiens
tggactacagaaatcgcatcacatcatctactagacaactatcaagatgcacattcttcaccaaccttatgatggctggcactgacctctggtgtattgtctaccctttgatcaccaggttgatgccagtcatacactgtcttcgtcataccaattatgccaggtgaactcttccagcttactcaccattccttttgcacctctctcacttagactctaggcaactttgctgtgcttacacatgtaccatactggatgggcagaaatctgtgagagcttacccctctactgatatccttctattcaacaagcttctctgggggcgtgggttcacaccaggccaccc

SEQ ID NO: 710506 - DNA, 442 bp, Homo sapiens
tcaactagatgaacccgaggaatcgcttatcaggaataagtagtttgcattcccacaaaaagcagaggcagctctttgccacagagcgttccctgtagccacccccaccccactggcccttggttctttagaaggagcacacacatgccttgattcctccctgatgtggtaaagtggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaaattaccctctagctctaaca

SEQ ID NO: 710507 - DNA, 109 bp, Homo sapiens
tcacaaaaaaaaagttaaactcttcttttctttttatgataatgaccagcttttggtatttcattgttaccaagatctatttttagaataaaattgttctccttctaaa

SEQ ID NO: 710508 - DNA, 302 bp, Homo sapiens
gtgattaattagccagtcagaggttaagactctggagaccacaggtcaagttctgctctgaaggtccgtttctctgttaacagtgcagtctccatggcctgatttgtctttgacaagtagattggagggttaatcttccactctgccgtgtggggagtctcggacctttaccggtataattattcgattgaatggcttcagctttgggagcctacagctagtctcaggtttgaaacttacttctagcaccacctaaatctcttttttgcttttcctagatctatgagagtctccgtcgaact

SEQ ID NO: 710509 - DNA, 268 bp, Homo sapiens
tcccaaaacccggtttttaatgagggggccccaaaaaaccctttttctcgggggggggaaaccttaaatcccaccccccccagagggggagcccccccccccccccaatttgttcccggggcccccccttaacccccccacacccccggggcaaaattttacaaaaacccccccccccccccaaaaatttccgggggggcgcgcccccaaaaaaaaaaaacgcccttttgggttccccgggaaactttgaaacaaaagaccccaaccc

SEQ ID NO: 710510 - DNA, 937 bp, Homo sapiens
  misc_feature (937)..(937): n is a, c, g, or t
aactccaccatgaaccgctatgtattcctcatagtactgatagctaatcgtgaatatgtcctaatgcttacctacttggaacatctgaggtaatttaaaactaagcacagatcacaacgtcgtcctcatgttatggagagtaaatgtacagccttatcgacatgcactcaaattatacactactatcaaacatggaagctccataagatacaccgcctacaatctattcagtgcatcctacattaaaatcctaagccaaccgcattatataaggtactatagctatcgtatcagtctaatttatggataccatagtacattaaagtacaaatcctgtttctcgtctccatgtatgacccccctcagtatcggggtcccttgaggcacaaatccgtccgtgaaatcattatcccggacaaggagtgctaacatctcctcggcatccggggcctataacacttggggggtagctaaacccgtgaactgtatcctgatgatcgtggtcctacttcagtgtcataaatgcctaatatacgcccacagtgttccccttaaataagacatcactgattggaatcacaggtctatcactcctatttaacacttcacgggagctctccaggcaattgggatagtattccgtctgcggaggtgtgcacgcgaatagcaatgccgagacgctgatgccgaggacaacccagacaaggtacacgcatcaaaccgacttttgcggacgccgtccacaagaaagtctagccgatcgggagggtcggcccaaaggcatgacattgggctctgggccagaaatcgggctccccggggtgacccaatagacaccggggacaggctgaaacacaagagtgggctggtaaaaggcacgtgaaccccgggggaaagtcacacagcccaaaaaaggccaaacgaagaaaaacacggn

SEQ ID NO: 710511 - DNA, 156 bp, Homo sapiens
cagtcggccagtgagcattacgtgtgtgagctcggccccctgccagagcattactgtgtgagctccaccccctgccagtagcattacgtgtgtgagctccgccgcctggcagagcttcacgggtttgtgctcagctcgcgtttcagagcttcaggg

SEQ ID NO: 710512 - DNA, 369 bp, Homo sapiens
ctataagtgctcgaacaaaagaaaacctgtaacagaccttactaatcaccttaaaataatctgctccaggttataaaatcttaaaacttgagagctgaagtcagagtacatactcacctctttcaaattatatgtgtgtgtgtatgtgtgtgtgtgtgtgtgtgtgtgtgtgtgtgtgtgtgtatgtgtgtattcctgagtcaccatgaatacctttaaaaaattctagacctttgggccaggcatggtggctcatgcctgtaatgccagcactttgggaggccgaggcaggcagatcacgaggtcaagagatcaagcccattctgcccaacatggtgaaaccccatctctactaaaaatacaaaaatt

SEQ ID NO: 710513 - DNA, 1354 bp, Homo sapiens
  misc_feature (971)..(971): n is a, c, g, or t
agcggagaggcgccatcttgtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccaacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaacaaagaaaaatcaactcactgttcagtgctgagaggggatgtaggcccatgggcacctggcctccaggagtcgctgtgntgggagagccggccactgcccttggcttttagagctgtgtttgaaaatccattttggttggttggttttaaacgccaaagtcatgtgcaattttttaacaaatacgttaaatgaatccaatgtcgagaacacttttgaaacacacatgaagtggatgacccctgcctaaagcataagattttgcagttaacggtgcgtggaatgccagtctgccagcccaagcctgttccccttcggggaaacattgagcgtggttggtggcgcaagacagacttgcgaatcaaattctgcattggtcacagtatgagatccccggcaactcgcttgtccttgggtacacccttgaattcccatagccatgtgcttgtcccctgttgctccca

SEQ ID NO: 710514 - DNA, 1115 bp, Homo sapiens
agcggagaggcgccatcttgtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccaacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtgggcaacgtgcacgactcgatgactgatgagtcgccagaagcctgactaccgcgcagcacagcgacacccgatgctgccatctgcacccgcatccatgtaacactcgtggacagaacggcacccctgcgccaccaaggctatacaacatatcacctggacacatagctacacgggcaacccaaatgaaggcaagatccctgaatcacatcatacatcgcaaacagagaaacacagaccacagccgcccacccgcacccaaacgcagccacaccacccgaccacaggaacacagcgaccacgagccaacgccgcatcgtaggccccacgcgagcccacaagagccccagcgcagcagacgccgacagcggagagccaccgcacgaccccgcgcgaaaaaagcgcagcccgcaaaccat

SEQ ID NO: 710515 - DNA, 221 bp, Homo sapiens
cttacagtccccaacccttactaagacatcagattgcgttatactaggcgaggaaccatacgaaactgctgagtgaatgtggcatggccttttaaccgtatcctataacaacttactgaacataagaaaatttacactagagagaaagcctacaaatgtgaagaatgtggcaaagcctttaaccagttttcaacccttattacacatagttcagcgtctga

SEQ ID NO: 710516 - DNA, 454 bp, Homo sapiens
  misc_feature (142)..(143): n is a, c, g, or t
  misc_feature (146)..(147): n is a, c, g, or t
  misc_feature (150)..(151): n is a, c, g, or t
  misc_feature (153)..(153): n is a, c, g, or t
  misc_feature (162)..(163): n is a, c, g, or t
  misc_feature (167)..(167): n is a, c, g, or t
  misc_feature (170)..(170): n is a, c, g, or t
  misc_feature (176)..(176): n is a, c, g, or t
  misc_feature (181)..(181): n is a, c, g, or t
  misc_feature (196)..(196): n is a, c, g, or t
  misc_feature (204)..(204): n is a, c, g, or t
  misc_feature (213)..(213): n is a, c, g, or t
  misc_feature (228)..(228): n is a, c, g, or t
  misc_feature (238)..(238): n is a, c, g, or t
  misc_feature (244)..(244): n is a, c, g, or t
  misc_feature (248)..(249): n is a, c, g, or t
  misc_feature (285)..(285): n is a, c, g, or t
  misc_feature (292)..(292): n is a, c, g, or t
  misc_feature (294)..(294): n is a, c, g, or t
  misc_feature (329)..(329): n is a, c, g, or t
  misc_feature (333)..(333): n is a, c, g, or t
  misc_feature (350)..(350): n is a, c, g, or t
  misc_feature (366)..(366): n is a, c, g, or t
  misc_feature (369)..(369): n is a, c, g, or t
  misc_feature (371)..(371): n is a, c, g, or t
  misc_feature (375)..(375): n is a, c, g, or t
  misc_feature (378)..(378): n is a, c, g, or t
  misc_feature (385)..(385): n is a, c, g, or t
  misc_feature (388)..(388): n is a, c, g, or t
  misc_feature (402)..(402): n is a, c, g, or t
  misc_feature (423)..(423): n is a, c, g, or t
  misc_feature (426)..(426): n is a, c, g, or t
agcggagaggcgccatcttgtgggagcaaaaccaacgcctggctcggagcagcagcctctgaggtgtccctggccagtgtccttccacctgtccacaagcatggggaacatcttcgccaacctcttcaagggcctttttggnngannagnnangggcgagtnngggnggngggcgnggggnggggggggggggggngggatggnctggggggntaggggggggggggnggggggcacnattcgnagcnngggggtcagggggggaacgggggggtgcaagagcgngggcttnanggggggggggggggggggccggggcagggtggggngccnggggggccagtggttgngggggggggaaggggnggngntggnggngggcggnggnggcggggggggggngggcggggggcgggggggggncgngggggtgcgggcggggggggggctcgcg

SEQ ID NO: 710517 - DNA, 169 bp, Homo sapiens
ctgtcgatggtgcatgatactaggaccgcagcctgtccggcagcagccagagccgagctgctgcagaggcgattcagaagctccctcccctgcccgggacagagacagacaagatgccagcgcttgttgtccctgacatcaaggagatccgagtcagcccgactcgttc

SEQ ID NO: 710518 - DNA, 1320 bp, Homo sapiens
  misc_feature (937)..(937): n is a, c, g, or t
gctcggaatccctgaagcagcctgcagagcccatcctagccagggcccttatacatgcacacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccaacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaacaaagaaaaatcaactcactgttcagtgctgagaggggatgtaggcccatgggcacctggcctccaggagtcgctgtgntgggagagccggccactgcccttggcttttagagctgtgtttgaaaatccattttggttggttggttttaaacgccaaagtcatgtgcaattttttaacaaatacgttaaatgaatccaatgtcgagaacacttttgaaacacacatgaagtggatgacccctgcctaaagcataagattttgcagttaacggtgcgtggaatgccagtctgccagcccaagcctgttccccttcggggaaacattgagcgtggttggtggcgcaagacagacttgcgaatcaaattctgcattggtcacagtatgagatccccggcaactcgcttgtccttgggtacacccttgaattcccatagccatgtgcttgtcccctgttgctccca

SEQ ID NO: 710519 - DNA, 1540 bp, Homo sapiens
  misc_feature (1157)..(1157): n is a, c, g, or t
tccatggcctgctattctcgaactcctgacctcggtgatccacccacttcggcctccaaaagtgctgggattacaggcatgagccactgcgcccagctgaaggcagacatttttaaacgactgcacacagtgaggctgcacacaagcatgaagcaaagagtggttctctggctttgcagtccccttgtctgtaacccagaaatcagacagaagtctccaaaacctagttttcgctatgcacaccactaatcgctaatgcacaccactctactgagcagcatttacatctgcagtccaagaaatataaagcagaatccctgtgtcaggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccaacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaacaaagaaaaatcaactcactgttcagtgctgagaggggatgtaggcccatgggcacctggcctccaggagtcgctgtgntgggagagccggccactgcccttggcttttagagctgtgtttgaaaatccattttggttggttggttttaaacgccaaagtcatgtgcaattttttaacaaatacgttaaatgaatccaatgtcgagaacacttttgaaacacacatgaagtggatgacccctgcctaaagcataagattttgcagttaacggtgcgtggaatgccagtctgccagcccaagcctgttccccttcggggaaacattgagcgtggttggtggcgcaagacagacttgcgaatcaaattctgcattggtcacagtatgagatccccggcaactcgcttgtccttgggtacacccttgaattcccatagccatgtgcttgtcccctgttgctccca

SEQ ID NO: 710520 - DNA, 608 bp, Homo sapiens
  misc_feature (29)..(29): n is a, c, g, or t
  misc_feature (88)..(88): n is a, c, g, or t
  misc_feature (96)..(96): n is a, c, g, or t
  misc_feature (127)..(127): n is a, c, g, or t
  misc_feature (132)..(132): n is a, c, g, or t
  misc_feature (136)..(136): n is a, c, g, or t
  misc_feature (237)..(237): n is a, c, g, or t
  misc_feature (239)..(239): n is a, c, g, or t
  misc_feature (294)..(294): n is a, c, g, or t
  misc_feature (344)..(344): n is a, c, g, or t
  misc_feature (396)..(396): n is a, c, g, or t
  misc_feature (430)..(430): n is a, c, g, or t
  misc_feature (433)..(433): n is a, c, g, or t
  misc_feature (503)..(503): n is a, c, g, or t
  misc_feature (507)..(507): n is a, c, g, or t
  misc_feature (524)..(524): n is a, c, g, or t
  misc_feature (528)..(528): n is a, c, g, or t
  misc_feature (564)..(564): n is a, c, g, or t
  misc_feature (585)..(585): n is a, c, g, or t
  misc_feature (587)..(587): n is a, c, g, or t
ggatccccacggggatagtgcaataaatngaagccttaagacatttcatgtgttttataaaagaaactcagttagtttacttaattangacagtanaatagcagcaagtaccaagacatagtgcatntcttntatntaagacaagttacttcatttacatcagagttagaaatgttaagactggctttcttgaatacttaaatatagctcgaatcactggttagatatggacatatntncccaactgtacatcagggaggagtgctttcattagtttcagaaaatgcagacccncagacagccagcatgaccacaacattgagcaataagagaaatgaagcatntactttccaagcatttgccacagaaggtaatggagtctttacatttgtggtngtctcttccctccataagttaagggttgtgcttngtngaggcatttcagagaaattatttggcatgccactagtgatacttagggtcatgggtgtaggggatgattntgtngagctagtgaggcttgngttngtgaccattccatcttggagatgaatagttagagtngcagctgctgcttcatgtgantngatagtctctgtggatgtatc

SEQ ID NO: 710521 - DNA, 349 bp, Homo sapiens
cctctccagcacacacactaaactagaaggtagattacagaatacatgacctaaattcctggctggattaagggcagacaaaaaaatcttgaataaacagactgcccagctaaatcccaaagcatatatttcagtggtagagagactgagatgaaagaaaggtaaatccataggtattaacagtcaagaagatactgtataatagaagaataaaagatgacccaaacactagaatgttaacagtaaaagaatttgaatgagattatttgtcttgaaaaaatacaactcccacttctttttttttggagacagagtctggctctgtcgccaggctggagggggccgcgcg

SEQ ID NO: 710522 - DNA, 229 bp, Homo sapiens
  misc_feature (93)..(93): n is a, c, g, or t
  misc_feature (215)..(215): n is a, c, g, or t
agtccagagtaacactgatggctcagcacggatccgatcagcaccaggttcttgtctgtaccaagttggtggagccttccacgcccaggtggngtcccctgtacatcgtcctcggggaactccagcatcagcaaggacagaggctccgtggtgaaaggcgcgcgtgcttgaccttgtgttggaggggatgaaccttgcccttgttgggaacaagncatcccgggaagca

SEQ ID NO: 710523 - DNA, 175 bp, Homo sapiens
gcttcgcaggactttcgtggagtagtcaacatgagctgttggagtgaactcttcagcatgcctgcacacccggtaagaaactctactctagaaaatttatgggtcgactgttacagaagcctcaggagtacagttctggcttttccttgatgcttgtttgtagaaagaattggac

SEQ ID NO: 710524 - DNA, 391 bp, Homo sapiens
gagtatccggaggcgccatgtagggacaccagcaccgggtcgcactcttcatttctgtatttacccaaccaataaactgggtctcctggatagcctacaaatatagccctataaagaatgctatgtcgaagcatgacgagtagtagttgacaaactggaataagaacatcttcatggtgaggctgttctccatcaatccagtctgggtcctatgggcagttcgcaagttcagtaatccatcacattgcccactttttcatcatcatggatgttcagcaatcatgcatacattcataaagctgcatgatggcaggcccgtgcatggcacgtgcgatgatctgtggcagtccaggtcatatctcggcattgggtctagttcccatatacaagg

SEQ ID NO: 710525 - DNA, 549 bp, Homo sapiens
ggcgaagagtctggacagtagacgtagtcaacggccatcacacttgggaatgccagtgatcgctctcagtctatgagttctccgaactccatgagtgatagttggtctcaatagcactctgtcacactgagcccttcttggtgggctgacattctccagattggtgactggaccatccttgggtctgcttgtcaaagtgtccttaagagcatagacactcacttcatatttggtggccaccataagtcctgatacaaccacggatgagctgtcaggagcaaggttgatttctttcattggtccggtcttctccttgggggtcacccgcactcgatatccagtgagctgaacattgggtggtgtccactgggcgctcaggcttgtgggtgtgacctgagtgaacttcaggtcagttggtgcaggaatagtggttactgcagtctgaaccagaggctgactctctccgcttggattctgagcatagacactaaccacatactccactgtgggctgcaagccttcaatagtcatttctgtttgatctggacc

SEQ ID NO: 710526 - DNA, 130 bp, Homo sapiens
ctgatgtgctcctatgtactgtgacatatagtgcatgtgcatcatgcctgattcatgataactcattttctattatcccattgaaggtaggaggaaactgaagctcatagacgctaagttcatttaccca

SEQ ID NO: 710527 - DNA, 347 bp, Homo sapiens
  misc_feature (95)..(95): n is a, c, g, or t
ccgtatctctacattatctctaacattatgtgttcatttcccccaagtggcaaattaagacaataatccgctgggcgcggtggctcacacctgtnatcccagcactttgggaggccgaagtgcgcagatagcttgagctcaggaattcaagactagcctgggcaatacaacgaaaccctatttctacaaaaatacgaaaattagccagcgctgtggcacgagctgtagtcccagctacttgggaggctgaggtgggaggatcgcctgagcctgggaggtcaaggctgtggtgagccatgatcatgctactgtactctagcctaggcaacagatgagaccctatctcg

SEQ ID NO: 710528 - DNA, 123 bp, Homo sapiens
gaaccgcgtcccagggatgagaaagtgctcatggctaggactgcaagtatgagccaccacacctggcggattttgttcttaatcctgtgtatgtggtggatcacacttctgaacagtgacagt

SEQ ID NO: 710529 - DNA, 211 bp, Homo sapiens
ttgcacaatcagaattgataggcagtgttcctccactccatttagcaattatgtcacccttcagtcatgcagttggtttttgaatgtctcacatgcgttttaaggataaactcctttatggtgggactatgtgttattcttgtatacttgcagtgggtagatgtcactaaatgttacgtacacaaataaataaaatgtttattccttggta

SEQ ID NO: 710530 - DNA, 363 bp, Homo sapiens
cccgcggtctatgagcacagccgctctcagggctgcattccatggccagccctgggctccacccagacttaccaaactggacctgcccaccacttgccaagagatcacatctgcctgggctcaagaagcctcaagagcttcatcagactgatccaaccatgcagattcttcaaggagctcacttatgactctctcgcaatctattgggaatcacttcttctggagtccatgaatccggatccacaaagggaattccaaaaacatcataagcgaagaaaagcagttctttttccagtaggcttcgctgtcggtactccttggcactctcacggtggccgatggaactggcgtgttcttctccaa

SEQ ID NO: 710531 - DNA, 288 bp, Homo sapiens
gctcaagagcggattgagggaatgtcactaagaaggaggatcatgggattgcagtgtgtgcttagtaggaaatgaagccagtgctaccaaagtgtattgcttgtcagaatccaggttaacaaaatctaactacttctgcagtttcaacacctgcctcttcagagactagcaaggctccgaagagcggatttgagggaatgttcactaagaaggagggacagtgggattgcagtgtgtgcttagtaggaaatgaagccagtgctaccaaatgtattgcttgtaccgctg

SEQ ID NO: 710532 - DNA, 842 bp, Homo sapiens
ggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggagagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgccatgaagaggcccttccggccgccgcccggagcacttccagcccggcaaggggctcttcggggccggaggcgccgcaggcgggtgcggggtggcggggcgccggggccgacgggtaacgggttacctggcgccccccaaagttacctggcagtcttggcttcctcaacaactcgtggccgctaccgcaagcctcctcaaccattgccctattgctctgccagatgggggagac

SEQ ID NO: 710533 - DNA, 1111 bp, Homo sapiens
  misc_feature (416)..(416): n is a, c, g, or t
  misc_feature (574)..(574): n is a, c, g, or t
agcgagtcaccttgctcatcatgggcccctgtgtccatggtccatgtttctaccgaggcgaatggtcgtagtctggaaggatcctcctgagagggctccatgcaatggacagagtctgtataagtgatcagttgacgtagggtgacctgatgcatccaccacatcctggtcgttgtgcgactggaggaccagcacacgagccatcgatcatcgttggaacacgcgattaaacgactgatgtgatcagttatctatcacagcgggccggaggcggggatgcggcttccatggatcagattacttcctattcaaccaacgaaggaagctatcggtgacgtcgtgtcgaccatgtctgagcgctcgagcgcggatgtacccgtggcacgggtgaacggcagactggttggcgggcctgnatgcccgcagtacctgagaaccatggcacagcaataggaccatgcctgggccacaggaacgctcggcgcccgaaagtgtgtgcgcaccaatgcctacgtggcaagaacaagctcacatctaacagcgaggcttcgcgctgacgcaagcttctcgacanagttagtcaagcccgcgaaagaaagatcgtaatctccatgcaggtgtgaaccatggtagatatccccgtggctacatagcaactcccacgaagcgcaactggcaagggcaagctctaacaagagccctccacgtggggatccttgcgtgcgtagatggaaactggcgttgtcgtaactaccgacggggcacgtccatttggaacaggattcatggtcgggttgcaccgggaaagcgcggcaagagtagagcagaaaagactctgggcgtgtgtggttgagtgccacccacggtggaccttgaaatcttctacgcaacttatagggaacgcatgctgtggcaacaccttgtacacagggaaccccaccgtgagaatgtactcgccttagagaaaataggaccggttggagcactacgagaagagtcggggccgaaaggccttggaacccaggcgcttagccccaggggttagtgatgtggttccgcaacagagcgcaggatacgaagggctccttcctcaagaagctcgggagactgg

SEQ ID NO: 710534 - DNA, 204 bp, Homo sapiens
cagacaggtgaatgggattgatggacctgtgtcagagactgaacagaaccaacagaggggaacaagtgagaacaggacacaggaagaggacactggaatcaattcttgagagttgcactactttggttgttcttccagttccaagatttcgatgggacccagaagccctctttttcgttttaaaacgctaaaacaagcaaatgt

SEQ ID NO: 710535 - DNA, 353 bp, Homo sapiens
accaatcctggtgctgatcgagatctgccccgctgggccaccgaagctgataaagccgagcttgagccagaacagaaaagcctgaagcaaactgacaggctcagtacttggcagatcctgctctacaggtggcagtgtggtctcattcatcagaggtctcttctttcacgaatgccgcgagcagaccatcgaagatggcgcaagcagcggtcagcaggtggtcgtcattgaggatggtctcgcgcagcccagccaatacacgctcgatgccaacagcctcggcgggttgaacgccaccgatatccaggtaatgcaccaaagcagcgatgcggcttaggcctggctcgaccagt

SEQ ID NO: 710536 - DNA, 357 bp, Homo sapiens
gcaggagaatcgcccgaacctgggaggcaaaggccgctgcgagccaaggttgcgccaccgcactccagcctgggcgacagagcaagactaaaaaaaaaaaaaaggaaaaatttttgtttcagaaaacctacaacgcacacatttaggggagaaatgtgggaagcattctttttaaggaatgagacagggatggctgctattgccactttgtttaatggggggccttaggaaccacacagggaactaaagttttggttttcttttgcaaattgtatgactgtttatagaaaattcaacaagacaggggtgggggctaacacctgtaatccaagctctttgggaagaccaggcaggcag

SEQ ID NO: 710537 - DNA, 473 bp, Homo sapiens
cgaatccgtacttttgctcatagctcgtcccggtgtgaaaaaccacttccggaaagccgaaccagtggcctgagcgagtcagtgcgaaaaacgcgccgatactgtccgcttcttgactaatgggcttgagcacgagcgaaagtctaaacctgtcaattttgacagtagccaagatcttgttcacaggggttagatatctacacgctcaggaacagcatcctgtaatgctcgcctacgtgctacccggagaacgccatgtctagtaaaaacagcaagccggctaccactaacagcaaaaaggtgtcgtcgataaaacccaagtttcttgacaccccgcggattccagggatgtccccagcgtttaaaggctatgacggtggtatcgcgcagtggttgttgttcggaggattgaccgttgcagtggataaaaactgggcggccaagcccaaggataagatccaagtgcttgtcat

SEQ ID NO: 710538 - DNA, 422 bp, Homo sapiens
  misc_feature (110)..(110): n is a, c, g, or t
  misc_feature (185)..(185): n is a, c, g, or t
ctctagaggatcacattggacgaatgtgcgaggtagaggaggtgttgaccacttggaggggcccgtttgaacaagcccctggtgggcaggtgtggttagcaatgccaggnagggttgggggtgcaggctgcacatagggcaggacaactcagcatcccccactggaaggaggagggctgtggctntgccatccaagggatactgccacactttttattctccacatcagtgctcgcttccattggcacagataattaacaaacattgatggtagctcattagctaattatttctggctcatgtttaccaagtatactacaggtattttgggcagatcatcctgctgagagctaagttctggaaaattcctcagaaagatagacttttgatacataagcttcccccactttttgttttgcaaa

SEQ ID NO: 710539 - DNA, 424 bp, Homo sapiens
  misc_feature (32)..(32): n is a, c, g, or t
  misc_feature (40)..(40): n is a, c, g, or t
  misc_feature (74)..(74): n is a, c, g, or t
  misc_feature (257)..(257): n is a, c, g, or t
ccaaagtgctgggggattataggtgtgagccnccgtggcntggccaaaaaattattgataataccaattttatncctcaaatatagtgtagaaaaaccattttagagcttagttatttgaataatcaaaaataagtttgttggccgggtgcagtggctcatgcctgtaatcccagcactttgggaggccaacacgggcggattgcctgaggtcagaggtttgagaccagcctggccaacatggtgaaaccccatttntgctgagagtacaaaaattggctgggcatggtggcgaatgcctgtggtctcagctgcttgggaggctgagacaggagaatctcttgaacccgggaggcagaggttgcagtgagctgaagacgcgccattgcactccagcctggaaaacaggtgtgaaattccgtctc

SEQ ID NO: 710540 - DNA, 334 bp, Homo sapiens
acgacagggatacattctgagaaatgcagcactaggcaattttgtctttgtttaaacaccataagcttacttacccaaacctagagtggtgtagtctcctacacacttaggccgtatggtatagcctattgctgttaggtagtctacagacctgtacagcatgttgctgtactgaatactgtatgccgttgtaatacactggtatttggatatctaaacgtagacaaggtaatacattgcactgttatgttgtaacagctgtgacatcactagatgatagaaatttttcagctccattataatcttttgggaccactgttgtatatgtagttcc

SEQ ID NO: 710541 - DNA, 476 bp, Homo sapiens
tcttattacgcaggtgataagctctctctccagtgtgacttgctgatgttgaatgaggttacctttgaccaaaagatttcccacattctctacactcataaggcccttctccagtgtgaacaagctgatggctaataaggctgcccttctgactaaaagatttcccgccttctccacacttgtaaggcctttctccagtgtgaacacgctgatggttattaacgcagaatttctgacgatcagattgcccacattccccacagtgataggctctctctccagtgtgaccttgctgatgttgaatgagggtacccttttgaccaaaagatttcccacattctctacactcataaggcccttctccagtgtgaacaagctgatggctaataaggctgcccttctgactaaaagatttcccgccttctccacacttgtaaggcctttctccagtgtgaacacactgggttaagtaagca

SEQ ID NO: 710542 - DNA, 287 bp, Homo sapiens
gcaggactcgagaccagtctcgtcaacatggcgaaaccctgtctctacaaaaaaaagaacaaaaaaaaaatttagccagacttggtggcccacttctgtagtcccagctacttgagaggctgaggtggaaggattgcttgaacctggggagcagaggttgcaatgagctgagatcgcaccattgcacttccagcctgggcgatagagcgagaccctgtctcaaaaccaaacaaaaccaaaatgaagatacaaacttcacactttagcctaggcctaggcagggtcag

SEQ ID NO: 710543 - DNA, 163 bp, Homo sapiens
tggagcagagagggcactaacccaggctgacgccaagaatgaaggtggcccactgcatgcccctggtctgagcaggtcttcttgagatttgacatgctgctagagcaccccctatactcccacgatgtcctctcagcctacctctcatgcttacgtctgtcac

SEQ ID NO: 710544 - DNA, 515 bp, Homo sapiens
  misc_feature (382)..(382): n is a, c, g, or t
tactgatcccgagtgattcacgactctgagcaacctgtccgcatggatgtacaataaactcagtgacaacaccgaatgctggtgaggatatggagaaagtgaataatcagtgcccagattactctcttacatgtagaatggtacagccactctggaaaatagtgtgacagtttcttataaaaccaaacacataattaccatacaacgcagcagttgctttcctgggcatttgtcccagggaaatggagaattatgtttacataaaaacttgtacgagaatgttcacagcagctttattccctaatcgccaaacgctggaaacaacccagatattcttcaatggataagggattaaacaaactataatacatccataccgtgnacaattactcaacaacaaaaaggtattacctattgacacacaactcagttaaatcgtcagagaaattacactgggtggcaaaaaaatccacaaaggtaacttactgaatgattccattggtataacattcttg

SEQ ID NO: 710545 - DNA, 235 bp, Homo sapiens
acgccctgcatgggaatgtaggcccataagcacttaacaaacagactcaggaaactatacagtagacaatgacatagctaaaccagaactctgaaaaagcgatacatatttcagattcacactatgtacaaagcagaacagtcatgtctggcatgaccttaaggttcccataaacactaactgtgtttcatgttttcgacacccctggcagctgtgccacgtttaccagcatcag

SEQ ID NO: 710546 - DNA, 321 bp, Homo sapiens
atctagaggatccctttaacctaatcgcaagcatttcgtcacagaaagtctcaccttggaccaacctgacggcggtccctttggagttgcgatgaagctacgccgcctttgtgcattcgccttcgtccccacactcttccttacttcaatcaacctgcacgctgaacagttgggccaatatggcaacacctggaatattcaggagcaggatgcaatcgacatgatcaaaggtcggttaggagaaatggagaaaagaggggagctcacgaaatactggaatgactaccgcgacacacaactggccgggcgattagggttagt

SEQ ID NO: 710547 - DNA, 167 bp, Homo sapiens
cccccccccttccccccggggggggggggcctttttttttgggggggccccccccccgttggggcccttttttgggggggttggccccccccccccccccgtctatatgggacagaagcctaaacagataatgtccatgttttgtgtaaatgaaaccccccccccca

SEQ ID NO: 710548 - DNA, 563 bp, Homo sapiens
actcttgtatcgcaggtattgacttgaatagacaggcaaaggagaggtggaggaggtgtcgggctagacactattggaaattgtattccatccaaaagacaaaaaaatctcaggccgggcacggaggctcacgcctgtaatcccagcactttgggaggccgaggcgggcggatcacgagagttcaggagatcgaggccagagctgtacaacatggtgaaacaccatctcctactaaaaaactatataatacatatagatatgtgtgtctgtgtatttatatgtatgtatgtatgtgtgtgtctatatattatagtatatatatgctatgatatatataataatcgctgacattggagtcataaatcagacctaggacagaccaagagagaacaggaacaaacagcagagaatgaaaaaacagaatagcacgagacaaagcgaacaataagaggaacagaaaaagcacaagccagaaacagaaaagaagaaggagagacgaaaagaagcgaagaaagagaagaaagttaacgcaaccaagaggaacagagagagaagaaccaca

SEQ ID NO: 710549 - DNA, 159 bp, Homo sapiens
  misc_feature (22)..(22): n is a, c, g, or t
  misc_feature (27)..(27): n is a, c, g, or t
  misc_feature (32)..(32): n is a, c, g, or t
  misc_feature (46)..(46): n is a, c, g, or t
caaacgactgaagtcggatatnccaanagtgnaaatttccgagccnacggagggccaaactaggggggcccgagcgagctatctaccggactgtcgggaggacccaagtgtgaaagggggggccgggccctctccgggggcaaggcccaggctttccct

SEQ ID NO: 710550 - DNA, 900 bp, Homo sapiens
  misc_feature (8)..(8): n is a, c, g, or t
  misc_feature (900)..(900): n is a, c, g, or t
aacaccanagttcaagtgagaaagtatgagagctaagcgtactctcgttctctgcgtacggttcgagatatacgtagcccatatccctcccatattttctttttgctgcttgttgctctggaactttgctttgagcaggcaaagcaggtgtcgcctgagtgcttagaattgggaatatacccagtgtgtgttctcccccctcttacgaggctagataacacatctatgatggtgctttaggttgttagaggctatacctcaaagtagctgcggatttcgtctcctgcactgacaatatgcgagtgatcccgcttagatccagttcattgaagaagtacagcacgaattctcagagagatggagtatctagatgatcattaagtaaaccaatcagaaaagtccttgagcaatagttgtgtctttgtcagtcacagtcacgatcatctttagccattaagacttgcattaacattcctttgatataaagacgtgtatatgtccagctgaattcctatgtccacagttaagctttagagacgttcatcggggggactctccacgagagcggtcagggccccctatttccaaggtgaagcccgcacacgggcgggccaataacgggctctttacaactctccgtgccacggtctcaacacactcctcgagacccctctctttccacacagctgttgacccccccgtgcgacactctgtgggcaccctcccatccaccgcgctacaccaccccccacaaccgacacagcgacgcaccgcatcatacttgcacccacgtaacgcaccccgcctgagcacccaccccttcttttttttttttattttattttttatcttcgcacccaccccacctacacacactgcccccacagccgcaccccccgn

SEQ ID NO: 710551 - DNA, 134 bp, Homo sapiens
caggctggtcttgaatctaacctcaagtgatccgcctgcctgggcctcccaaagtgctgggattacaggtgtgagccaccgcatccgacttctaacgcactaggttttccgcgcccactaggttttccgcgccc

SEQ ID NO: 710552 - DNA, 221 bp, Homo sapiens
gcccccatcagaccgctctcccgttactccaaaagtatgcagtttacggaacacagaaatatgatcgaccccggcattagttcgagtgtcacttataaacaccaaaccctgttccaatctcagcgcacaacaataggtcatttcgttctctttacattcaacaagccagcacttgaaccacagacatcatattttcagtaccacccttttctcgcactccc

SEQ ID NO: 710553 - DNA, 438 bp, Homo sapiens
gcacaggagatggtggccggcacttcccatcagagagccaggccaaaggaaatctattgatgtaccatatgggaaacatctactctgactcatcaattgtttggattgtgaatcgatgactttatatagtgtacactttggaatacaaagcagaggaggctggtgggacggagatatgggacgactggctcattgtagatgatggaaacgctatcaaacacgtggttttccatttaccaagcttagtctatggcgtaaactaaatggtacctagaacgcatgcatttaccaagcttagtctatggcgtaaactaaatggtacctagaacgaatgcatttaccaagcttagtctatggcgtaaactaaatggtacctagaacgaatgcatttaccaagcttagtctatggcataaactaaatggtacctaggtcgacgc

SEQ ID NO: 710554 - DNA, 422 bp, Homo sapiens
  misc_feature (148)..(148): n is a, c, g, or t
  misc_feature (410)..(410): n is a, c, g, or t
  misc_feature (413)..(413): n is a, c, g, or t
actatagggaaaataagcttccttaagaaatatagtacttgttttgggttcctgtcattaacctatctaacatttcattgtgaatttggataagaaaagaaatatatgatgtatatggtgaaatgaaagtaaaagcggccgggcgccngtgtcacgcctgtaatcccagcactttgggaggccgaggcgggtggatcatgaggtcaggagatcgagaccatcctggctaacaaggtgaaaccctgtctctactaaaaatacaaaaaattagccgggcgcggtgcgggcgcctgtagtcccagctactcgggaggctgaggccaggagaatggcgtgaacccgggaagcggagcttgcagtgagccgagattgcgcacactgcagtccgcagtccggcctgggcgacagangcnatccgtctc

SEQ ID NO: 710555 - DNA, 158 bp, Homo sapiens
acccctcttctgtttgcacacagaaaagtgtctgtagactgttgctaagatgcattttgttaaataccccccgccccacaaaggctgctgtgtattgaatacgtagttggaatgtagtaaattgtgaaattaacgtaaccgaagcaagagccggaaaa

SEQ ID NO: 710556 - DNA, 274 bp, Homo sapiens
ggacccttagtggtaaacatgaattatgaataccgcaggcagccttcttaaatgacaaatgtcaaaaaaaaaaaaaaaaagattctatttcgggcagcaattggcttactctattacaaattggtcttaatttggaaaacctttgctgttacaaattgggcccttttatacatttttctggaacaacaagtgacaaagagttttttttaaccttctttctggcttgtaaattggtttccctttccttgttaacttgcccccggcacctgtggag

SEQ ID NO: 710557 - DNA, 794 bp, Homo sapiens
ggctattccataggagtacaatatatagaactcacactcttgtctcctctgtatgcttctagtttctagacgcagtctagtgctactcacactggtacgtgtggtgacagctccccgcagcggcatgacgctcccttacggctgcgcgctgaccagcactcctacacgtgcagcagagacctgagagcgacacgaattgccacgctgcctaggcagcgtgctaggctggccatagtacgagggagacagcgccgacgcatcccagcgccacagcactcctatctgccacgggctattacactaggaacgaccccactaaccgcggcgagacctcaccccgactagaacgcagccacgccgacctgcagcctgcagcaccagccacggtcactctgacatccagacctgaatcctcttcgctccaggcccttccctcctatccacgcacacgctgtacggcaggagacaattcaaggcagagaagcaacgccaccctatagctcccatgctacacctagttccttctagctctcaataatccctacaacagcatacgcatcttcctccactagccacccgacccaagggcacaccgagtaccccaccgtagacacaacctactcaaccgaccaggaactgggcgccccctagccaactccacgggccttgacctatgaccacgggccctggcaccagttagcatcttgacccatacccatcgtcacactcaacctctctattactacatttatcattggggaaacatactacttccttgcccccacacctgatga

SEQ ID NO: 710558 - DNA, 1087 bp, Homo sapiens
gctctgagacccagaaagccggagagtgcaactgtcatgaaggctatgcccctgaccctgttcacagacatctgtgtgtgcgcagtgactggggacagagtgaaggaccttgtgccgctacaccggcacagcttgcagagtgggctatgtatctaggtgactaggagcagcaagcccctgaaaagattctcagactttgggtcaatggtgcgtactggcttacctgtctaggcaagaagactatagatggttcccgacactagtaggtagctggtccagtcaacgcgccctgggccaggctgcgaagatcccgatgtgcgtcgctcatcggaatgaccctgcagattcgtcagggaatgaagcggatgctgtcccacactatcgtttgaaaaagcagtacaaattgaccattgcttgtcttttccctttgggggtgacccatgattcagttgaacatggctcttcggaggaaaacatagttgggcggcgggctagtcacttcgacaaactttcaaggtgtagtgtctagacgcggtcatgggtcgggatgccctccggaaaatgtgttgtagcccttgaaggaaggttgaaaacccatgcacagcgatggctctgggcttgctacgaaaccgatttccaagaatggcatttgacttggctcttgattagggttctataatcgggccgggcctgagtagaaggcaagcgtgttgccctttgcaatacatgaacggcttgacaccgttgacacctaacggaattgaccacggtatcaggaagcaaccattcgttggcacatagcttccatagcccggagtatagacaggtagggaacgggaaggttaacagaaaccgtggaacttccttggattgtgacaaaagtccgtggtctttaaaaggcttctcaagaaatggtcttgccggagggagcccccagagcttgcccatcaaaacgcctgaagtccgaagattcaacttgattacccctccttatgggagcaagaatggctaacaattgggtttacaaatcaaaccgggaaccccagacaatgtttgaaccaagggaccaaggtctacccagactgac

SEQ ID NO: 710559 - DNA, 158 bp, Homo sapiens
tgctaaaatcgtcaggtgtcgaaattaactgcgccaggtcgaaagtgggtcggctctgatctgggatcgtttcaatctgacagcaagcgatctgccgatcctgagtgcaccagcagatcaatgcattatggggcttggtgcgatatggctatatgccc

SEQ ID NO: 710560 - DNA, 1010 bp, Homo sapiens
  misc_feature (328)..(328): n is a, c, g, or t
gtccggacactggacttctggagtccccgtcgtacctggtgtgtcccctctaccttcaggaaagaagggcagatggtcctcttgcctactgaaaccgaggaggggcgcgtatacagcgggctaagaggcgctcaacagatccgcagtggaagaaagaagcagccggcacatcactggtaatgggcgaggtagatggcgagacaggagttgtgaaggctacttcggactaagcaaggtgtggtgtggcggggcggtacagccgtagaccttggcctagtttactggtcagatttcggatcctagctttgtccagtttatagccagcgtnagttcacccctctttagatcctcttgctgtggccgtatacgccaccgggttttctgcaccgctgtgcccctgtagaaacccatacctggacttagcacaggactttgcaaaggtagtgctggtgacggtaagagagctctagccgcttgaaagtaaggtctgatgctagtctacctgacagcttcgtgtactctagcataagcaagttagcctgaggattgtttacgttgtatggatcggcaatgcgagggtatagtaacgggacaagaatacgcgatggccaagataggacgtaggctggatagatggcacattcttagggtcggattgcagctcgaaccccgcgttttggagctgtagagtacgcctgctgtgccatccagtcgatcccgtgccactcgagatttaagccgtagagccgaatggatcggtctggcgttggttccgtggagttgtcatttaaccactgaacgttgggttgacatatgccgaccctgttcaggggtatccccggccgggctttcggaagccggatctctgtgggtaattgggtactctttgacgcttggattgcttgctgttagggaccacattcgtcagctcctgatcccggactgcccctccgggagatagctcttgaagtgagcatgtctccagccctcttgctcgtggtcattcccaa

SEQ ID NO: 710561 - DNA, 926 bp, Homo sapiens
  misc_feature (413)..(413): n is a, c, g, or t
taaaaaaaaaaaaaaaaaaagaaattggaaccaaccaaacaaaaaaccaaaggggccgcgcggtttccaggtggccctgttgcttgggggggtcaggaccctggtctccaacacccgccaagtgggtctgcggggggcccacgggaaggcgtggggcgcctttgggaccaggaggcccacggggggggccagtaagtctccaacataaagagtgctatgggaggccgactccttcttcccaaggcccgccgggaaaaggctccgccggggtgatgagaaagtcaaaaaagccgtgtgcaacttgccggaggacccaaaggggggcgatggtgttggccccccggtgtccccttgtttggtcctcctttgcccgagccctggaaggggggcggccagggagagtgtcctggggngctttcgtgtctgggcacacaacaggattggggggcccatcttttccggggaaggggggggcgggagacccggctagggaacatcggaggctcttgtgcgggggacccttgggggggaggctccttggggacacggcgcttgcaggagcgggccaacgccatcaatttgtctggtttagaaaggccacagaaagcacagggagtaatctgggattaggttgggagagagaaaaaagcactttgcgggacaagggatggggaggcccggcctcccgaccatggatggggtggtcagataggccaggcttgggagccagaaaataaacaaggggcttgggaggccccgggcagtgcacattaggaagtggcctcctcttgtgggaactggtcggagacgcggaagccgatgtgtaataggtacctcgaaggaagaagagtctcggcacacaggacgaggaggcccaaataggaccacatgtggcccaagcttggattgccacaacgcatactgtc

SEQ ID NO: 710562 - DNA, 1057 bp, Homo sapiens
aaaaaaaaaaaattaaaaagaaatgctcctcaagttggagagggcccactagcatcctggagaggacttggaagaacaacagtccaggctgggcacctgtgcgtgggttcttctgtgttccaaaggccagcccttctctttgtggtgttcagccgcagaatctcccttcaccttagggcattgacttacttggacttgccagcttcccacttaacacctgtgctgcagaattccagaacgtgaaacgccggtccccagcgggcccctaaagccccttaggaaagtgaccaccccccattccctgtggcacccagattccgtggccccgtgcacctcacacacaaaaacacattacagattgccatcttcttttcattcagtgttattttatttccttttattttcttgggaagcccgggaaggagtgtgacgggaagcaaattcaggacctgtggccggccccacgcctgagcctttgccacgaatatttggagaagttgtggcggtgaccagaagtggccgtggtggtggattcaggccgtgcaggtcgagcctgtgggaaattctcacaaagtggggcacttagaagaagcgcagcctggaagcgggggccccttcagaggttggaccgttaggtgagtcgcagtacgggcattggcaccttgcagaggtttgcccggggattcatagttcccgagcaccattcacgcggggattgagccggtttcagagttgtggcactctgtcacacatccaatttacattgagaggccactgagacattatcacaggggtacatgtacaggcacttccatggcataactcaattaaatcttcaacagcttgcatgatcgaggcatcggcttcgtatcattagctccattttaccgattggcgcaactggaggctcccaacaaccgtggctgtcgtttgcccagaccctctgggttccaagagatttggccccgtaggatccaccttgtgctcttcaaggcaatccttggaatcgcctcccgtcgcttgagaatgcctggaaaccggggactcagggcctcgc

SEQ ID NO: 710563 - DNA, 809 bp, Homo sapiens
ctgctctcccacgctgggggtctctgtgtggtgctcgtgagcctggcctgcctccagtgaatgcaggcgccgcgcggtattgccgcatgcagcctcgtgtcgtgggtgacccctgctgcagcagccctgtccacacgggtgaactcctgtgaggtgctgtgtggcggtggtggcaatctgcgctggtgtcatggcccctcggagcagtgctggtggagctgccctgagccatggcctgctcccacctgccagccgcgtggccaatgaatgctaggcctggtgatgtcatgccccgacctggaccctggtgacgaaagtccgaatgtcacccggtcagggaaccagcacagacccacccgctgggggttccagaacgtttccactgccgccgcaggagtgctggcctctgcccaagcagccttgcagctgtgctaccacgctgtcctgccgttctcagcagacagcctgcctgccctgcagccatgaggacccccgacagatgtctgctgcacacagccttcccttggattaccccaataccttcattcctacactcctacttggctcctaggagtggaggagatggggactgacagggaccggagactgcatgcaaaagcatgctggatgaccagggaggcaagttgcaggggcctgacatggtgggggcaataacggctctggaaggaacacaccctggaaggccacatgacatcttggcctatcctggagctaatccccctatatgacgggaagcacaaggcccgatgggacccccagatgacaataacaggcagactggaaacaaa

SEQ ID NO: 710564 - DNA, 740 bp, Homo sapiens
  misc_feature (23)..(23): n is a, c, g, or t
  misc_feature (116)..(117): n is a, c, g, or t
  misc_feature (153)..(153): n is a, c, g, or t
  misc_feature (185)..(186): n is a, c, g, or t
  misc_feature (208)..(208): n is a, c, g, or t
  misc_feature (212)..(213): n is a, c, g, or t
  misc_feature (255)..(256): n is a, c, g, or t
  misc_feature (265)..(266): n is a, c, g, or t
  misc_feature (277)..(277): n is a, c, g, or t
  misc_feature (318)..(318): n is a, c, g, or t
  misc_feature (338)..(338): n is a, c, g, or t
  misc_feature (343)..(343): n is a, c, g, or t
  misc_feature (373)..(373): n is a, c, g, or t
  misc_feature (381)..(381): n is a, c, g, or t
  misc_feature (385)..(385): n is a, c, g, or t
  misc_feature (417)..(417): n is a, c, g, or t
  misc_feature (419)..(419): n is a, c, g, or t
  misc_feature (431)..(431): n is a, c, g, or t
  misc_feature (451)..(451): n is a, c, g, or t
  misc_feature (501)..(501): n is a, c, g, or t
  misc_feature (505)..(506): n is a, c, g, or t
  misc_feature (524)..(524): n is a, c, g, or t
  misc_feature (527)..(529): n is a, c, g, or t
  misc_feature (532)..(532): n is a, c, g, or t
  misc_feature (534)..(534): n is a, c, g, or t
  misc_feature (544)..(545): n is a, c, g, or t
  misc_feature (564)..(564): n is a, c, g, or t
  misc_feature (569)..(569): n is a, c, g, or t
  misc_feature (579)..(579): n is a, c, g, or t
  misc_feature (593)..(593): n is a, c, g, or t
  misc_feature (595)..(595): n is a, c, g, or t
  misc_feature (604)..(605): n is a, c, g, or t
  misc_feature (617)..(617): n is a, c, g, or t
  misc_feature (626)..(626): n is a, c, g, or t
  misc_feature (631)..(631): n is a, c, g, or t
agcgggacgtcggcggttgccgnggagagacccgctcggtcccgaccgagagctggcgtcaggagccgcagggtcacagcgtgtctttgaagctgcctccgccgcaccatgagcgnncgaagtcggggtcgaaagtcctcccgcgccaaaaancggggcaaaggccgcgccaaagcccgagtccnncctgctccggacgacgccccgngcgnnccggacccttcacagtaccagagtctcggggaagacacccanngcggcacanngtgcaggctgncgcggggtggggtggcctggaagccgctgcgtccgcgcagntcctccggctcggggagganggccngctgccggctccccctggactgtggcctcngcgctgcngggncctgagctgcgggggaccacgggcaggccgcngncaggcccggccnggggaaggccgcatctctcntcggagcgcctggcggcagacactgtcttcgtgggaaacagcgggaaccngtgnngaaggccgacaaaatgcnccnnnggngnttggaaaccnngcgtggccctgaccggggnaaganagggcccagnaaaacctgtagcancngcaggggannggggccctcagngtcaatagnctggntggagaacggcagaacaccaaaagggggcgggaatggagaagaatacctcgtgcggccacctggcggagggcaacgtaaggagcagagggaatgcaaggtccgggcccc

SEQ ID NO: 710565 - DNA, 126 bp, Homo sapiens
aagacgcagtgatgtctagcttagtgtaacgaggcagtgcatgtctagctttagtgtaaacgacggcagtgcattgtcatagctgttagtgtaaaacgacggcagtgcattgtcatagcttgttag

SEQ ID NO: 710566 - DNA, 252 bp, Homo sapiens
  misc_feature (249)..(249): n is a, c, g, or t
agacagaacaccacgacggaaggagggagcagagccaaaggcggaaaacaggaaagagacggcagacagaaagaacagagacgcaagaacaccagcaagaagcagaagcacagcaggccaccacaaagaaggcccgaaggaagcaagcacgagacaccaaaagaggaagccgaaggcagagtgaggcattgagtattccaatatttgaagctgtagagcaagcatgatttggggaagttaatcattttnaaa

SEQ ID NO: 710567 - DNA, 406 bp, Homo sapiens
gatgcgccgggcgggcggtgcccactgacctccctcggcggtccggccgggcagcgcccggagcccaggcagccccgctcgcatacgcgttgtcagacatgaggttgtggaccgaccgcagttcgctaggccgtgataattgaatgactacagctgattcgggatcgatgaggtgacgagcaaagggtgggtacgcgtaaaagtcttgtggagtcggtcaggaggagagtagctcttaggaagtcgacccgtgcctattgtattacagtgaaggagcgcatataggataaatgagagtttgagtcggagctgacgaatagacattggccgtgatgagattggtagcaatagagattgtgtcaaagaactgagtatggaaggcctagggtgtggggaggagcagagg

SEQ ID NO: 710568 - DNA, 704 bp, Homo sapiens
  misc_feature (184)..(184): n is a, c, g, or t
atcggtgaacatctagggtggctggcgtagtctaggtttctcacaggaacataatgtgcctctatagcaaggctatctcttagatcagtgtctcaagtggaaacactcttcatggtgcttagcccttactggagatctgcctattaatataagtagagcaacgacacagtggacaagcttcgtngatcagacggtcgctgaaagtctttcatctgtgaatggtgctttgtagttaagagctgaatgtttctttgtacagctagacgaaagactcactaattttcacatgatgtagccggtgtacactccgtgcgaaggagatgtttatggtgattgaaagcaagatgtggaatcggtattaattttagaagagagtggcaggagtgacttgagactgatcattgcatgagtccctcgatccctgaagattgagtttaggtagtcattttagttattttattcattaggtaagtgtggtctatgtatatttctagatattgattaggtaatcgattataaagggatatctatcagaagtccaggggatgcatttggaaattatgattattgttctttggctgaagtattcatgttagaacatacaaaataaacatattttgaaacattgcgtttaccaccaaagaagaaatagaggaacatgaaataaggttataaaaagataacaggagaaataataaattaag

SEQ ID NO: 710569 - DNA, 342 bp, Homo sapiens
  misc_feature (317)..(317): n is a, c, g, or t
tacaggaatagaacattaaaataccaagcagtggcctggagcggtggctcacgcctgtaacccgagcactttgggaggccaaggcaggtggattgcctgaggtcaggagtttgagaccagcctggccaacatggtgaaaccccgtctctactaaaaatacaaaaattagctgggcatggtggcaagcacctggaatcccagctactcagaaggctgaggtggaagaatcgcttgaacctggagaggcagaggttgcagtgagccgagaatacaccactgcactccagcctgcgcaacagagcgagactctgtctcanataataaaatagaataaaaataaag

SEQ ID NO: 710570 - DNA, 778 bp, Homo sapiens
ggcacaatctcgactcactgcaacctctgcctcctgggttcaagagattctcctgcctcagcctccattacaggcgtgcaccaccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattgggggaggaaagggcgtttaaattaaggccccttctgtgggccggtctcaggaaacgtgcctacggggggggctcaattttttccccattattgacttttattttcctttatttttccacaactttttttggaagcggcagggggacgaggggacgacgcggtgggcgtttaccctgattatttcagggggtgggcccccctttccccaggcctgattgcacggtccattctagaaccgctcagatttagcctaggccatgcccttagggacacggctagggggagcggggctagagggggtctgccggggtaggggactcggtttggcctgaacctgcttagggaccgggtgagccccttggcggatgggcccagaagtggggcctgtattcccaggtgccggagctggccggggcggcgaggaggaggaggcttctccgggaaaaagtggggcgccttcttgacagcggccttggcctggaatgggttc

SEQ ID NO: 710571 - DNA, 134 bp, Homo sapiens
tattattatttttgggacggagctttgctctgtcacccgggttggagtggagtgacgcaatcatggttcactgcaacctctatcccccaggctcaagtgatcctcccagttcagcctcccaagtagctgggact

SEQ ID NO: 710572 - DNA, 241 bp, Homo sapiens
tcactcctaatcaaagaagaaagtgagtggcatatagaacagcagttaactaattttttcttcacctaatcttatagggagtaatgctagtagatataacctttttagttaacctgaaagattccaaaaatggttcttaagtgcttgagactggcaaccacacattaaattgtcacttcataaacatcctcttatcgcagttcactcttgccctagcattgtcaacattcaagttgggcat

SEQ ID NO: 710573 - DNA, 269 bp, Homo sapiens
caagagacgcctaggaagtagatacgaggcatcaggctacctcacgagagtcatagtacctcccgccgtgcaccagcgcttgattgaatatactccactgtgacattcacgagcactgggcagaaactcacatcgcgtcaacacccgccgcgggccttcgcgatgctcggttctaattacacagtcggattcccctggtccgcaccagtcctaagtcggctgctacgcgccggccgaggcgaggcgccgcgcggagcactccacgtccg

SEQ ID NO: 710574 - DNA, 155 bp, Homo sapiens
  misc_feature (37)..(37): n is a, c, g, or t
cgggctgtcggatgtgcgggatgtctggctcagcacnaacgtggcgttggagccatccaggctggcaattcaatgtgtcctcgcgggcgtcggcccagtagatgcgctcagtgacatagtccagcgtcaggccattgggccatgtgatcttggtg

SEQ ID NO: 710575 - DNA, 633 bp, Homo sapiens
  misc_feature (556)..(556): n is a, c, g, or t
ccttagtactataaggccgaacccccgatgctacgccaggcggtaagaagaataatctaataccccgcaatttcctaacaacccccggacgcgtcggattaccactcattataaataaaatctcctcattacgtactccgccactaaattaatgtacacacctcctaaaaactatatccgctacttaagtttccccgccggattgacatctataacctaagttatctacgccgatacctccaaaataatgcggccccgtacaccccttaacaacttataaaggaatccccctagagttactcgtaccgtagtaaacaataatcgctaattccctcccactccgcccctccttcctaagccgccctgcagtaagagaacgactagtccgcaatccgcaaaataaattagccctgcttacaccaaaaatactccctaacggaaaccgactcacccccctttcgacaatccttagtcctccccttacgctacgcgcactaatagaattatctctcctaaaatgatgaaaagatccgacattacgctgcaatccacatcncctaagttacttccgagaaaacagtcctatggaactccgcagagggcacataagccctaccgttccccccgttcccc

SEQ ID NO: 710576 - DNA, 677 bp, Homo sapiens
ctacccctaaaatgccaaaatgggaaagtgaaaagactcatatcaacatatgtctgtcattggacactgtagattctgtggcaagtccaccactactggccatctgatctataaatgcggtgtgcatctgacaaaatgaaccatctgaaaacttttgagaagtgaggcagctgagatgggaaatgtggctccttcaagtatgcctgggtcttggataaacttgaaatgctgagctgtgaacgtggtatcaccattgatatctccttgtggaaattcgagaccagcaatgtactatgtgactatcattgatgccccatgtgacacatgagactttatcaaaaacatgattacatgggacatctacaggcttgacttgtgcttgtcctgatttgttgctgcttggttgttggttgaactttgaagctggtatctccaatgaattgttgcaagaccacgagagcatgcccttcttggcttacaacactggcgttgttacaacaatctaattgtctagctgttaacaaacatgagattccatctgaagccaacactacagaccagaaagaagatattgacgtcaattgttacaggaacgtccatgcaacttacccttactaaaacttggttacaatcccctgaccacatgtagcattgctgccatttctgtgtgacatggg

SEQ ID NO: 710577 - DNA, 349 bp, Homo sapiens
ccagcgaagaacgggcagtgccctgtgtgacaagcattccaagctctttgaagagcctgaggatcccagtaagcgctcattcttctcgtgagaatcatctcctcgcgtgtccgacgtgaagtacagccacagtggctctactacatgctcacccgggattactcttacgagtcaaggtctggtacctgaacatggaggcaagagccatagagacctaccaggtccatgactaccttcggatcaagctctgttccctgtacgacagcgactgcattttccagcaagtttgaatgtgcctggatgcgggagccgacagtgtcatcatgaccggtgcctacaacagcttcta

SEQ ID NO: 710578 - DNA, 380 bp, Homo sapiens
ctcccccttatggacgctcatggactactcctcgctctagatggagccttactacatttgtacaggtccagtcccctgcagattgcgtctctgcagttaataccgtcctgatccgggaacaccgggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtag

SEQ ID NO: 710579 - DNA, 276 bp, Homo sapiens
agtgtcacatcagtataacatgatatcagcacattcccttgtcctcatcaaggtgttggctcagatttattcttactcggctgtctaaagcatgtactaccttgttacagtcggtaaagtgtagtggattattgacatgacatcatgagaagatgtgtacttttataccacatttataaaacatgattttgttttctacccttcaaggtaaacattaaaaataaggtggtacttgtgtacttgtacataacaccaaaattatagcggattgaagtt

SEQ ID NO: 710580 - DNA, 317 bp, Homo sapiens
gatagcgatctagaggatcccatccacagattcaggaagcagaaagtgctggcttccacctcgtaggtctccttaatgtccacttttgtagaagagtcatcgctgtgcagggacaggtggtgtgacgagcttggacgaggccccacctctagtgactgcagcttagttaattacgtctgcatcaagcctatttgcaaatcaggtctcattctgaggtaccgggaattccaaattcattataccttatgaactgtcggacgatgaccagtattcccgcatggcagctcgtcattcctgggtctccgctctcgcacatg

SEQ ID NO: 710581 - DNA, 456 bp, Homo sapiens
cgcaaatcaggcgcgccgaagatgtagggttccattgtggcgtcaacagtggggcgcggattaaatttcggtatgcgacaagctgcccggcaccttgtctttgtcgtcgtcatgccaatgtcacgttgttcgccttcaggagctcgggaaagtcgtcacccgcgagataggcatgctcgcgttcgcgcccatgcgtcagcgggtcgaggtcgatcaggatgtcgtcgacgaagccgggatggcacatgatgagcccgtcctccggcaatccggcgacgaacccttgcatcagcgcgccaaaatcggctccgcgcgtgaaatcataggcgccggcgaaatcgggattgaaggcgagatcggcctcgcgcgcacggcggcggaattgggcgctgaggacatcgagcaccagcgccttcggcgcacgcaatcgctccgcgagcggcttgtcgcggccgc

SEQ ID NO: 710582 - DNA, 229 bp, Homo sapiens
cttagcatgcttcaggtttagcaacagcacacaggccaacttccagacgatagccatgctgaggacttcactataagcatggtaccatctttggtgttttacatatgctacaccacttaatcttctcacgtgagctcatgagcatggccatcagatatctctagtttcacataatgcaggaaactagaggcaagtataagttccttgccccaaagtctcccctataaac

SEQ ID NO: 710583 - DNA, 885 bp, Homo sapiens
ggtctcaaactcctgacctaaggacatctgcccaccccagcactttgggaggccaagaagggcaaatcacttgagctcacaagtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaaaaggccaattttttttggggggctctcaaatttttctaatttcaccccagggattgcccaattgtcccaaacgcccgggtcatattcttacctgctttggacaacctaattaaccttaaatttttcctttttctttacactggaaactcacgttaaggaaatttttactcacttctgggattggaaaaaatacttccctttgtggttcccccaggaattgattcaaatgaggagggatgcggggcggtttattgtggataaccctttaattttcatgaactggccgtgtttttttccagaacgttttggacgtttaggaatttccctcacggttcctatgttttttcaaaatcctcttccctgaaagtcctgaaattttaaacggcttttacgcatttttagaagcaggcggcctacgggatgggcccaatctcctttcttaaaattctttaccacttggtctggcgggacctttggcccgatggaaacaggcattcggtaacacacacatactattacctcaatatggtgcaacatactatgcgtgagagaggatcgccctgcaccgtggagacagaatatc

SEQ ID NO: 710584 - DNA, 914 bp, Homo sapiens
  misc_feature (1)..(1): n is a, c, g, or t
  misc_feature (337)..(337): n is a, c, g, or t
nggaaagagagacacaccgagagacataaacggaggcgcccggtttcaccccgaagcctcctctcacgcataaggttcgcacacagggtccgcaaatgggaaaattcaccgggcggccttggcatatctgccgcgccaggacagtaatttggagatgagacgaatgcaaaacagggcgcagagggcacgccggaatgggaccacacacgggacccctggagccaatatagcggcgaacctctgtgggaacacacgggggaaaagggtgcgctgtgccaaacacgacgctggagaaaataatgtttggtccacagccacaagtgcccaccccacgctncccccggcgtggtgagacacaacggttgaattgatgtgcccgcgcggtttctaatgacccaagaaagaaacacttttttggaaaaaacgctaataatggaattgccccaagggaagccccattccaggagcacccagcgcgaccttgtttgaagcgtcttgtgggaaccacacattcgccccgcgcccccaatgaggccgcccttgaaacctgttatatggagtgagtttttcctccacccttttgttagaaaaaattctccccaggcctctgcgcatttaagagaaccccctttccaaagagggttaaaaaaacatggtggctgccacatccaacttcgccgcttgaggcgatataacactccaccacctttgaagcacttttcccccctctcctatcgtggattaaagggaagaaaattgagatccaccaaacactaattcaacctccgtttttttttttttccgtggtgttaaaccaccacccccgcttcttaaaaaacactaaaaattttttaacctttcccctttttttttggttccaattaaaaaaaaagggaaaaattttaccaaaaaaa

SEQ ID NO: 710585 - DNA, 111 bp, Homo sapiens
  misc_feature (1)..(1): n is a, c, g, or t
nccaaccgcatcaccccgctaaatcccctataatgtactcactccttaaacacactcccgtattactcgcatcatgattattaagtcacctgagctcaccatagatctaat

SEQ ID NO: 710586 - DNA, 418 bp, Homo sapiens
ttacaatctgtctctgacagtgaaaacccgttgactgagcaccatgtcccgtggtaccgatgctaaccctggaaaccgcccctgaagcgtgacaagccctttctggaaaatgccctgaagggttccgggttcatccccaatctgttggcggtgctggacaatgccccggcagcattggaaacctacatcaccgtgtccggcctgaacgccaagtccgacctgagcctggccgaccgtgaggtggtgcaactgattgacgacaccaaccatggttgcgatttctgcgtcgccgggcacactgccgtagcgcgcaacaaggccaagctgccggaagacgtgatcgacgccctgcgccagcgtggcgaactgtccaacgagcgttatgagacactggccgcgttcacccgtgaagtgatcg

SEQ ID NO: 710587 - DNA, 367 bp, Homo sapiens
  misc_feature (1)..(1): n is a, c, g, or t
ntgtataatgttcgaagagaggcatcctccatacgcggtcccctgtttcaatgctggcctcgtagagtttgttccagagccaggatgaattggtaaagaccacagtggcacgtgatcccacagctacatccatggcgcctgttaaggtggcggcattgagtatggccttcgggttgagcgtgtgtgcgtatcagagcgcatcagacagtatgagcctcccctcagcatcagtgttatcaacatgcatggtcatgccttcacacagaggggccagtcgtatactattgctgggcgcatgtcagctgctgcagcagacacgatgtactgagtatatagtcgcagctcgtcgcatgtgagccttcatgag

SEQ ID NO: 710588 - DNA, 1090 bp, Homo sapiens
  misc_feature (1)..(1): n is a, c, g, or t
  misc_feature (47)..(47): n is a, c, g, or t
  misc_feature (92)..(92): n is a, c, g, or t
  misc_feature (150)..(150): n is a, c, g, or t
  misc_feature (171)..(171): n is a, c, g, or t
  misc_feature (260)..(260): n is a, c, g, or t
  misc_feature (266)..(266): n is a, c, g, or t
  misc_feature (303)..(303): n is a, c, g, or t
  misc_feature (321)..(321): n is a, c, g, or t
  misc_feature (348)..(348): n is a, c, g, or t
  misc_feature (448)..(448): n is a, c, g, or t
  misc_feature (463)..(463): n is a, c, g, or t
  misc_feature (546)..(546): n is a, c, g, or t
  misc_feature (613)..(614): n is a, c, g, or t
  misc_feature (628)..(628): n is a, c, g, or t
  misc_feature (645)..(645): n is a, c, g, or t
  misc_feature (761)..(761): n is a, c, g, or t
ntctgttgcccttcgttgtggtgcgtctggactctgaaattttggtntgctcttggttggctcggtctcgccgggtggtctccctctccgancctaaacgttgtctgttttgtttcgcccgcgcgcgagtttatattcaccgtgcgcctncagttgcttcgtatgtggagngggatgaaacccggctcgggtggtgttttccgctcgcgccggccttaaactcgggcgtggtgggttttaataacgcgcgctccccgcgncgctcncctcgtgagaatgtatgcctggtttgttaaattagcnctcgcgcccatgctctcncaattagttttcggggggcggtctcangctatatatccgttgccttcgtctcgctcactaagcctcgacgtgtaatgcgatgctcctgttggtgcggcgcaacctcggaggtgctcacctgcttttntttagtccgtgagangcgaacccctacgccgtcggcccgctcatataacctatcttctgtgtgatatgagcacgaaacacgcttatagtatcgcgganatggtttcatcccacatgtctcgccgtcggttgtcttcccgggacagataattattcgccccggggnntatttctccgcgcnccccttctcctcgcgcncgcggtggtgtcaaatctatacaccgcgctggactgacgatctacgcccatattatgtcgtcgggtcgtgctcgattattgttatcctcctcgtccttctcatccctctctaggcngttacatgtctgaagttgctcctcccgtcgaccgcatttgtcaggctggcgagttttcaggcgtcacacacacaacttgttgtagaccaccactagcgtgtcccccgagaatgtctcacgtctcaaattttcggtggccacaaaccttctccccacctcatgttggcttccatccgcgcccgacatgaataatgttcgcacgtcagacacagcccaacagactccactggggtcttcgaacgccctcgtcctgaaacatcgcgccatttttaaaaaggggttcaaaaattttttaatttccccttttttatgggggtttttaaaaaaaa

SEQ ID NO: 710589 - DNA, 291 bp, Homo sapiens
ctttttccccttaaaaaaaaattttaattatttaatttaaaatattgggaaaattatgggattggtagggaacttaaaaaaaattgataaaattaattattaaaatttatatttaattaaaaggaaatttatacccctttgggcagaaggttttttgcagatccgattaatttttgatttttaaagaattttgttaaaaaaaaattttgcaaaaaacctagggaggtcctcctataaaggttaaattttttcgattacttataatccttaaaccaaggggaatggttttta

SEQ ID NO: 710590 - DNA, 115 bp, Homo sapiens
ttatgcatgtccctttatgatcgtggtgatttagagagtgatctcagctggaatggggatgcgttgcatgtgtaatcttactaagagctaatagtaaacggctagtgaccaaagc

SEQ ID NO: 710591 - DNA, 294 bp, Homo sapiens
gcatcttgggacacaacgcctgggattacagagtggatcacttgagcccaggaatttgaggccagcctggggcaacacagcgagaccccatctctacaaaaaatacaaaaattagcccagcatggcagctcgcccctgagattgcagctcgcccctgcagttagcggcagctcgcccctgagttacccgcagctcgcccctgagttacccgcagctcgcccctgagttacccgcagctcgcccctgagttacccgcagctcgcccctgagttacccgcagctcgcccctgagtt

SEQ ID NO: 710592 - DNA, 231 bp, Homo sapiens
cactcacagacattgcctgtctccagattggaactctggatctccttctcctctgcatagtctggtgaccctgctccaagtccgccgcaccgatgtcatgtttccgtggcttctccggatgccgctctgttccactggtctcagtctccaagtgccagctccacattcccctcggtcgccatatctattttaccatgcctggccgataaagccccaaactcatgccgactt

SEQ ID NO: 710593 - DNA, 356 bp, Homo sapiens
acacagtagagacctcgttggcagttaagaagatgtccgcctagtcaaggtggggatgctgaatggcggcaacgcatggcactatgtggcgtacaggatgcaagcctattgacagttttaatgagtatttatttgcttgacaaagtcatctatgctactgggcgtctgaagacacagtattgctcgtcctcaaagagatctaccaaacccaggctatcttccttgatcagcctttacagtaaaaatgacccatctatggctgcttaatacggacattgagggatccttccccagaaaatccacctgtttgttgctgcaattttcctctcctcagctgcgtcatttcctgcatgttg

SEQ ID NO: 710594 - DNA, 237 bp, Homo sapiens
atctaagcccaaaagtgcctgatattgcttaatcaaggcgcttttttggttctgttcaaaatgcgcaccaaatcagacaccgtcaattccttccaaaaccgtcacaattggcaagcgaccaataaattctgggaatcacaccaaacttgattaagtcttctgggttgcacatattttgagaacattgtcatcgtccaacgctgcggcatttttcattagcatgcgagccaaagccaa

SEQ ID NO: 710595 - DNA, 164 bp, Homo sapiens
acttctcacttggtcaccgtgtattatacttgtcatacattgctggatttaaccatgctaatattatgtcgagattatatataaaaaatctcagagtaactacattttattgtgacacttattacattttaaaatattttagaaatcatgaaattgctagacat

SEQ ID NO: 710596 - DNA, 330 bp, Homo sapiens
  misc_feature (232)..(232): n is a, c, g, or t
gagaagacgaagaagggtccattcattgattgacgaggggctctacggaggggtgaggatgggtgcaggatgcacagtgacaagggacatggggtgcgggccaggaggaaaaggctggaagttagctgacgcatgcttttggcttttatcccacgggcgggtagtggcccggaccctggcttgtggctgtcccaagtgagactgcaactgtccccttcctcctcacgtccgncttgtcttctgtttcttggcttgtctctttgcatcttctgggccgctattgtcagaggctgcttggccgagcgcgccgactcccttctgtcgtcttct

SEQ ID NO: 710597 - DNA, 408 bp, Homo sapiens
  misc_feature (26)..(26): n is a, c, g, or t
  misc_feature (35)..(35): n is a, c, g, or t
  misc_feature (91)..(91): n is a, c, g, or t
cctatactctggcggaaaaagggagnccaatgtcntcaattccctcaggtgtgagttagaatccaactgaaattaaattaagtggaatatnaaaatgcatggaattgccttattaataaagattggacatccctaatctgaaaatctgaaatctaaaatgttctaaaattcaaaactttttgagcacctacatgatgccacaagtgaaaattttcatacctgaccttatctgatgggtcacagtcaaaacagagtcaaaactttgttttgttcacaaaattatcaaagatactctaggaaattgccttcaggttatatgaataagatatacataaatgaattttgtctttagacttgggtgccatccccaaggtacctcattatgtagatacaaacatttcaaaatcc

SEQ ID NO: 710598 - DNA, 601 bp, Homo sapiens
tctaggtcactgcctccttttcagtactagatggttggtgccttaagcccaggttagcactggttttagtaaatgatcagagtgccacccatcctgaatgggagaggtcccaaagaggatatcccagtagtgtgggaaggccagccaggggtttttacccaggggacctgtgagatgaaactcttactgtgtggtgctgctaaacagccactttgatttggcgtctcctttggccaagatatagagcagagtttccagagataaggatggtatttctacctcaccactttggctgtggctttcctcagggatattctcccttctggtactctcaacacttcttgtgcattgaggcagggaaagatttctcaccagaaaactcaagattgtggagaagctggttgttcacctcagtctcactttttccactgtagaaactgggagttggggggaaattttccacacacttggtgtcaggcccactggggaaaaggatatcatgaaatatgaagttcgattctcttactcggttcttggcgattttttacttctctggggccccgcgaactggctaatattaatatatgagatttgggatatt

SEQ ID NO: 710599 - DNA, 1540 bp, Homo sapiens
  misc_feature (1040)..(1040): n is a, c, g, or t
  misc_feature (1417)..(1417): n is a, c, g, or t
tttcaaattcttcctactctgcaacagcctctcaagtgaattttcaatacccaagtctatttagattcatcacttctattcccccacctcttcccccaatcctgttcctggaggcagcattcttgaaattatctgtcttcttcaatctggactgagtactctctaagcttactgaatgaactagtcttctgaagcttcctttaatcatcataatgggaataaactttcatcatgcttgtagtactggatcttttgttgccaaatcccatgtctctcttacttagttaataaccctctagtgttggcagagcccattttccagcgacttcccaaaataggtccatatctgaaatatcttggctgaaaatcattttcactaagcattttaaaggcgttgctccttgttttctaacttttgatgctgaaaagtctaatattcctctatccaatctttatataggattaaaaaaatctctaaaagcttttagggtccctttatcactagtgttttgatatttcagagatgagccttcttgagagtagggctttttaaaatttctctcattaataggctttcagagggacgttgtaatctggagactcatggtcctcattttggaaaattgctttttttttttaaaatttggtattttagtattccacttaatctaaaagcatgattatcactataccattatgaaagaaaagatgctgtcaattaatatagtcatactatggattataataaccattctgatttcagagatattacaacgtaaaaaaaaatgtttcttatggtatttctttcctgctttcttccccttcatttcctctattgtctctttctggaattcctattagttagatgttagattgctcttctttctttttctctcctactttctactttctacctcttattgttctactttttgagagctttcctcaattttagtttgtaaatgttctactaaaatacaaaacattcctattattatttttaacttctaagagtttcttcttttatgatttcttttttntggcaagttactttttcttggggaatcaattttgtctcaacacagaggacactaattaaacttgctttttccctgcattgtttgttcctccaagatctcattcttttatactggaagacttcctcaaataactggtgatatttggctttccataaatatttgcgtgaggcattaggaagtggcctggaagttattggcttgtcaactgggaggctttcttataggttaactagccaaccaggcagcttttacactaaaggtctcccaaaggacagtatctgacatttcttcagtcacaacgctcatcctccttcctggaggatatggtccctagtggttggaatgggaccaggtcaccattcagtaataggttttcncttgacctccctgtttccagcccagtgccttaccctacttcttcctgtgtccaaggtgcccaagtatacagcttctctggttttctctgtgtgaaatatcttctgtctccagaggagagagga

SEQ ID NO: 710600 - DNA, 502 bp, Homo sapiens
tttagtttttgttttgtggaaagtgtaaagccttcccaccaagggttttaatgtagattttttttttttgccccccctgctgttgattggtaaatgtaacagtttgattgtgacgctgaataaaagttttttttttaatgggctggggaaaggtagtttacttttaagcccttttggtgaatttcccccccagtgtgaagttagaattccttcagggggatgccaggttttatttggaatttatatacaacccgcttgggtggagaagcccttgtttttggaaaccttggggtagttgaactgatagttactgttgtggcctgaagttccccctttaaagggatttccccagcaaaatcatggaatggttataaaagtgattgttggccccttttatgccatatattttaattgaataatggggcccgataaaattataaatgggaaagaaggttggggatcccttttcatgggtaatcaataaacgattttatttttttta

SEQ ID NO: 710601 - DNA, 291 bp, Homo sapiens
cgggcccctttttggtttttcggggggggggggggttttttcaaaacccccccttttcccccttttttccggggggggccccccctttttgggggggggggttttttttccccctttttttggggggggggggcccccggggccccccccttttttttttgggggggggggggggggggtttccccccccccctccccccccccccgggggggggggggggttttttcccccggggggggggggtttggggggttgggggcccccccctttggggggttttttttttttta

SEQ ID NO: 710602 - DNA, 756 bp, Homo sapiens
  misc_feature (714)..(714): n is a, c, g, or t
cgagactgaaatgtgttgctaaaataaatgtcagaacagatgtctttaaagttctattaaatatttaagaaacagattattcctattttatttaatctattccaacacataaaatggaaacaaatatatatttgtagcttatcaatttattcaggatttgtttattgtctgtcttccccacttgcctttatgcactacgaggacaaataccacttctgtctcattcaccattacaccaagcatagtgcccggccacagtagtgctcagtaactcctgctgaatgaatgttgctgaattccaagttctcgtatgagatcagcataacactgataccaaaaactgacagagaaaagagaaaaaagaaccagaaatgaaagcatatttaatttttgttgatccttgtttttagagacagggtcttgctctgaacagcccaggttggagtgaagtggcatgaacattgctcactgcagcctcaaactcctgagcccaaaagatcttcctgcctcagcctcccaagtatccgggactacaggaatgtaccaccacacctagctgattatttatgttttatccatacatacccaaatcctaattaaaatagtagtgaattaaactgcaaaatcctgactgtagcaacttttagaaaagtgattcagtttccttcaacacaaacaaagcaagattgaaagagaacctacgactgcaaaganttaggatatctcagcatagaattcaaactattggtccaccac

SEQ ID NO: 710603 - DNA, 849 bp, Homo sapiens
cccacgcgatcggaagatgatgacgatatggacctacagtccaataagcagaaagaccaacatgcaggtgccagacaagacagggagtgtaggtggtcttcaatggtgtggacgagctcgaaacacgttatagaagactgaagcttctacgtgggcaacagcggaacgtctctggaagcgttgctctatctcctgtgtgagttatgaattattccatgtgccacggagagaagggccctgtcatgccttggtgaacggtgtatgaacgattgggattgtatcgagagagtaaatgacattcttgcagactatatgggatactgtctgtggatcctgatgctgagtatagctgaagtacatgatgaaagggatgcctctgcactggtggatccgatggagtgcacagacagagacagacggagcagagaggtacacagtcctcctgcttcattagtgccgagaattcatgtgatctatagcccagacagttgcaaacacatcaaaaccattatggcctgcgctgaccttagacagaagaggagagcaaaaactagtaatcgaagtatcatgtacgcgactagtctccagtcagagacagaacttcttgggtatccattgactcagtgcgccttacaggggagatagtaaaggctgcgtgaataccattagtattacatctcatctccacagaatatacaaagaaccgagaatgtaccttccacataggcaacaattaaccagccacacctgaagaggtgccacaaggaatagcaccgtcacagaccaatgaatcggctcatcaaaccaaaggagccagcaaatacccagcagacgatatcgagcacagga

SEQ ID NO: 710604 - DNA, 275 bp, Homo sapiens
ggcgaggacagatgcgaactgaagatgaatgattatgaaggcaggtgggactaaccttatagggatggctcacatagctgagacatacaacagttgagggtatatagtctcactcatgctaagccctcgagctcctgtccaatatgttctactgacatgactggtacagccagaacattaatgaaaaattttccaccttcctttcattcacagggcttctcatctttgtgagtcttaagatgttttttaagacctgacagcaaagaccccaaaag

SEQ ID NO: 710605 - DNA, 374 bp, Homo sapiens
atcttggatctgaacagtaagtaacacctggcagttcccccatacacacacgcactttggaaattaagtggaagtagtaagcagctgatatgcatagtaccagaaataggcaagggtccctgcagcacacatagcaaagtctagttgttgtggcggcagcaagaggcctcctggatcctacaaataatactacagtggtgtagacttcaaactacaacggtatcaacagactgcaaccctagacagccagttcagcagtgtatgaggccatgcatactcttcctcagcctttctgatggtatctgtgagtgtctctgtctcattgaaatcccctcctgcctaaataactaagtcatttcttgcacggatgccag

SEQ ID NO: 710606 - DNA, 131 bp, Homo sapiens
tggcctcagcctctcaaaaggctcagttacaggtatgagctaccatgccgggtccacattgggtaatgagatgccatctactccctcgcaagagctagaagggactggcatcttcagagtttcaaaaggcc

SEQ ID NO: 710607 - DNA, 527 bp, Homo sapiens
  misc_feature (436)..(436): n is a, c, g, or t
ggcaaaggaagactctaccggcgaactgcacctcttgcaacgattggatagcagcgtggacgcccagccctgcagctgcctcagcgcgaccacgggcgcacggaacagacacgacagttgataacactgcagaacaagctgccgcgctctttgacggatacaagatgttccacgggccctacgagccgtctgacctcacttactgaagtgcgtatgggaaggacacaggcactgccttacaagaacgctcgtgggacatagcacggcgacttggacaggctaatatgtccgctatctggaacactaccatgttggtgacgagcgaactctgtattggaggacagtgggcttgacaactcccgctaattgagagacgcgatttgcccacagcttgaattgtctttggtcattcagcggtaaggtgtttaacgacaanggactgaagcgcgtacatatcaatgtgacccactggctgtgtccaagggagacactatcctagctttactgaaattgctgcttgatggact

SEQ ID NO: 710608 - DNA, 322 bp, Homo sapiens
  misc_feature (280)..(280): n is a, c, g, or t
  misc_feature (287)..(287): n is a, c, g, or t
atatgagcgcccgtgcaccaccattctcgtcgttcgaattctctttcgatctctctcggtcgagctgctgagattttctaaattgaaaatttgccccctcccacactccaggaatcactccagtcttagagcttgttaggaccgattgggaggcagcccccgaagtggacatgccccgtttggacacagtccgagtgcaatgggaagggaatggtcaatccctgtcctggttgtccaagtcgggatctcagaggaaattgcagtgattccacggttaggnccccctnggggggttgctttcccctcagcctctccccacacg

SEQ ID NO: 710609 - DNA, 186 bp, Homo sapiens
agtggtggttgaacaggtctctatgcccaggtgagtgcatgatgcaattatagctcattgcagcctcgacagtcctgggctgatctgttcttcctggctcagcctccctagtagctgtaccacaggtgtgtaacaccacgcccagataatcattaaatactaagtatagatgaggtacactaacgt

SEQ ID NO: 710610 - DNA, 268 bp, Homo sapiens
gttgctccagcatgggggactacagacatgcaccaccatgcccagctaatggtttttattttttatacatatggggtctcgttggtgttgcccaggctggtattgaactccgggcctcaagcaatcttccctcttcggcctcctaaaatgccggggttacaggtgtgagccacttcactcactttagagattttcactttatgaatggataaatacagcatggcatcacttaatagggatacattctgagcaatggggtaccgagctc

SEQ ID NO: 710611 - DNA, 205 bp, Homo sapiens
gtcgacatgctctctgctagcctccatttgcacttacctttgtgaactgcagcgctcatagattgtttttctgttgttttttgtttgtttggtttttgagacagagtctcactctgtcacccaggctggagtgcaatggcatgatctcggctcactgcaacctctgcctcctgggttcaagtgattctcctgcctcagccccccg

SEQ ID NO: 710612 - DNA, 478 bp, Homo sapiens
  misc_feature (33)..(34): n is a, c, g, or t
  misc_feature (355)..(355): n is a, c, g, or t
  misc_feature (455)..(455): n is a, c, g, or t
  misc_feature (458)..(458): n is a, c, g, or t
  misc_feature (461)..(461): n is a, c, g, or t
  misc_feature (463)..(463): n is a, c, g, or t
ctgacattttttgactacgatgcaccttttggnnctttactggtgaactctttacatgatgattatttatgatgtgcaaaatgtgagattagagaaaaaaaacaaaacaaaagcaaaacacctaaaacttaatttgatgctgagttacaattcctttgaaatttcaactgttaggggttcacagccatttctccaaactgatttcttggaactgcactaggagagcaggtggcttgtgtgtctttttcactcttgtatgcccagcacttggcatggtgtctggtacagagtgggctctccaactacttgcaggatgagtgagtggcatgcaggcctggctgtgggcctggcacanagataatatgttcatttccatattttgtaggtgtcacaatctgaaatctggttatttcagattgacccttccagaggcagagatttatctagaatccttnaanccntncaatttcaaaaaaaa

SEQ ID NO: 710613 - DNA, 1490 bp, Homo sapiens
  misc_feature (857)..(857): n is a, c, g, or t
  misc_feature (879)..(879): n is a, c, g, or t
  misc_feature (899)..(900): n is a, c, g, or t
  misc_feature (908)..(908): n is a, c, g, or t
  misc_feature (925)..(925): n is a, c, g, or t
  misc_feature (928)..(928): n is a, c, g, or t
  misc_feature (938)..(938): n is a, c, g, or t
  misc_feature (945)..(945): n is a, c, g, or t
  misc_feature (952)..(952): n is a, c, g, or t
  misc_feature (964)..(964): n is a, c, g, or t
  misc_feature (974)..(974): n is a, c, g, or t
  misc_feature (976)..(976): n is a, c, g, or t
  misc_feature (981)..(981): n is a, c, g, or t
  misc_feature (994)..(994): n is a, c, g, or t
  misc_feature (999)..(999): n is a, c, g, or t
  misc_feature (1013)..(1013): n is a, c, g, or t
  misc_feature (1015)..(1015): n is a, c, g, or t
  misc_feature (1018)..(1018): n is a, c, g, or t
gttcatgcttcattaaggcaggcattgcaaactagttcagaggagagaatccacgatgacagcacattctgtgccatggagaacattcttaaatcaagcctccagtggaggaaggactcaagaatgaaatagcaccagataacggggcatcattagacttgtaaagcaaagcttccattttctatttttatataaaccattattaatgcctttaaaacaactgtgatatctggacaaataaaatagaaatgacttcttaagatgattgcaacttttagtcttgatttataaaaattattctacataattttagtagggtaactgataatttttctcacttttttttggttttagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtgttgcagttatgcagaatccaaagtaaatgttctgctanctagttaaaggattgtttaaanctggtattttgctatttgcnntgttaganatgactgatgacatatntgnaagacaagtntgttganaagttgntggtgtaaatancgtttgaaananttganctacaagggcctnggaanaatttcagaggttngnaangagaaaccaataggctttgaaacctgtgtgccatattgaagtagttacgtatgaatgttatggtaatcttttatggccttcactgttacaatattcgtagcctctagatcaagaggaaccgagcaatttgctgctatagaagtccttgattgtagcatctgatatatcatacaggccatacatttaggaaagtatttcgctgaatcggggaacttttgcagtcgaattcatttgccttgagtttttcatcttccgtataatgtactggcgctttctatcaccctcattctaatctttcatcgtatctgggtgtcgcaaatcttgggggtaagacctgagtcatgagtactttatgctttgaaagttttcacgcggacagaaaggccttttaaagtgaaccttgttgacgtttacggggggctattgcacagtgtcactagcgaagtttacttgactaagtgccaaaagaccg

SEQ ID NO: 710614 - DNA, 697 bp, Homo sapiens
tccaaatttcgctgtgatgataaaacctgatcatagaccttaagatctttggaatatgtttatatgtatgtatgtatgtatgtatgtatgtatgtatgtatatatatggagagagagataggttgttttcatgagaattaagtttgacttattttccaaagttcttttggtggcctactgtcctgctaaaatggattcatcactacacgtcaatattagaaagcagctcactgaggccagctggtggcctcattcctcataggcgtgaggaatgaaaccgagcgaaggccattttaagtaacagctgccttttatctggccagcgctgccagttctggcctagcaagcatcccagtccatgtagtacttccaaccgcacgaaagaccgccaattgactgtatctgtcttcctactctgttgctccatagcggtaccgccgttcatcgaagatcggtttataaccctctggcatgtatcgaaacagcttttcgaaccacacacacaagactacatccttccccacctcgcatgcttcgcggtacaaaggatccccctcttcccccgccaccgggctcgccccttccaccacagacctctacaaggagcccaccgcatacccatccgccaaccacatgtcctcccccccccgactccccctgtccaacaccagggactactcaactctccaacaaacaa

SEQ ID NO: 710615 - DNA, 262 bp, Homo sapiens
  misc_feature (45)..(45): n is a, c, g, or t
  misc_feature (244)..(244): n is a, c, g, or t
  misc_feature (262)..(262): n is a, c, g, or t
ccataaccattgttcccgccaaaccactcaccctgtcactctctntaaattagccagttggagttagtttggcctgtgtggtctaaccctagccaataggggaatgacacagcagcaggggccatgtgcatcagggataagaaccctttcccctcccttgtccaggtgtgcactcaaccattgctccatctgtaagggcgcacccttctgtagaagtacattgacttgctgagaattaaaaagnaaattttaaaaaacaaan

SEQ ID NO: 710616 - DNA, 154 bp, Homo sapiens
gtaagagtcagctaattatggatattgtcatctcggtaactttgtaaaaaaacaaacaaaactggcattgttaattccaaaagaaaaaaaaggcagtaaaaaaaaaggtcattggcaccaccagaggaacatggtttaatggattaatagtttt

SEQ ID NO: 710617 - DNA, 358 bp, Homo sapiens
gattgcttgaggttatgagttcaagaccagcctgggcaacaaagcacaacctcgtctctacacaaaatagaaaaaaatttaataaggcatgggtgctgtgcatctgtagtcccagctactcgggaggctgaggcgggaagatcacctgagcccagaagatcgaggccgctgtgaaccatgatcatgccactgtactccagcatgcatgcgtgtgtgtgtgtgtgtgtgtgtgtgtgtgtgtgtgtgtgtgtgtgtataaaagaatctaagacagctcactgcacttcattgtaaccgatgaattgctctcccaggaagcctggggttctgtggagagagcattgtatagcctgtcaca

SEQ ID NO: 710618 - DNA, 461 bp, Homo sapiens
aagcgattctccggcctcagcctcccgagtagctaggactataggtacactaattttttgtatttttattatttatttatttatttatttcgagactgaatttcactctttttgcccaggctggagtgcagtggcacaaactcggctcaccgcaacctccgcctcccaagctcaagcgaccctcccgcctcagcctctggagtagctgggactacaggcatgcaccaccatgcctggctaattttgtatttttaatagagatgggaattcaccatgtaggtcaggctggtctcgaactcccgacctcaggtgatccacccgccttggctcccaaagtgctgggatcacaggcatgaaccactgtggctggcattctttgttatcttttgtagagatcgggttcaccgtgatagccaggatagtctcgatctcctgacctcgtgatcccccagactatggct

SEQ ID NO: 710619 - DNA, 171 bp, Homo sapiens
ctccccccgagcgccgttccgcttgcaccgcgctcgttccgagtttcaggctcgtgctaagctagcgccgtggtggtcttccttcagtcgccatcatgattatctaccgggacctcatgagcacgatgggagtgtcttccgacaattacaggatccggggaatggggcggg

SEQ ID NO: 710620 - DNA, 1023 bp, Homo sapiens
ttcgctctcagggacgaatttatttcgtagggcccacggttttggtcaaccccgccgctctgtaactataacacactccgtttggggggggggggtccctcaaggtagaatgacactcgtgcttgggggtgaaacaccacatgagtggggcgcctgtataaccaccacctggttgtttgccgttgcggccgctcctatacgcgatgtaccaaatagtgcgtcttctcacagaggcccgccgccgcgtttattcacttatagttttgtaggtctcactaggggcccctattgcgctggcgcgacaatatttttcatcgttcgcgcgcaccatattcgtccagtgaaccgcgcgggttctcccacccccagagtatggtgcacacacacgagcttccctcccgacccgtcccgcgctcgtcgtttctgtgccgcgctcccggagagaatctggcggagtgtgttacaccgccccaaggaacgcaccgcctctcttgcctccgcggtgtaagtaattttaattgcagtacaataaacgcaccctctctggggtggactcgtgtgctaatcgacctagtgcttctactcattgaatctaaaacgaggatttgtgggcggcgccgacaatcaacttctgtttttgacttgctgactctgtttgataataagttctttattaagaagttagggcgtccccaggaatgccacccctactatgtgcgagcgatctgatgatactgtggctgcaccaccatatactgctgtggttctcaccatggagacacctctcattgtgcaaattatctctttactagatcagtgctgttgtattgccctcctctccgcaagctcccctcacctctcacgagtagcgcccccctccgctcatcgtggcacacagaccgcatctgtcaagctttcatccggcatagcccagatgggcccccaagacttcattttgggcccccttttttaaaaaaaaactatcttccaaaaaacaaaacaaaaaaaacacaaacataaaaa

SEQ ID NO: 710621 - DNA, 627 bp, Homo sapiens
agaaaacacctttgaaggatcggggagaggaagtctgagatggcaggagagcctttgctcttccttgcgggactgtgacaagagacaggaagaaagaaccaggaaagatttggccaggctgatgagtgtcctagagccaaagatgcctgtcagggagtcccatgtccacaggaacagctggcaccagaagctcttctgtgctccatcactgaccaggcacattctgtaacgtgcgtggccgtggcatgaacaggcagcagatcctgagggtcagcagatgcagggtcaggagcagcaggagcgttgcagaggagcacactttcctccctgcagtaggagctcggcagagcacattttcatggccaccacacttatccaatagaattgtgttttaggaatcctgttttttagctctagaaattctgtttggtgctttttatgttttccagttctctccttatgtttttcatttaattcttagagcatactgaacatttttataacagctgttgtaatgtctttgtttcctaattcatcgtctttgtcagttctgagttggcttgatattttccccttgtatgggttacattttcctgtttcacacacaaggaagtccggtccgagctc

SEQ ID NO: 710622 - DNA, 243 bp, Homo sapiens
ctcaattgggtttaagcacagggtaatatttctccaggtatcatccaaaattccccagagaaaaggctttggcctcattaggggttgccccagcctaaccctccaggacggttccattaaattgcgccagattttaaatccggttacctccactttctgaaatattctttactaatgttattgaaaccatttctacttcaaactgatgttttggaaacgagcaattaaagtttttcttccatg

SEQ ID NO: 710623 - DNA, 218 bp, Homo sapiens
cctcctcatgctgaccaagtgctgggataacgagcgtgagccactgtgcgttgacacctatggtgctatgcacttcattgtgctaacgaacattctgaattacatgagcttttgtatcacttcatgttaaaggtatcattcttatgtaccactgtatctcatttgaatttgtaatgaggctgatggtatatttcaattttttgctttgagggaggagg

SEQ ID NO: 710624 - DNA, 174 bp, Homo sapiens
  misc_feature (162)..(163): n is a, c, g, or t
cccaaggtataggagaagaacttacaatgtatggactaacttctctttgcaagaacgcagattaaaatatatgcgtaggacccattatgtattattcatgatgcacatgcagtactcacacatatatacacacacagtaatatatagtgcatacacacggcnnaagtgtgtgta

SEQ ID NO: 710625 - DNA, 404 bp, Homo sapiens
caaggcgagtctcaataagtttttaaaaatggaaatcatactaagcatcttctcagaccacagtgaaataaaaatataaaccagtaccaacaggaactctcaatactatgtaaataggctgggctcagtggctcacacctgtaatcccagcactttgggaggccgaggcaggtggatcacttgaggtcaggagttcgagaccagcctggccagtatggggaaaccccatctctgctaaaaatacaaaaactagccaggcgtggtggtgcacatctgtagtcccagctactctactcaggaggctgaagcagaagaatcacttgaacccggggggcggaggttgcaataagccaaattcgtgccactgcactccagcctgggcgacagagtaagactcctcaaaa

SEQ ID NO: 710626 - DNA, 934 bp, Homo sapiens
gcgtgcggagcgcggcgggggtcgaggctcgagctcgcgatccaccgccgcgcaccgagcaatcctcgccaccctcggcctgggttcagccctgggccgaggatgatgggggtcaggcggcctgcggtctggggaacgccccgaccatgaggctcttttcgtgccactggggggcggggcgtgagagcggctcagcaattccccttgctcataaggtgaaggcttgctcatccagggtgggtcaatagagccggagtgcccccaaccgtttggaacaagtgtgctgggggaggaaggtcctcaatctgcccgagcttttttcacctaacgccaatgtacattctgtgcaaggtggctgggagatcagggctgtcccgaagccgtgagtcccgggttgatgtccgaacggccctctctaatgtgacctcgcgggtagcatgacgaaaggtttccctccagatgaagatggaggcagggttcccaacaaggatgatatgaagactttccctgaagaaaggtggtgaaggagacctcctacgagaatgatgatgcagctgtgtgtccgcatgtgtgcccaccccgtgatgttatcctcattgcgctgcatggtcccagttgggtggcagggaggccaaggtacagggggtggtggagcccattgggaaagttacaacgacggaggggctcgggcatactcgcgggagaaaccgaaactcgggggcgaatgggaactagggggcgaacctggggccattataaaagccaccgggggaacggtgtggacccaggggggagcgacgaaacagggccataaacggccggcacgaggaacagtgggggggggggggcaggcacctcgggaggggcagggggaaagcgggggccccaccagatatgttggagaagagcgcagcgcgcgggatcgggaaaaacc

SEQ ID NO: 710627 - DNA, 1136 bp, Homo sapiens
ccacgcgtcgcggacgcgtgggctgcgatagtccactacgcttatttcgagagtgactcccgttgtcccaaggcttcccagagacgaacctgtgcggctgcaggcaccgggcgtcgagtttccggcgtccggaaggaccgagctcttctcgcggatccagtgttccgtttccagcccccaatctcagagcgtgagccgacagagagcaagggacccggcatggcccaaagccgcggcgatcggcatcgacctgggcacaactactccttgcgtggggggtgtcccaacagggaagggtgggagaatcaatcgccaacgaaccagggcaaccggaaccaccccagatacgtggccttcacggacaaccgagcggactcatcggggatgcggccaagaaccaggtggcgctgaacccgagaacaccggtgttttgacgcgaagcggatgatcggccgcaagttacgggcgaacccgggtggtgcaagatcggacccatgcacgcacgtgggcctttaccaggttgatacacagacggagcacaagcccaagggtgccaggtgagctacaaggggggagaccaagggacattctaagcccgaagggagatctccgtgccatggttgctgaaccaacgatgacagggcggatcggccggaggacgtacctggggctacccccgggtggacccaacgcggtgcatccaccggttccggcactacttacacacggactccgcagccaccagggccaccaaaggatgccgggtgttaaatcgcgggggctcacaacgttgctgcggataccatcacaaaggaggccccacgaggacgcggacgacccaaatggcctataggcgacttgtgagagccacaccgcgagaaccggggcggcatgcgtgcaacacagctggacgcacaccatatggaggcctggagaccagggggcacccacttaccgcagcggtgtgccccaataccgtgaacgaacctacagacacacgacactcttctcaagcgagaaagacagcaccgggcaggggcaaccccccacagggaaggggagcaggccacatgaaaccaaagcaggtagtagacagacaatacggagaaagagctagagaacaacaacaaaaaggc

SEQ ID NO: 710628 - DNA, 129 bp, Homo sapiens
aatcgccacgacaggagcatgtggaaaactgtgggtggcaaaccacccaggtgctgaggcaagagactgaggacacgagctgttccagtataataaaatataaaacaagaatagttgtaccagaatata

SEQ ID NO: 710629 - DNA, 539 bp, Homo sapiens
  misc_feature (112)..(112): n is a, c, g, or t
  misc_feature (291)..(291): n is a, c, g, or t
  misc_feature (512)..(512): n is a, c, g, or t
  misc_feature (521)..(521): n is a, c, g, or t
ccctgaggatcaccggcagaatacactcaaaggtttgcacagtcagcattgcatgtttttgtcaacactgagcactgattaatataaaacctgtgagctgatcagctcattnaccctgcaacaggagcacaatgctggcacccccaagtcacccagaggcactgggagctcccaagggtgctgcggtgccaggccatactccctcctccaactcagtcttcagcaactcctctcccacagcacagttgaagaggccaggccagaggcggagttgtgggggtgcagaatgcnttcacagtgaacctttttcagctacaaaacatttctttactaaaagctgctgagggggagcagggagacaataaaacaccaaggggatttcaaacgcgttaagcccactctgcctttgttcttatttgatgaatgcaaaaaccacccagcagttgacaggcaaaagaacactgctgcacgggaaagtgcatttcatcagtccagcctcggatctccagganaggtaagtntgagtgtgattctggccg

SEQ ID NO: 710630 - DNA, 263 bp, Homo sapiens
tgcgagtatagagtatcctgggatatagggcccagcgggctgtggacctcatccaaaagcacaagagcatcgaggagatcgtagcaggcgacttgaccccaacaagtaccctgtgaccagaaaattggctaccacaatggaggctcaccatgctcttctatggaacctagaggtgctaggacccaggagtactcgtggagctagaagtaggcagcgcgccaaatagaagcaagagcttgatcaagttacattgtgtgagtgaa

SEQ ID NO: 710631 - DNA, 150 bp, Homo sapiens
  misc_feature (14)..(14): n is a, c, g, or t
ccaatcctgatgtnccaccctggtcaggccacctgcaccattaaaattcaacacctgtggctttctgatatcattttcatttatttggtgaaaaattcttgagggtctcttgtgtgttgggctgtatggtgaggattcagctgggaaaca

SEQ ID NO: 710632 - DNA, 321 bp, Homo sapiens
ccccaccgtgatgagggttgctgctagccccggcagcagattgcagcggacatcccagaagtggttgtttcgccttgcatgggagcgataatgcttggctccagagcatccaggctcaaggaagaacatggcctgctattggagaataccagcgtgcattgcaggagaacgtcgctatggaaccgtgcatctaccagggtaagactcttgtggcattctgcgtgctgagcttgcatcacacaagaaaaatgagctcaaaatgtcgctttgagagctacagtgaattgctatggctcctgtaccttctgctcattttccttt

SEQ ID NO: 710633 - DNA, 336 bp, Homo sapiens
tggtgtgattccatttatataaaatgtccagaaacggggaaaccctattttaaacaacagaaacccaaagtcgatcagcagttgccaggggaggaggaagacgggaggggaaatgatggcttcacggggtgatcgacccgatatgtcccacgaacagttgacagagggtgggtgcctacgacaatgtttctggatgtactagaatgccgactgcatgtgtagcatttctcacgctgcatgagattgttaagagttagtctcggaacttccatctcaattaaataacacccgaagacacgcaatacgtgtttcccgccagcttcagccccgaccaga

SEQ ID NO: 710634 - DNA, 1028 bp, Homo sapiens
ctgctcccgccaccctgcccgccgacatgcgccggctgctgccctgacatggtgctcgacaggaaggagctggtgtcctgctgcggggagatgctccacatccgctaccggttgctccgacaggcgctggcgagtgcctggggaccctcatcctcgtgatgttcggcatgtaaggctccgtgagcccagtgttgtgctcagccgagaacacccacggatggtaaaacctcaccatcaacctggaccttatggcttagcatgacactctgaggcatcctcatcgaatggacaggtctctggaggcccacctgaaaccatgccgagaacctatgcacatagatgcattcctggcatcgtgagcccatgagatcaaagctgcccatactacacacctggccacagacgctgggagccatacttgaggtgctggaactagtataaagaggactgtaattactgaatgcaaacatggccacataaagcacacagaaaaaacacaagaccaaaaaaaagattaacagagagacccccaaaattgggcaaccaatgcgccgtgacaattcgttatgacataacccataaaaacacacatcttgggacaaccctatgagaattaattgaatccaaatgcgcactatacataattagacacaacggatacaaaaagagacaaacaagaaacaaacacacgtaataaaataccgaatgattgggaagaaaaggacatgagggcacgaaaataaagcaaggaaacccaccgaataagaagaaccaaaacaaccaaacaggaaccaccaacacagaaaaagaagacccaagaagaagaggcaccgaataaacgacgaactagatagcggagaccccatagatgcaatgagatcaacacaagggagcatgcaataatggagaaaacacaaaacaacaagaagaggaagcaataaacaaacagataacgaagaaaaataagcacgagaaacaaaacaccaatgagacacaaggagaaaaataaatgacgaagacacaacaag

SEQ ID NO: 710635 - DNA, 135 bp, Homo sapiens
tgcagaggaagttgttttctttcttctgatctgtgtctcaaaggccagcaaatggtttccaatacagtgcctgcagctgagggacacgactccccaggcaggctgagagtctgtctgtctgcaaggaacccactg

SEQ ID NO: 710636 - DNA, 145 bp, Homo sapiens
gccttcctcactaagcttaatcatttctagcttttgatttagagtgagagatgtgtgactctacctttcaactgaacacttacaggccactgtgttgaggtgggggttgtttattttttatccttgtttttttatttgtcgacgc

SEQ ID NO: 710637 - DNA, 256 bp, Homo sapiens
atccccgctcaatggcagccggcccaatggcagccgaaggcgagctcattttggacagaaacctcccgtggagcagaagggggggagttttcttgatcttgattttcactccgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgt

SEQ ID NO: 710638 - DNA, 595 bp, Homo sapiens
agacatgtgtaccccctgctgcagctgcagcacgggtgctgataggagtaggctgatagcggacatactcctcctttcacatagtcggcaacctgatccactccttcggctactagagtctcgcaccactgccctggtgaggaggggggacctgggctcccacccatgtgggcccaagacagtgtttcccctttcctggtttcccctccatcccttcctacctcccttgggtttaggttggcttgtttctcgttggtactagaggattcagcgtgtgcaagcagtggggagggtgtgcctgcagaggggacctgtcaagaaggggcaacccagccccaccaggacagagactgataatcctcctgtcagtcacctggtcactcagcccacctgttttctgtggagtctttagagtgggtctcaggggccaaacaacaccaagatggggacacactgtggaacaaacctctgtcctcccacgggatccgtgcacgttaacgattactaggctatgcggaaaccttgttgtgtttttttgtttgctgtttgtttgttctcttgtcttctttttgtttttgttcttgcttttttttct

SEQ ID NO: 710639 - DNA, 175 bp, Homo sapiens
gtgtggtacggtgcggggcatccatatagtcactccaggtttctggcagattcttctactattaggacttttcgcttcgaagccaagctatcaaatcatgaacattattaatattactgctgtcagagaaatgactgagcctacagatgataggatagaacatgtggtgtatgca

SEQ ID NO: 710640 - DNA, 734 bp, Homo sapiens
  misc_feature (123)..(123): n is a, c, g, or t
  misc_feature (167)..(168): n is a, c, g, or t
  misc_feature (172)..(172): n is a, c, g, or t
  misc_feature (184)..(184): n is a, c, g, or t
  misc_feature (189)..(189): n is a, c, g, or t
  misc_feature (222)..(222): n is a, c, g, or t
  misc_feature (246)..(246): n is a, c, g, or t
  misc_feature (255)..(255): n is a, c, g, or t
  misc_feature (268)..(269): n is a, c, g, or t
  misc_feature (325)..(325): n is a, c, g, or t
  misc_feature (333)..(333): n is a, c, g, or t
  misc_feature (357)..(357): n is a, c, g, or t
  misc_feature (360)..(360): n is a, c, g, or t
  misc_feature (362)..(362): n is a, c, g, or t
  misc_feature (389)..(389): n is a, c, g, or t
  misc_feature (411)..(411): n is a, c, g, or t
  misc_feature (655)..(655): n is a, c, g, or t
  misc_feature (662)..(662): n is a, c, g, or t
  misc_feature (668)..(672): n is a, c, g, or t
  misc_feature (676)..(676): n is a, c, g, or t
  misc_feature (687)..(687): n is a, c, g, or t
  misc_feature (694)..(694): n is a, c, g, or t
  misc_feature (697)..(697): n is a, c, g, or t
  misc_feature (701)..(702): n is a, c, g, or t
  misc_feature (705)..(705): n is a, c, g, or t
gggtttctgctgggtgtaggtccttgggtggtcgggcctccggtgtctgcttctccccgctgagctgctgcctggtgaagaggaagccatggcgctccgagtcaccaggaactcgaaaattantgctgaaaataaggcgaagatcaacatggcaggcgcaaagcgcnntccntacggcccctgntgaanctccaagcccggatgaggccaagaacagctctntggggacattggtaacaaagtcangtgaacaantgcaggccaaaanngcctatgaagaaggaagcaaaaccttcagctactgacaaagtcattgataaaaaantaccaaanctcttgaaaaggtacctatgctgntgncnagtgccagtgtctgagccagtgccagnagccagaacctgagccagaacntgagcctgttcaaagaagaatgaactttcgcctgagcctattttggttgatactgcctctccaagcccaatggaaacatctggatgtgcccctgcagaagaagacctgtgtcaggctgactctgatgtagtgcttgcagttaaatgatgtgggatgccgcaagatggaggcttgatccaaaccttggtaagtgaatatgtgagagaatatttatgcttatctgagacgacttgaggaagagcangcagtcngaccannnnnctantgggtcgggantcctggnacntgannccntctaatggctgctagtccgtcgatgaatc

SEQ ID NO: 710641 - DNA, 895 bp, Homo sapiens
  misc_feature (36)..(36): n is a, c, g, or t
  misc_feature (72)..(72): n is a, c, g, or t
  misc_feature (77)..(77): n is a, c, g, or t
  misc_feature (98)..(98): n is a, c, g, or t
  misc_feature (115)..(115): n is a, c, g, or t
  misc_feature (144)..(145): n is a, c, g, or t
  misc_feature (208)..(208): n is a, c, g, or t
  misc_feature (231)..(232): n is a, c, g, or t
  misc_feature (251)..(251): n is a, c, g, or t
  misc_feature (255)..(255): n is a, c, g, or t
  misc_feature (265)..(265): n is a, c, g, or t
  misc_feature (296)..(296): n is a, c, g, or t
  misc_feature (299)..(300): n is a, c, g, or t
  misc_feature (310)..(310): n is a, c, g, or t
  misc_feature (320)..(320): n is a, c, g, or t
  misc_feature (327)..(327): n is a, c, g, or t
  misc_feature (346)..(347): n is a, c, g, or t
  misc_feature (352)..(352): n is a, c, g, or t
  misc_feature (373)..(373): n is a, c, g, or t
  misc_feature (377)..(377): n is a, c, g, or t
  misc_feature (380)..(380): n is a, c, g, or t
  misc_feature (386)..(386): n is a, c, g, or t
  misc_feature (392)..(394): n is a, c, g, or t
  misc_feature (404)..(404): n is a, c, g, or t
  misc_feature (408)..(409): n is a, c, g, or t
  misc_feature (426)..(426): n is a, c, g, or t
  misc_feature (449)..(449): n is a, c, g, or t
  misc_feature (455)..(455): n is a, c, g, or t
  misc_feature (514)..(514): n is a, c, g, or t
  misc_feature (585)..(585): n is a, c, g, or t
  misc_feature (709)..(709): n is a, c, g, or t
  misc_feature (759)..(759): n is a, c, g, or t
  misc_feature (889)..(889): n is a, c, g, or t
acacacaaaaatgtaaaaaaaacaagcaggaaccgntccggaaaacccgggaaggactctctctgcagccanatcancttcctgagaaaagaccaacngccaaaacctcaatganagccaccctggaggacagggcacaacaanngtttctggagagaaagggaggattccaaaagggcaaaaaaagaacaaaggctgaaagaaaaanaaaaaaaaaaaagtctgcaaaannaacggcaaagaagaaaaancaanagggcaaaanaagcagcgggaaaaaaaccaaaaggaaaaanaannatggccaacncgtgtttgantccaaantgaaggcccaaacaaaaannaaaangtgccaagagaaaaaaaaaanaagnaangggaanaaaaannnggtggttganacgnnctccaactttgaatcanaagccgaaacccaaaaactgaanaaaaanaacggggactgctacctgctctctgaccccggggcacaccacgtcctgcttctggtganccagactggggcgtttacactgctacaagacacaatggccaacaagaaggagaaaaaagacattgggacangggccatgaaacaaatggtcaacctcttcaaccacaaaaaaaaaagggggccaggccctggatgactatgtagcaaacacggacaactgcagcctgaaagacctggtgcgggagtgtgagaganggtactgtgccttcaacaactggggctctgtggaggagcagaggcagcancaggcagagctcctggctgtgattgagaggctggggagggagcgagagggctccttccacagcaatgacctcttcttggatgcccagctgctccaaagaactggagctggggctgccaggaagactacangcagta

SEQ ID NO: 710642 - DNA, 133 bp, Homo sapiens
cccttttttcccggggggccccccccttttgggggggccaggggttttttttcccccccccccccccccccccccggggttttttttggttttgggggggggggggggtttttttttgggggttttttcccca

SEQ ID NO: 710643 - DNA, 162 bp, Homo sapiens
tttatgctgcgtcgtttctcgacggatccccgtgatccacctgcctggctcccaaatgctggcattcaaggtgtgcagccatgtgcccagttcaattagtttaaaatgcagcagttggccgggtgcagtgactcacgcctgtaatcccagcactctgggagg

SEQ ID NO: 710644 - DNA, 231 bp, Homo sapiens
acctgatgctcaaggacctgggccttgcgactgaggctgcgcgccaggcgcatcagccggtgattctcggcgcagtggcccagcagttgtatcaatccatgagccagcgtggggaagggggcaaggacttctcggcgatcatcaacagctatcgcaagcccaaataaatacctgtggcgagggagcaagctccctcgccacaggttttgctgggtcaggcaaacacaaaat

SEQ ID NO: 710645 - DNA, 934 bp, Homo sapiens
gacgggacattttgaaatattcaccatgctgctggcatccatgattctagtggacattttccaggtgaaggctgacgtgttacacatgtgtgataatgcatgtgatgatgaatacctgagatgtacggactggatggtaacactgtaaatacagttccccaactgctaataggaggaataagcaagccgagcagcgaattgagatacgtgtgtgggaaaatgcaaagagccaagatgtggcagccccgacaagactcaaatctttctccctatgaatttgaaggataagcatggaatatccctgatggcatatatttccgaagctcaagagcaaactcccttttaccgatctgttcagtgaagctgtgaagatggctggccaatctcgagaagattatatctatggcttccagttcaaagctttccacttttacctcacaagagccctgcagtctgcttgagaaaatcttgtgaggtcagttccaagaacgtgtggtatatagaatcaagccagggctttcatttacatttggagggctagaccaggtcaggttgggccattttaccttggcatattcaggcaaacgtcatgctgtaatgaacagctcactgtgttatccatctactgcatgccttggagttggcctttgcccactttgtctggttacagcacggggtcgatttctttacttctctgaatgacgtctcacttgtcccgggggggtggcaatacgttgctcaaggctaacaagaactgggcgttggtggggtctcagtggctcaacggacggttggaccaaatttcccttgtgttcgccgggtgacggtgtgcctgcaacggtttgctgggggccctgcgcgggtgccctcggatatcttcttattgttgtgccttctggtttttgtgtttgagcttttttgtctcttctgaaca

SEQ ID NO: 710646 - DNA, 180 bp, Homo sapiens
atacgctgtgcccagtacaagaaggacggagctcgactatcgccaagtggcgtatgtgtagctgaagatgggggaacacaccccctcagccctcgccatacatggaaaatgccaatgttctggcccgtaatgccagtatctgccagcagaatggcatagtgcccatcgtggcgcctgagt

SEQ ID NO: 710647 - DNA, 806 bp, Homo sapiens
gaccgaccaagatgctgtctcaggggaaaggaatgctgcgtcaatagattccagcaagtagaaagccgctggggttacagtgggacgagtgatcgaatcagattcacagttaatagaaggatctctatagttggatcttggcttgtatggatcctcatccatggccctacagattcatcaagtgcaatatacgagatcgattgcaatatgagcacacacaagcaaacccgtgggacagcaatgatgaccggcgcttttagtttgtgcattgcggacagcatcacacacattccagggctcattgtctccaaaggaacccataagagatcctgcccaaatgtcgtgctacacatgcctgtgcaacactcaaaggtccagattcccactatggcacaaacggattgcacgacaagtagtgcatgcagacaacctggcttgcaagcaagcacccgtgttcattctttcatcttagttcccctggcaatcaaataacatggcacttcaatagaacgatggacaccattccagaaatcatctttcatcacacttaattctagcatccacttcactcacatctttgggctaaactaattaccataccaatctagtgtccaaaaaacatcagatgggccccaacacaaagtagtccgcgtgtcactgccatcatctcaccattgtcacgatacagaaacagtttctctcgacgccgatcgcacaccgctctttacctctttgctgatcccccacagctttgcctctcctcacacttccgacaaaagacgccgtacgggtaacaccagcccctt

SEQ ID NO: 710648 - DNA, 184 bp, Homo sapiens
actgatatgtatacttttgaatgtcctagactttaaatatctgtcttctgcaagtgggataagagaagaatgaagaagaaaataaaagccaaaaaaaacaaaaacaaagaagggaacaaagtgaattgcccttaaaatcccttgcaagttgtttccgcctgagggaaggggttggcacttgtcc

SEQ ID NO: 710649 - DNA, 330 bp, Homo sapiens
  misc_feature (142)..(142): n is a, c, g, or t
  misc_feature (289)..(289): n is a, c, g, or t
  misc_feature (317)..(317): n is a, c, g, or t
  misc_feature (322)..(322): n is a, c, g, or t
agaagtggaagtgtcctcccttgagcctcaccaagctctgggaacgagagccacagagacggtgtacagtgagatccggaaggtcgaccctaatctcatggaaaacagatactctagaacgggaaggctcccttaatggaanttaagacagtcaaggcagtgcacgtccctgggaggtcgtccatgtcccgagaagagcagccgattcctggattgcgaaaatcctgtgcacgtatttatgaagcctgtccccaccgaaagcagtaatccttcagggcaaagccatccnatttttaaaaacccggcttggccttggntccangttttggg

SEQ ID NO: 710650 - DNA, 314 bp, Homo sapiens
ttagcacaacctagggtcagtcttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 710651 - DNA, 238 bp, Homo sapiens
gttatagtaagctatggttaatttactgttaaataattttttttaatgaatttagtgtaccctaagtatacagtgttcataaagtctatagaagtatacaataatgttgtaggctttcacatttactgaccactctgtgacacatccaagacaacttgctctatttaagctctattcatggtaaatgccctatacaggtgtaccatttttttatcttttatgtcatatttttacttta

SEQ ID NO: 710652 - DNA, 350 bp, Homo sapiens
gggtcttccctcctccctcctttccgccactggaggtagcacagattcatggtggagaacatggcttctagagcagatgacatgggtatggacctgactatgctgatgaaagctgtgtaaccttgagtagatgacctaggccccctgggcctcagttttcttcatggtaaaatgggggtaatctttgtgactacctcacagggtgctttgtggattaaatgaaccaatgcacataaagtgattaaactgcgtgagacataggcagcacaatgtaaatgactgctgctgacaattctatttttattacctcctccaagtattgactagaaggcattgtgctactgctctga

SEQ ID NO: 710653 - DNA, 1270 bp, Homo sapiens
  misc_feature (148)..(148): n is a, c, g, or t
  misc_feature (208)..(208): n is a, c, g, or t
  misc_feature (585)..(585): n is a, c, g, or t
  misc_feature (695)..(695): n is a, c, g, or t
  misc_feature (697)..(697): n is a, c, g, or t
  misc_feature (702)..(702): n is a, c, g, or t
  misc_feature (704)..(704): n is a, c, g, or t
  misc_feature (707)..(707): n is a, c, g, or t
  misc_feature (713)..(713): n is a, c, g, or t
  misc_feature (736)..(737): n is a, c, g, or t
ggtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtggagactatanaatattcaggaacgagatagtttgatttttttggttgatgcctccaaggctatgtttganctctcagagctgaagatgagttgacaccttttgacatgagcatccagtgtatccaaagtgtgtacatcagtaagatcataagcagtgatcgagatctcttggctgtggtgttctatggtaccgagaaagacaaacaattcagtgaattttaagaaatatttacgtcttacaggagctggataatccaggtgcaaaaccgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaanccccatggcaatgacagtgccaaaagccagcgggtcaggagcagaagccggtgatctccgagatacaggcgatcttccttgacttgatgcacctgaagaaacctgggggntntgacntntgnttgttntacagagatatcatcagcatagnngaggatgaggactcagggttcattttgaggaatgcagaagctagaagactgttgggaaggttcgcatccagtgagtatcctagggaaatggtagcagtcatgaggttaaaggtgatgctctacataacgataagtagtgatctctgtgggcattttttatcttggtccagaaggactctcatgcctcatcgaataaagctctatcgggaaacgagtgaaaccagtgataaactgttgataccggactttaactatcgagtacaggcggttttggttctgcttagcagataccaagagggtctcgagatcctatgggagtcgtccagaattattacttgagaaggagggactgaacggagtaaacggtttgatgatccgaggttcgatgtcatggtctcaagcgttggtatgttgagaaacacattattgcggtctccagtcgtgtacggaggagcagcgtgaagggatcaaccgtgcggggtgaataggtcggaagcatggggtttgcataaccgaggatcctatgggtcggc

SEQ ID NO: 710654 - DNA, 1590 bp, Homo sapiens
gctgcctccgccccgcgagctcagagcctcgcgcatttgcctgatccggcgaccagtgacacacccgccggcattttgacctatggatgatgtctgtcgccagcgcttcgttcgtcagaatgacgtgctccgagcgctgtgcaatggtccggccttcagcggaggctgacgtattgccccaccggagctctgtcatctcgcgccgtcctagtcagtgggggcgcctcccagtgtgccgcgaggaggctgtgtatgtcgtgggactactggcgtcgaaagagggcattcgcatagacgtgggtagaaagcatgggccccaagtaggcaatccgaggagggtcgggtcgccactagactcgtagaaagatacgcgcccaattctgcaagtcaccggcggcattctgttcagcccaaacatggagagaactgaacgattgcggagaaaacaatcgtgggctacgcaaaaacccatttgcttaacataagtgggagagacttcggtcgtagctaggggagctccccaggaaacgggcaggggcagaccccaacccggttggacctttggcatggagagccccgtagtggagagcaccccccccttaggaaacctcgccacaaaacggtggttcgaagctctggcggagagggaaacacgcacactgggaaagccctaacagcgatagtctcatatggtgctcccgggagaaggcgaacaccgtatttcataaaccgacccacaacacaagttggcgcaattggtgtaacgcgctactggtccatcagatctcctaagtgtcgcgttggttgggacataaaatttcccgcggtgggtaaagcagaccccttccatggggggcctagaaatcgcagagcgtgaggccaacttccacggagggacttggggcatcgttccctcagcttggacacacggaaacgggtctctaaaactcaatacacccagtgggtttgccccacgaattccataacagtaactggtagtgtgtagttagacgcccatatggcggcccacccgatttgtgtcaccaataaccccatgggacaaggttccattaggagacagcgcctatggtgtcatatcggggcgccttgtgtgcaccccttaggaactcgtggtgaatttaaggccttgcaattgggacacgtgaatctcccgtaacacccgggaggtcggccgtgaccttaaacagaggggttttacatgccgaaagccataggtgggacccggaaaacgcagggggacaaaggattcgggcggccgctgcgccctaattacaaagggtgtggacgcacactgcactagggtgggcaattatcaggtgttggcccctctcttagaggaaacttttcacggaaggccaacacggaagcgaatttgggcaccacatccggggcattgaggacataacaaacaagagattacgctacacccattgagaggaggcaacagaaagggcttaacgaaggcttagcaccttggaacgtgagccacagggtacaacatacaacagcaagtctgcgggacacagatgaagctcgcgggtaccccaggctagagacaccttagattgg

SEQ ID NO: 710655 - DNA, 208 bp, Homo sapiens
  misc_feature (185)..(185): n is a, c, g, or t
ctctccttctcacctggccagtgtcagctcaaggtcatcaatgtctttcttgagtactagaacattcatcctccagtttcctctatcttggctgtcagctcagcatatgatactctatcctcatcctacagctctctacagtcacctactttgattttaggcttctagctagaataatctcaagngggatcctactagaagtcgacct

SEQ ID NO: 710656 - DNA, 172 bp, Homo sapiens
ctatcctggactgccccgcacgcttaactcggacgtaccccgagtgcatacaccatataaacatcctagtcatctgtaggctcattcattctctctgacagacagtattattcatgattttcattgatttgagaagccttcgcttcgaatcgaacagtccagaattgccccg

SEQ ID NO: 710657 - DNA, 115 bp, Homo sapiens
cgcaaactcggatacactggatccaggatgtgactcactgggaaaaaatgttggactaggcatgttcagctgaaggagccagtgaagttatataaccaccacggatacacatcca

SEQ ID NO: 710658 - DNA, 1304 bp, Homo sapiens
  misc_feature (619)..(619): n is a, c, g, or t
  misc_feature (729)..(729): n is a, c, g, or t
  misc_feature (731)..(731): n is a, c, g, or t
  misc_feature (736)..(736): n is a, c, g, or t
  misc_feature (738)..(738): n is a, c, g, or t
  misc_feature (741)..(741): n is a, c, g, or t
  misc_feature (747)..(747): n is a, c, g, or t
  misc_feature (770)..(771): n is a, c, g, or t
cacccaaccaaccacacagctagacagccggggtgaatcggccgaggctcttgtgaagatgtgcgatgcagctgccgaggcgttcggtcctggctgttgcggtcgctgcccaggctgcggggacgctcccggagccctgcctgtaccctgtccatccaggtccagcagtctgaaggagcctcaccggcactcccttctctgagtaggcacggatttgaggagaagcagcgagagatgtccagcgagccatccccctccttatcctgggggccccacagccgcgcattctggaagagaaacagtggagcccgcagtcgataacgcaagtgatcgagatctcttggctgtggtgttctatggtaccgagaaagacaaacaattcagtgaattttaagaaatatttacgtcttacaggagctggataatccaggtgcaaaaccgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaanccccatggcaatgacagtgccaaaagccagcgggtcaggagcagaagccggtgatctccgagatacaggcgatcttccttgacttgatgcacctgaagaaacctgggggntntgacntntgnttgttntacagagatatcatcagcatagnngaggatgaggactcagggttcattttgaggaatgcagaagctagaagactgttgggaaggttcgcatccagtgagtatcctagggaaatggtagcagtcatgaggttaaaggtgatgctctacataacgataagtagtgatctctgtgggcattttttatcttggtccagaaggactctcatgcctcatcgaataaagctctatcgggaaacgagtgaaaccagtgataaactgttgataccggactttaactatcgagtacaggcggttttggttctgcttagcagataccaagagggtctcgagatcctatgggagtcgtccagaattattacttgagaaggagggactgaacggagtaaacggtttgatgatccgaggttcgatgtcatggtctcaagcgttggtatgttgagaaacacattattgcggtctccagtcgtgtacggaggagcagcgtgaagggatcaaccgtgcggggtgaataggtcggaagcatggggtttgcataaccgaggatcctatgggtcggc

SEQ ID NO: 710659 - DNA, 1306 bp, Homo sapiens
ggtcgtcttctgtccaagttggtcgcttccctgcgccaaagtgagcagtagccaacatgtcagggtgggagtcatattacaaaaccgagggcgatgaaacaaaaaaaaaaaaaaaaaaaacaaaaaactttttcggcgccgcgcctctggcgccctctcaaaaacgtttctcttaacaccttccgtttgggcgcgccgcgcgggccccaatggggttccggtcgacacctggggccatatacgcgtggtcccctatagagagagaacaccccgggggccatctggagacataagcgtcgctgggagattctccctccccacatatattaaaaaccgcgcccccgggggggagcagccccgagacgcgcttctcttggagacaccacatctccccagagattggagcgtctcacctgagaggcgccgactacccgggggcgatcctcatctatcaccaccacaggggaggagcgtcgccaacagcggagaaccctccgagaaatctctcgacaaaatttataccgcgccccggctaccgaggtggggaccaactgcgccagcagcacaaccggaagaacaaactaaccgacaagtgccacgcgcccgcaaacgaccgccagcagcaccaaaatacgagaacacaacatatcactgcataacgccaccacccaacagactacagcaaaagaggcggcaaagcaacaccccagggcacaaacaaatagccggcacgcaaacccccgcaccccctgggggccaaacgccccccacccacaccacgcggaagccgcagcaccaccacgcccgcgaggccccgcccgcgcggacaccccacagtacaccactcccaccaacactaccagcgacccaccacacgccggagcacaacaccgagtcccgaccacgacgacaaaacccaccacggcagggccaccaccccactgcgcgcagccacccggcaccgcgccagacaccacgcacggagcacccaagacagtcagacccgaacaacacggtagcccagcaacgccagcacgaccctgcgccgcagcagtcgcccacgaaacgacccgcgcgacgcgaggcaccacctaacaaccacacgacgcgagcgcacgcccaggcaccgcgacaccgaccagacgcgaccgagcacgacagaccgacaaaacaaacacaccacccaccacaacaacgcaacggcgcaccgacagcaaacccccggccaaccaacccaatccacagagacgcacccagagcaccagcgcactacccccaggaccgcgcgacccccggcagcccgccg

SEQ ID NO: 710660 - DNA, 201 bp, Homo sapiens
ttatcaagtggctgaggcggacgaatctcttgaaccgggaggtggaggttgcatgtgagccgagatcgcaccactgcactccagcctgggtgacagactgagattccgtctcctaaacaaataaaaatgaagaagaagaaaaatgaaaaataaaataaagcaaccctgaaccctgaagattgttgctggccctaaagattg

SEQ ID NO: 710661 - DNA, 123 bp, Homo sapiens
  misc_feature (76)..(76): n is a, c, g, or t
  misc_feature (101)..(101): n is a, c, g, or t
gtagagacaaggtctcactatgttgcccaggctggtgtcaaactcctggcctcaggcaatcctccagtctcggtcnttcaaagggttgtgaccacaagggngagtcaccacacctggccttat

SEQ ID NO: 710662 - DNA, 102 bp, Homo sapiens
tgtgaaatggcagtgaatcgagctcggtaccagcctgattgtcacaaccctgccatcgcgcttgccgacactgaagtcctggttcgatctggcggtctttga

SEQ ID NO: 710663 - DNA, 525 bp, Homo sapiens
  misc_feature (29)..(29): n is a, c, g, or t
  misc_feature (59)..(59): n is a, c, g, or t
  misc_feature (130)..(130): n is a, c, g, or t
  misc_feature (243)..(243): n is a, c, g, or t
  misc_feature (485)..(485): n is a, c, g, or t
agtacctttcccctgtgggccaaccaggnaggtccccactggtggttcctcgagtgacnagaggaaccatttatagaatttaaaaatttgtattgtaaagcaagatcccttcctggctgcaagcatgganctgtatttagagggggaccagaaatggagggagggagatattccacagttataaacaccccactatgtcccccaggcatgtttcctagagactagaaatagagcaaaagaggncccaggcacagtggcttatgtttgtaatcccagcactttgggaggccaaggcaggtggatcacgaggtcaggagattaagacaatcctggctaacacagtgaaatgccatctctactaaacttacaaaaaattaccctggcatggtgatgcgcctgtagtcccagctacttgggaggcagaggcaggaggatcgcttggacccgggaggcggaggttgcagtgagccaagattgcgccactnactgcactccagcctgggcaacagagccagactccatctc

SEQ ID NO: 710664 - DNA, 137 bp, Homo sapiens
cattcaaatatcacacaatacactacaatctgataggagtggtaaatccagccaatggaatccagcgtaagtacaaaaacgccaccttttattgccctgttcttatttctcgggaaggagggttctactttacacat

SEQ ID NO: 710665 - DNA, 178 bp, Homo sapiens
cgagaatgtactccagaataggacctctttatctcacaagatgaaatacagtcatttatgagctaatatcaagtctttggagaagtcatatcattgaggaactcaatgttcgaaaagttacactgtctacagatcaaaacaaggaggcacacagtgccaaggtatggctcacagtgct

SEQ ID NO: 710666 - DNA, 789 bp, Homo sapiens
ctggatgttttcactccagaatgcttattaacggagtgtgagcttgaaaactactatgtgatctattgctctccacactgtaccgccagtgagaataaggccgagcttggcttttgggactcagtatgaaggtcatattatgagggggaacagagtgaagaaaaccaagccctcattatattttgtaccgaaacctattgaagtgtgtatgtacaaagaaccatagttacatgaaatgggagaaaaacaagggtgttcaaggaaaagctctggaacaccaaccatgattggaggctaagttgagaatcaagattcaacatagctgagaactctccaccttattacctctgtcattccttgcgcttaccttacttcccatttacccattttcttccagtaaatgcacccaaggagaggaaaataaaatgactacgcaagacctagtggataagattctgcactgaaaatcttgctttgtgtaggacaagaaaattgaaccaaagcttgcttgttgtaatgtggtagaaaattcacgcgcacaaagattatcacacttcaaagcaaaggaaaaacctaacctcacctcctcaatgttaacactcactgttttgttgataggagaaggctacattggctgaagacatcttttaagacaaaaggaacttattactttagacggaagagaaacccatcttctagcgtgctctcttgcgcctacttgccgcgaccatccgctcactgcgcttatattgggtatattgttattctggatccctactgtcgcgcact

SEQ ID NO: 710667 - DNA, 658 bp, Homo sapiens
gtcggtccgcaggatgttggctatgaaactagtaactactctcttttaggtagcacagccagccaggcacagtagttcacacctgtaatcccagcacttgggaggccaaggtcgggggatcacctgaggtcaggagtttgagacaccagcctgaccattatggtgaaatcccatctctactaaaaatacaaaaattaggcctggtgcagtggctcacacctgtaattccagcaccttgggaggctgaggtgggtggatcacaaggtcaagggatagagaccatcctggccaacacggtgaaaccctgtctctactaaaaattcaagaattagctgggcatggtggcatgtgcctgtagtcccagctactcaggagggctgaggcaggagagtcgcttgaacccaggaggcagaggttgcagtggtctgagatcaagccatggcactccggcctaggcaacaagagcaaaactccatctcaaaataaataaacaaattttcaattatcaattaaacagtaaccaaagaataaaagtaactattggtttctggatttataaataagattggtacttgaaggtttaagacaaatgactacttgcaattctaatagagcagattctgattcagtataaatacttttagtctgtcctcaccag

SEQ ID NO: 710668 - DNA, 300 bp, Homo sapiens
tacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttaaatctttttttttttttttttttttttgagacggaggttgcagtgagccaggattgtgcgactgcactccagcctgggtgacagggtgaaacgccatctca

SEQ ID NO: 710669 - DNA, 699 bp, Homo sapiens
ggtggtaatcccccatttaaaagatcatgattgagcaaatgatttaaattctggtgtctcattaactgatgagtgagtttcttcttcatatgacactagtaatacagcagagttccactcaggctcagtacttatttccctgcacacaatgtttactaatgtgctgatttcttaaagttagagtctattggtgttcaggaatatacgtacaagcatgccagttggtaatacatcagagtgtgtaagggtgtactagtgcaatcttatcgtggcatctctcatttaccctcctaaatacctcagtataaacacttccctaggtgtgtgcgtacaatgtatatactccaaatggaggagcacagcacagcagccttatggagagagccttataagtgattacatggggcatgagctcatacttcagtcacttgtgctgccttgtcctgtttgagaatctcattatattacaacacacccgtaaacgaaaggggggccagtgtgctactgacctgccgaatatccagggcggacaacacgacccacacaacgcttcccgctaaaggaccccttgcactcgaactcagaaacggcaccacacgggccgacacgctaaagctcaaacagagcacacgggacggcagcaacagcccaaagagagggaccacgggacaccccggaataggcaacggcacaggcggc

SEQ ID NO: 710670 - DNA, 1611 bp, Homo sapiens
gcagcaatcattcactgtgcatttatccataatcaatgcacagcacaccatgcaatcatacttcttcattcatcatcatcagttccagcacatggacctgcaatcagcacagcaacccaggacacccatcatccagcaaatgttatactcattgttatgtcaattcattatgggtccatttgcacaacattcaacatccactcattcacattcacatctcaacacacatccaacatctggcatcaacacacccacatgtatttcttattcctgtgctccagcgccatcaatcacaccagcagcaaccacagcacaattctattatacagcaattctagcagccatctatcgcacagcatatccacacagctatgccgcaacaggcagccacgacacacacacatcatctcagagatcaaacacattcattagggccccaacatccgacatcactatgcacacaaagcacacttgatcgttgagcacgacacatagggacaaccacaccgcaaaaacactcataggaggacccacacacacatagatggacacacactggtatcacaccagacggacaacacccacaaagacaccacacgtaggagactacacacagatgatagacactacaacatacgcgaaacaacaagaggacaggcccacaaccacttcacacctacatataagatagagctacaccccagaggacaactccaaaaaaaaaccagcagggacacagccccgaacgccaaaggcactagatcagccctcccgtggcaaaccacacacgaccaaccatcacgattacaaaaatcacacagaaaagcacgtacacaaagaggacaggcacacaacggaaggagcacaatccaacaatgcacacaggaaacatcccaaacagggatctcagacgacaaaacataagacacacatgtcaacaacagtgtaccacaaacagggaattaaggataacacagtatattagggaacgcctattgacaccatgagaattccaatatgtcagatagatacatgtgattcacacttatacctcatatcataacccattaacaaggagcctagttaagcatatgagaaagcattaatatacacacgtcaaacttccgacagacacacgttaatggaggcaagcaaggcaaattagtatattatcactgtttggtgagacctatcactttaatagacacgaacaagtgacaatataagtgcatgtgaataaggacaagaacattctcactgtagaagcaacaaatatgaatattattaaatggcagactgagactgagatcgaggtgatatcacagaactagatacaagtcacccaaaggggaaaaatgaagctgaacaaatgacttcgccagacagaagagatagagacaaggagagagagaacaagcagtgcagcatagaaatcaatatataatagatcgtgccaagagaacggagagtaagcaatgccatcaaggcggaactaccatcaaggacactagaagccacatgcagctaagaaaataagaaaaacaatgagcattccaaaggagcggcgtaagtcaggaatctcattccggaggagttcggaactagtaagat

SEQ ID NO: 710671 - DNA, 444 bp, Homo sapiens
gctctcacatataaatactgttgggcacaaatatactttgtcttcagaaaaaagcattcttagttaccatgaattatatttattcatatctggtagttggaagtatttctctattagatctgtttagaaaaatgtgtaatttttttattagaaaagttttagtgttcagaagtctttgggggataagtaattgcagtaacacaatctccgtcttactctccccccatatagatcaaatcataggaaattttattaatttcagccagcttacttccccccttaatttccttttatgaatcatggcattaaaatagacaaatccctttttgctctcctgtgttttagtacaacaacagagaaccatctttagtcctctaaaaggcaatgtgagataggattttataaagtacattgaattaaaatatttttcagaataaaaaatag

SEQ ID NO: 710672 - DNA, 368 bp, Homo sapiens
  misc_feature (339)..(339): n is a, c, g, or t
caaacaatggtttgaaacaactactggaatattgtccacaataagctgggagtttgttgtagtatgcctcaaatataactgactgtatactatagtggtaacttttcaaacagcccttagcacttttatactaattaacccatttgtgcattgagttttcttttaaaaatgcttgttttgaaagacacagattccccgtatgcttaacgtggaaagaaaatgtgttctgttttgttaagggaccttccagtattgttgtaaatacctggaccgagggtgctggacttttaaaaaaattaaattaataatttaatggccctaatttattaatccgaagantaaccatttttttgttttattatttcaaa

SEQ ID NO: 710673 - DNA, 307 bp, Homo sapiens
tatttggatgaatgtgataagatgcttgaacagctcgacatgcgtcgagatgtcacggagggggttcgcatgaccccccacgagaagcaggctcatgatgttcagtgctatcttgagcaaagaggtccgtccagtctgccgcaagctcatgcaagatccaatggagactctcgcggatgatgagacgaagctgacgctgccatgggctgcggggcagtactacgctgaaactgattttacaccgacgaagaaccgcaagcctccttgacctctctgccatgctccttgagctccaacccagggggct

SEQ ID NO: 710674 - DNA, 113 bp, Homo sapiens
atgctgagcaatcacggataaggtggcagactgggaatccagatttgacgatgcttctagatcagagagggacgtcttgggaaggagtgtaggcatctgtcgttgtgattacg

SEQ ID NO: 710675 - DNA, 149 bp, Homo sapiens
  misc_feature (132)..(132): n is a, c, g, or t
ccaaaatcacaccactgcactcttgcctgggtgacagagtgagaccctgtcccaaaaacaaataaatgaataatttatcagtgtttcatgctgtcaataaatctggcttaaacatctcctgtcctaattaanagcagctgctactactt

SEQ ID NO: 710676 - DNA, 307 bp, Homo sapiens
ggcccccccccccccccacgggggctgagggtttctcccccccgggggcccgggagagggggcaggggggcccccccgggggggggccccctggggggtttgggccccccaagggccggggcctctctcccccccggcccccgggtggggggggccggggccccctttgggggggcccccggggggacggggcgttttaggattggggggggggggccccccccccccccccccccccaggggccttggtttggttttttaccccggattgggggggtttttttttttttttttttttttaggagga

SEQ ID NO: 710677 - DNA, 850 bp, Homo sapiens
agcggatagctctggagatgaggcagaaagtccttctcaaatgaagaggtccaagggaatccatgtattcaagaagcccagcttttctaacaaagccggcacacggattttaagaactaaaacgacgaaacccaagagaagaaaacgacatacacagaccagaacaccaggcacaaacgaagaaacacaataacacgacggacgaccacgtcaaaacgaccttgaccagcagactgactggtaggttaaaccagatggacacggacacagacagaaaaaagaaaaacgccaagttcaggacgcctagaagagtggctccaagcaatatgagtgataccaaaaatcatcaaaacccccactatcttaaggaaatatccgtttgagacatgaactgcacgctaggaagaagagattccaatgcactggatatagaatagagacaatgtcggcactgcacaaggccaggtattatccagatgtaaatggctactagaaattaccgatacggaagaacaagtcaatggaccaatagaaaagcagtagaaggggcacttcttaccaacgccggctcagtaccaccgggcacactatgacacaaaatccacaacaagcgctaggcgaccttgcaagtccttaacaaacacgggaccacgagccattaccgaaggaacccggcgagcaaggagcgacgccaagtaaccaaagaaacagactcgaagcaacaagcaaactaaaattagacgacaccataacaacaacaacaggcgaaacgaagcacacgcagccacgccctgaccaccgccaacggaaacacaaagagcagcacgcaaccctagcccccacgaaacga

SEQ ID NO: 710678 - DNA, 133 bp, Homo sapiens
aagaggatctgggtgattagcaggatctttgtgctcctttcagccctgtcagtaccccacaatctgagccacaggctggtcacaggcgaaaaaccccgtgcaggcacaaaagaggaagcggcacagttatttg

SEQ ID NO: 710679 - DNA, 467 bp, Homo sapiens
  misc_feature (23)..(23): n is a, c, g, or t
ctgcctggcacatagtaagtgcncattatatatattaatttattaatttgtttgaaaagtattttaaaaggatgttcttcccaagttgaaatgtatagtataatgatatcatttgatttcagaaatgaatcataaaacagtgcttcttcaactttaatgtccatctgaatcactggggatcttgttgaaatgtaggttctgattcagcaggtctggggtggagcctgggaatatgcattcttaacaagcttccaggtgatgctgaagctgctgatccagggatggtactttgagagccaagggaatataagaggtattcaaattgtcttttattataaatttcaaatacaacattgcaatctccatatatatttgttaaatatccactaggttccaggagctatgccagacaccaggggagtgtgtgatgagcaaaagcagtcatgctccctacccttgttgagctt

SEQ ID NO: 710680 - DNA, 687 bp, Homo sapiens
cactgcactccagcctgggtgacaagagcgaaactccatctcaaaaaaaaaaaaaaacacccaaatgtgaaacccctaaaaatttccctattagattttttcccagggaaattatttttaacttgggggcgtgatttaacacttagcggcctgtatccatgggatgacttaactgggaactccgatttatagtggtctttgggctatctttagaaatccacctttagagttctaattccaacccactctggcggcaaaatgtgcgcacattttgtggaccacaagagattttacggcattttgtgtacacacacaaaccagagatctaccctggtggcgtcaagaattttcctagagacagatttcccttgtccaccacattttttacaggagaccttcctacacaattgggacattaatctagcgccctttcggttcttcacagtagaggcattatttcgacaccccctattattgaatttaccagcattttaaaggtttcaaaaattccaggtaacctttgaacatctagggaaaatttggaaaactttatttaatgttggcaaagcgcaaaaaaagggtatttttctcttgaaaaatacctatttaaactggtttaacctagatctattagggtagtcccttaaggggttgtttggacccttgaagtggagtgcgggtttggga

SEQ ID NO: 710681 - DNA, 970 bp, Homo sapiens
gaccctgtgccgtttgagcctcctgacaagattgccgtacttgacgaagaggtcgcagatctgtggacgtgtgtctggaacaagggttgatgtattgccgcatgaggtttctagtgactgatagagtctcatgagatcttcatgatcatcctggctcttctgttcgcatggtcctgcaagtacactatatgctgacacacattgcaatcgtcgcaacccgttctattggctaggatcgtggaattctaactcgtgatcgttcctgcataccgcgccaggacagtgtagaggaccctttgtgtggtatgcgacctaaggagccctgggccgcaggaacctctttcaggaactgactagggcagtaagctctcgtgtcgtatctcatgcaccgaggaaagcctccctgtctcatcatcgttaccaagcgcagtaccactggaaatgctagtccaaaactcttgtccagatgagcacttggctggctccgagtggcttgccctgttgcctccgagcggcgctactatgctgtggctcactgtgatggtgtggctgcgatagtccctggccagtcattgatcgtcctatgtgctggtgtccgaccgctggcaaaggcgctcttggacgatcttggcatcctctgtgttgggcactgtttcggtgtccctctttttgtcttttgaatgctctctcgttaccaatccctccttttgcgcaaaagagaatataaagagcccaaaggagcaacggaacgctagtgagtcgattggtcctaccctcttgacgatgaagtgcaaactagatcatacccagtcaaaatctcggttggcggtacgtcctttccgcctgggggaatcgggccgatcctatatcccgagggacgactaatgcctacgccttcggggtataattcctctttgtagggcctttcctggaatatgcaccatttttttccagcgggaattctgcttct

SEQ ID NO: 710682 - DNA, 879 bp, Homo sapiens
atgtttctattgggtgtttcatgtccgtgtaagcgcccttttggtgtgaaagcatctcaactccgagctgtgtgatgttaaatcgcttgccggaccgctcccttcgggaggatttatgaaaagccctctgtgggggatatttctttgtgccgccccgcttacttatgctgggtgggcgcttcctttggcgcgcctcgctcgcactataccctctgttgcagcatctatctctttgatagactgcaccaggcagcgaggggagttctaattacggggatcctcctctccgctgttgtccgactcctagatactcgttgtgggtcccaccacctgtgggtgttcgtaatcactcctcggtcggtatccccccgcgcttttcggcgcgcgcgcgactatattgttgtacggactcctccgcagacattagtgtgtgcccccccacgcttttttcttttgtagacaccaccgcggcgactctctgcgtgtctctctctcttagcgctggtacccacctcggtggtggtgttactccctccggtttggtagcccgccccccttctgtagtagattgataatactctcgcaacaagaaattgttttgtgtcccacttagggcgtggtctcacccaccacatggggggttgtataaacaagagtggcgcacattttctcggagggtttgatgcacaccacgccaatgttgtcccacgcgacaacacccccggggggtgaattatcagtgtcgtagtattgttcaatattttggggacgaaccccccttttttcccccttttctggatttttcccccctaaattttttaaaaggggcccttttttcccctttgccccccctttcccccttttgggccccttgtttta

SEQ ID NO: 710683 - DNA, 295 bp, Homo sapiens
ggaacttcggtgagccagctcagcatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctatgactgtgattttccactacttacacaaatcctataatacggaccgagccctatctcttttcactga

SEQ ID NO: 710684 - DNA, 130 bp, Homo sapiens
accctggaaactgctttggatgctagcccctaccccccaattaggagggcactggcacccaacatggcatacccctgctaaatccccttagaatgtcccacttccttaaaccacattcctgaatgcatgt

SEQ ID NO: 710685 - DNA, 2064 bp, Homo sapiens
  misc_feature (1042)..(1042): n is a, c, g, or t
  misc_feature (1075)..(1075): n is a, c, g, or t
tctgtctctcttcttctgctctcgtctttgtttctcttctttcttttgcgttttattttttttgtgtgtgctccgatttgatcttttcatttagttcttgtctttcgtgcttcgttctgtttctttgtctgttcgttcgctctctccttacattctattttttgttctcttctgtgtgtcttcggtatcttcgtttgctctttctttctgtttcctcttgcttctatcatgctttgtcactgtctttctggcatgtcgttgcttttctcctctcttgtctctgtctcgtgtgtgtttgtcgttctttattgttttgtcattgtatataagggtgttgtgacgtgttgtaattaattagtatatagttgtttcttgtgatttatagtggttatgagtatattgattagatgctgtagttgcttagtctatgattttgttgtgtttatattatgaagtattgtgttgtgtgtcattatattgtgagtttgttgtttatagtttttgtttcgttatattctttatatcatatagtgtgtgtcagtagtatgttttgttgttagtacttagttagttgttttagtgcttagattatgtgtgttaatgttaagttatttattgataatttaggtttaggttagtgtttatttgttattattgagttctgttgtatgaatgtgtaattgctgtatttatagtgtgatttagttaatatgtatattgtatcttttgtcatgtctcaagatggagtttagatgattgaattgtgcatgtgtggtatgtggtatgatgtgagaatgaatgttagtatgtagagagttgtgaagttaattggagtgttgtgtagagtttagttttttttttatagtaactaatattaattataaattttgatatcatgattatatcaatgtgtgaactcttataatagatatgtattattttttgttttcgttgctttgttcttttttgttgtttatgtgtttgtgttgatgggagatggagcaaggagtgggacgaaaagtgagagaggggagagagcacnatgcaagtaggttactacgccgctttgtgttgntcactaaggaccagttttgtagtgtgttagaagtctttcctgtcgcgtagtgcgggggtgcctgatatgggggcgagtttcccgctgttgtgttgctcccgtatctcctgtgtgcgcccaccgaaggcccgtttctttcgtccagagagagccccctgtctgtgagatcccaggtaccgaggcacttgggccgaagaagctggcttggccccgcgagaggtttggaccacgcagggaccgtgggcaccaagttttggggccacgatgagatgtatcgtaccttatcggggttaccacaggaccaaagcgtactcaaggggtcaacccatcggggccaccaacacaggaagctgcccccggctagaccccccgagggcccttcgcaaggtggcccctgtattggggccatggccatcctgctttcgtgtacgcctttttcttgttggcacgaccctgggccagaaataggcgttcccatctcccgcccgtgaggatcttcaccagagagatttaataagagttggcccagggctatctccttattcaaaggaccgccatacttgagtccagaacacatgcgctctcccctgagctattgagcctattcttgaaccagagcaatctaaccccttttgggtggcgtttgtcccactatatggtgagaaatgagcccaaggagcgtttgtcatgctgtaaaggctgttgtggtgggaacccagaaaacgggtgctctaccctctcgcagagatcccttgctggtgccagacgaaacggcgggctctggagaagattgacccttaaattctcattgaccaccaccctcccaatttggccctggcccgcttcccagaccctggaggagaaaaaagacatttatgggacccctgtaagaaaagaacccaattgccaaagaagaaaagagcttatattcccgggaccagattttgcccttggtggggtttccaatataaaggttattttccccctga

SEQ ID NO: 710686 - DNA, 965 bp, Homo sapiens
  misc_feature (14)..(14): n is a, c, g, or t
  misc_feature (70)..(70): n is a, c, g, or t
  misc_feature (73)..(73): n is a, c, g, or t
  misc_feature (93)..(93): n is a, c, g, or t
  misc_feature (97)..(98): n is a, c, g, or t
  misc_feature (102)..(102): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (134)..(134): n is a, c, g, or t
  misc_feature (136)..(137): n is a, c, g, or t
  misc_feature (141)..(141): n is a, c, g, or t
  misc_feature (157)..(157): n is a, c, g, or t
  misc_feature (206)..(206): n is a, c, g, or t
  misc_feature (297)..(297): n is a, c, g, or t
  misc_feature (330)..(330): n is a, c, g, or t
  misc_feature (339)..(339): n is a, c, g, or t
  misc_feature (353)..(353): n is a, c, g, or t
  misc_feature (356)..(356): n is a, c, g, or t
  misc_feature (399)..(399): n is a, c, g, or t
  misc_feature (489)..(489): n is a, c, g, or t
  misc_feature (500)..(500): n is a, c, g, or t
  misc_feature (517)..(517): n is a, c, g, or t
  misc_feature (553)..(553): n is a, c, g, or t
  misc_feature (555)..(555): n is a, c, g, or t
  misc_feature (569)..(569): n is a, c, g, or t
  misc_feature (605)..(605): n is a, c, g, or t
  misc_feature (617)..(617): n is a, c, g, or t
  misc_feature (621)..(621): n is a, c, g, or t
  misc_feature (623)..(623): n is a, c, g, or t
  misc_feature (683)..(683): n is a, c, g, or t
  misc_feature (685)..(685): n is a, c, g, or t
  misc_feature (776)..(776): n is a, c, g, or t
  misc_feature (811)..(811): n is a, c, g, or t
  misc_feature (866)..(866): n is a, c, g, or t
  misc_feature (872)..(872): n is a, c, g, or t
  misc_feature (930)..(930): n is a, c, g, or t
aagtctttattttntctttcaaattccaggtattgacttatttaattaatccatcaacctctcatagctnatntttgagaaaacaaatttatnttcnntttnttnttttcngtnggggtgtaaggtgttggagntnngtgngctgtaaagttgtganagagatggagacatccagccccacctctctggaacaagaaagatgagtngggaggaaacacaggtcagcatgggaacaggggtcacagtggacacaagggtgggctgtctctccacctcctcacattatgctaacagggncgcagacactttcaggtgcctttgcagaaaganatgccagangctcttgaagtcanggngggggggcgtgaagaaatcctgcatctcagtccctcacaaganagctgtctcaggcttttcaagctgtgagagacacttccgggccctgggctctgtcgctgcgcgccgcctgtgtgttgctccctccttttncacctgatctnttcctcctacacatcanagcagcgaccacagctccgatgaccacaactgctangncggccaggccagcnacaatgcccacgatggggacggtggtctgggaaganggctctcatctnatgntnttgtgcttcggcagcccctcatgctgtacatggcatgtgtatctctgctcttctccagantntaccaccacagctgcccacttctggaaggttctatctcctgctggtctggtctccacaagctcagtgtcctgagtttggtcctcgccatcncgctgccaggtcagtgtgatctccgcagggtaganacccagggcccagcacctcagggtggcctcatggtcagatatggggtggtgggtncgtgtnttttttgggggtcagcgcgctccagcttgttcttcccgttctccaggtatctgcggancactccacgcactcgccctccaggtaggctctcag

SEQ ID NO: 710687 - DNA, 151 bp, Homo sapiens
  misc_feature (1)..(1): n is a, c, g, or t
  misc_feature (111)..(111): n is a, c, g, or t
ncagggtgcccgaaagcactcacgtggacggcacgttggcgtaccacacaccgcgggctatgcccgtaggggccgtctgagcggattctctacgctggggccgattaacgnagacgtactcgtgctctccagttatgctacttcgtatccc

SEQ ID NO: 710688 - DNA, 299 bp, Homo sapiens
  misc_feature (150)..(150): n is a, c, g, or t
  misc_feature (165)..(165): n is a, c, g, or t
  misc_feature (167)..(167): n is a, c, g, or t
  misc_feature (170)..(170): n is a, c, g, or t
  misc_feature (188)..(188): n is a, c, g, or t
  misc_feature (205)..(205): n is a, c, g, or t
  misc_feature (212)..(212): n is a, c, g, or t
  misc_feature (227)..(227): n is a, c, g, or t
  misc_feature (233)..(233): n is a, c, g, or t
  misc_feature (271)..(271): n is a, c, g, or t
  misc_feature (293)..(293): n is a, c, g, or t
aaccaggctttttatgtgtttagctggaggtgagtggaccgggggctgtgttttaaactgcttccttggcatttggcatccctgccttttgtttccgggggagcatggattttttgtcccccctgctttttaatggggaggggtgagggntccctgtccccccancnggnatgttggggtttgccccngccccccccttgctttnaaaaccnagggtcagagccccntccccntgtttttttttttctgttataataattattaacttccntgtaataaaaataaagtttggncttgga

SEQ ID NO: 710689 - DNA, 829 bp, Homo sapiens
gagctctgtaggaacagtacctgctgcgcgcgcgtctacagcttactgatttggaaatgagccattagctgtccactaagaagatcctggatgcctgatctatctagcagtgggagagattgatccatctacaacagatcgtcccgtccgggcacagcgagaacgttcgtgaacacacatattacgcataatttgcaagctccctgccaggtgcattttgggcaagtagtttcatggttatcggatggaaagcttcaaaagcgtatggcattcattggtcataccctatacacggcaccaggctttcctgctgttgcaggaatcccagaaagggggcctggctttgcctctccggctgacttaccatgaaattgtccccagttgccccatgcccttgcaatttggaagggcacccaattgtttgggccgaggaaccattccagggaagcttgggatttacctggaccaagcaattggtttgttccgccgtggcaacctcccccaaggggggcgcttgttctttctgacttacttgcattttccccgtcgccaaaggaaaagcccccttaccggggaaccacccgtgggccttaattccaaaaaaactggctttcgggggattacttgggggcaccttgacacgcaccttgcactttgcacacaacttggcttctcggaacacatttaccaccacggcgcttttttcccaacaccaacggcaacgcccaacgcaacttctttttaaccgcggacttggctttaatcaacccaggcggcttaaccccttgtggccccctttcccaaggcccccaaccaaacacacgggctg

SEQ ID NO: 710690 - DNA, 530 bp, Homo sapiens
ggcacgatcccagtttacgtgcagcttcagacctcctgagctcaagggatcccacatcgcctcagtccgccaagtagctgggacgtacaggcattacgccgcacatgcctggctagtttgtggtattttcgtagagacggggttttggcatgtttcccaggttactcttgaactcctggactcaaacaatctgcgcaccttggcctctcaaggtgctggggattgcaggcatgagccagcaggcctggcctgagtgagttttatctatactgtattcatgtaacccagcaagcagagagatccatttacgacgttgtttgaaacagtaaagtgactcagtgacatccaccacagaatttgcacatatctgatacatttgtgagttactcctagtattaagtactacggaaaaggaccgaggcatctaccttcacttctttaagcttttattgaatgctatctccaagcatgctctgggagagctactggataacacatttatggaacgtcatagtaggagacgccatggc

SEQ ID NO: 710691 - DNA, 195 bp, Homo sapiens
tagacggctgcagtgagctacgtaaaatacaaaaaattagctgtgcattgtggcacatgactgtatccccagctacttgtgcggctgaggcacaagatatcgcttgaacccaggaggcacaggctgcagctgagctcgagtttgtgccactggatttccagccgtgcgtgacagtagtgagaatctgtctcgaaa

SEQ ID NO: 710692 - DNA, 230 bp, Homo sapiens
  misc_feature (60)..(60): n is a, c, g, or t
  misc_feature (63)..(65): n is a, c, g, or t
  misc_feature (109)..(109): n is a, c, g, or t
  misc_feature (133)..(134): n is a, c, g, or t
  misc_feature (148)..(148): n is a, c, g, or t
  misc_feature (150)..(150): n is a, c, g, or t
  misc_feature (164)..(164): n is a, c, g, or t
  misc_feature (184)..(184): n is a, c, g, or t
  misc_feature (207)..(207): n is a, c, g, or t
  misc_feature (216)..(216): n is a, c, g, or t
tttacaccaaaaactgaactgtgtgtaaccatagtaacaccaagcacgtatttatttatnagnnnttgccattataatttcgcgccataaattcatttgacccatactnctcttattaatagagaagtaaaannatgtacgttcagcntncgctagagttatgntcaatgaatattgtaaatgnttaagtattgttaatgaatagantaaatacantattgcattcccat

SEQ ID NO: 710693 - DNA, 532 bp, Homo sapiens
  misc_feature (463)..(463): n is a, c, g, or t
acgtctgtaccgtctatcttaaatatcaagttgtctgaaaaaacaaaccatgtatacgtaagtaggctaatatattacatgaatcttaacgtccatatcactataagcaggttataaagaaaacccaccttgatttattgctagagatttaccagctaaaagcaatcactcgcatgatttagaacaataaatgtttagtctcaacaatatccacgtgaagcagttcagtaagtggtggttttataaaacccagccagctccatttctagctctgtttaaaggggagtggttgtatgaagagttcctcagtcaaaggtgtgcagctgggaagcccaccccacctaagagggaggtctgacaaagtgtccacactgaaccactcagacctgcatcagggccccgtttcttccataagccgccaagtacaggcctgagtcaactgaactcaggcctgggaggcttnccaaagctgacttgactcagctttgaactgaaatgaccgtaccatgacaaccctgatgaaaagctaaac

SEQ ID NO: 710694 - DNA, 787 bp, Homo sapiens
  misc_feature (321)..(321): n is a, c, g, or t
  misc_feature (787)..(787): n is a, c, g, or t
tctatttttggggtggggggggggggtgtgggggccagggaaaggaagggacccgggggccgccctcgcccccgcaccctctctaccagttcccccccagccccgggtcccgggagaagattgtcgccgggcgggggggcgcccaggtgttcgccgacgcctgaaggaagaagacccgcgctggggccagaccccaagagcgggctgctgggacagttgtgtcaggctcattgagcaggctaactttttgggggttttcttccccaacaaatattgagtataacgcctatccaccaaaatctccaggaaatatgcgaacanaatattctctgtgttcaccctggagaaatgtcctggtctggagtgagaaaatgttttgcgccacacaaaaaaaaaaagacaaggcgatttgtttttgttgtgtcccaaataggagcgaagttccccccacagaggttaaaaaaacgggcgaggtgtgcccttgtgtgaatctcctgtagaccctcaatctcaaaaccaaaacacgcgttgaaaaatttccccgcgactcccccgtttgacggagtattccccacaagatagtgatgcattgtttgggaacccccataagattaaaccacgcccaacagtgtgtgtgtgaaaggactcctataacacaccgagtaggaccataatataaagaaagagtggactctccgttcccaaagagaaaagcaaagaagaaagcttacataaagtgggcagcgtgatcttaagggtggggaggaaacacccgtaatgaaaaatn

SEQ ID NO: 710695 - DNA, 786 bp, Homo sapiens
  misc_feature (11)..(11): n is a, c, g, or t
  misc_feature (77)..(77): n is a, c, g, or t
  misc_feature (168)..(168): n is a, c, g, or t
  misc_feature (200)..(200): n is a, c, g, or t
  misc_feature (202)..(202): n is a, c, g, or t
  misc_feature (204)..(204): n is a, c, g, or t
  misc_feature (208)..(208): n is a, c, g, or t
  misc_feature (243)..(245): n is a, c, g, or t
  misc_feature (248)..(249): n is a, c, g, or t
  misc_feature (252)..(253): n is a, c, g, or t
  misc_feature (255)..(255): n is a, c, g, or t
  misc_feature (268)..(268): n is a, c, g, or t
  misc_feature (272)..(272): n is a, c, g, or t
  misc_feature (284)..(285): n is a, c, g, or t
  misc_feature (288)..(289): n is a, c, g, or t
  misc_feature (291)..(292): n is a, c, g, or t
  misc_feature (302)..(303): n is a, c, g, or t
  misc_feature (306)..(306): n is a, c, g, or t
  misc_feature (311)..(313): n is a, c, g, or t
  misc_feature (347)..(347): n is a, c, g, or t
  misc_feature (352)..(352): n is a, c, g, or t
  misc_feature (368)..(369): n is a, c, g, or t
  misc_feature (407)..(407): n is a, c, g, or t
  misc_feature (419)..(419): n is a, c, g, or t
  misc_feature (421)..(424): n is a, c, g, or t
  misc_feature (428)..(428): n is a, c, g, or t
  misc_feature (430)..(430): n is a, c, g, or t
  misc_feature (433)..(433): n is a, c, g, or t
  misc_feature (437)..(437): n is a, c, g, or t
  misc_feature (439)..(439): n is a, c, g, or t
  misc_feature (453)..(453): n is a, c, g, or t
  misc_feature (459)..(459): n is a, c, g, or t
  misc_feature (481)..(481): n is a, c, g, or t
  misc_feature (497)..(497): n is a, c, g, or t
  misc_feature (517)..(517): n is a, c, g, or t
  misc_feature (522)..(522): n is a, c, g, or t
  misc_feature (524)..(524): n is a, c, g, or t
  misc_feature (532)..(532): n is a, c, g, or t
  misc_feature (534)..(534): n is a, c, g, or t
  misc_feature (545)..(545): n is a, c, g, or t
  misc_feature (551)..(551): n is a, c, g, or t
  misc_feature (555)..(555): n is a, c, g, or t
  misc_feature (557)..(557): n is a, c, g, or t
  misc_feature (562)..(562): n is a, c, g, or t
  misc_feature (567)..(567): n is a, c, g, or t
  misc_feature (589)..(589): n is a, c, g, or t
  misc_feature (631)..(633): n is a, c, g, or t
  misc_feature (635)..(635): n is a, c, g, or t
  misc_feature (640)..(641): n is a, c, g, or t
  misc_feature (645)..(645): n is a, c, g, or t
  misc_feature (647)..(649): n is a, c, g, or t
  misc_feature (655)..(655): n is a, c, g, or t
  misc_feature (658)..(658): n is a, c, g, or t
  misc_feature (662)..(663): n is a, c, g, or t
  misc_feature (670)..(671): n is a, c, g, or t
  misc_feature (683)..(685): n is a, c, g, or t
  misc_feature (687)..(687): n is a, c, g, or t
  misc_feature (704)..(704): n is a, c, g, or t
  misc_feature (710)..(711): n is a, c, g, or t
  misc_feature (722)..(722): n is a, c, g, or t
  misc_feature (784)..(784): n is a, c, g, or t
acctatttgtngtttagaaccaaacaaaactacaagaaaacattttcaaaacctttttttcaggctgaagaaatcgnttaatccattttaaagaaatctcacatgatgttctgtcgggattaaaaatatacacggaaaaaataaaacaaaatatatacacagaaagangctcgcacagagtcaggcgtgcagcaccgtcncncnctcnttcctttctgtttcctctggacactcaaaatgtgnnngcnngtnngnggggggtggtttnccgnccttttggtccnnggnntnngatttctttnnaanatttnnnacgtcaaaacctgccagaataagacaatagaagngcgtntcgtcgggcgctgggnntggcaccacgacaaggcattaatgtggattcacttgcncagctgctctcntnnnngctncncgnttcngnggtaaccctaactntccgcnatcccaaccaaagtcatgttcntgccgctgttcttgtntggtcattctctgttactcntccancncagttatntncagaatgcgcngtcccngccncngtgtngattncggcaggcgttctctacctggnctcatgattggatttcatttctaaattacatcagagctttcnnngnttganntacncnnntctgcnctncccnngcctccnngcctgtacgggnnncnaatcagaagagcatttnttgggnnctgacacgtcnggcctccccggtgctgggccgggctccccgcggcttgctctgcctcctgtcttccgtttccntg

SEQ ID NO: 710696 - DNA, 566 bp, Homo sapiens
tgggggggggggggggcccccaaaaatctattttcaacacccccggggcacgcgggggggcgaaataaacccccgcggggggggggggggagagagaggtcccactggtgaggggcgcgcggaacaccaaccactccgaggaggagagagagaccacgcggcgtccggggagagagaagaaagagggcacgcggcggtgggggggggctactccccctaaagaggcatcacatcacgagagggagaagaaaccgagcgacgacacaccacgacccgcgatgagggggacaaagaagagacagacaaagaagagaggaggccagcgagagagggtataccaacacactctcttccactcactactagagagaacaaacagagcgcagactactatacgagcacgcggagcgagagagagagaagagggagacacacactctcactctccgcgcggcggaggagaagagagagagcggccgaccgatgaagtggagaaccactctcatcctcgcgcgagagcggagcaagtctcgatcattaaaacaccgcacggggtcaaaccgcac

SEQ ID NO: 710697 - DNA, 419 bp, Homo sapiens
  misc_feature (325)..(325): n is a, c, g, or t
gacagcctcccaagcccaggctttggcactcagaatgggcccagtgggggtgggcaggcccatttagggccccccccgaggtttttcctagggctgtttctggggctgggttttacaggcttgtcccccaggcctgcccttttccactgccccctcctgtgtttgggtccccccccccttcaggaagggggagcccttaaaagcccagcccagggggtcagcctgggatccggtgatggtttgggcaaaggctgggtcaggagtcccaaaggtcagtgacagtttttcaaaaaaggcccagggtccccctttttcccagggccanacacccctttctgggtcccccatccccctatggggtcccagccccttgccccctcattgctgttcagattaaagcctttgttttgcccctgtca

SEQ ID NO: 710698 - DNA, 280 bp, Homo sapiens
ttcaagacacacaatatgcacagagcacagacatagacagacacacaatacacacacacaatatatatgcacgagtgtcacatacacacattcgaggagagaagtgaattatgtaacacatcgagctgtacatatacacagagcccacattgaaaatggagctcaatcattataatgtatatgaatgtcttggtggtgacgctgtctatggatatttcacacatgtgcactgatgaaatattgcccatctcttgaatgcacatgaaccattggccttgtt

SEQ ID NO: 710699 - DNA, 954 bp, Homo sapiens
tcggggtttcctgacttcaacagtgcttgggtacggaacccggcgctcgttccccaccccggcggtcgaccatagccatgcacctctgttcacctcttcatcgcgtcactcctacggtactgcacccagaaggtctcccgtacgccgttccaagcgtccgcgcgaaccaccgacgccgcctgttcgaccctaatccttagatcgtcgcccgtgaagactcgagttaccaccgtgcgaatggatgcgcctagaattttaccacccagtgactcacgtagagctcagtcattctaatccgtgcatcatcaatcctggatcgtcgtacacgctcctacttatctacctgattcatgtaagttggaaaacctaacgaaggttggccggtaaatcttccttcatgactatctaataacaccaagaactgttgaatagagcttggtgagcagcgcgcttgagagtgcaaatggtacgatgttgcgaattgacgattttgggaaaataaactgtgcaatccatatccacgtactggcacactgcatagaacatggccactgactaaaaagtgatcctcccataatggtggtgaccttcaatagagaccacaatccatctgacatgagcctgtgtcctagccatctcatgaagtgggttgaccactgttgagcaacatttgcagcaagtatgggatgctcacctgcattgctcggccttgggggggaaataatctctttgactaagcaataccctggcgatacacgagataaatgcaccagctcagccttgaggtcataactttccccagtaagccgtgcggggtgacttctctggtaaccaatggtagaggatgcactgtggggtttcctttagactttctataagtcgtccaatcttccattacggttcttgattggaccattcctacaataagaatttggttcccaataagaaaaaaaa

SEQ ID NO: 710700 - DNA, 644 bp, Homo sapiens
  misc_feature (644)..(644): n is a, c, g, or t
aaaaattttttttgaaacccttttccccaaaaaaaaaacggcccccccaaaaaattttcaaaaaaggggagtttccccctttttaaaaaggaaaccagggaaagggggtcccctttggggggtcccttaaagggtggggggacccggtttttttaagggaaaacccccctgggcccagggttcttttaaaaggggtttttttctaattaaaagggtaagtctgcccaaaacaaaggggaaaaaaatgggttttaaaaaaaaaaaaaaacctggggggggggcaaaattttcgccccccttttttccccccggttttttgaaaaaccctaaaaaaaaaaaaatggggggggcaacccgattttttttaatattttgccgaccaattttaattgggttactccgtggggaagggggcccttcccaactttctcgttgtaaaaaaaaaattggagggggtggggtttatttcggggcccccggggggggaaatagggttttgtgaaagaaaaaaataaaaaaaaattcctttgtcctttatcccccaagtaaccccggttgtgaaacccgggagaccccccgggcacattttttcccccaatttttgcgccccaccccacaggggtttttccttttgggcaaaagan

SEQ ID NO: 710701 - DNA, 449 bp, Homo sapiens
acgctctctctgttgggggcaactgggagaagaataggagaagctccgtgaaaggggcctcagaggatgcacatgaaattggcgaagtgggaacagagaggcccaggagggattgcagtgtggggcagagtctcaggtctggagtgagaaagcttgagttccagtcccagctctgccactcactaggtgtgtgatcctgggcaggtcacttgacctctggtgagtcttagttgtctgtacgtgtccatgcaggagttgtcctgacaccacgtttaaaggtggttggggatggtcaggctagataatacttttgaaagtggttttaaaagtgtaaacaggaggaagtgtcgagttcttagttgctggggattaagaatcgcaaaggctacgctatgtgacttccagcacctccgggggacgcaggcagataacccccacagagagagcgt

SEQ ID NO: 710702 - DNA, 1216 bp, Homo sapiens
  misc_feature (757)..(757): n is a, c, g, or t
agcatcaagagagaggatttggattcttcagaaattgacagaagtaattcattgtgtccattaaccagattggtgcaaggacagcaacaagccaatctaattgattgagaaatgtacttatattctagtgttggcgtatataaccttactgtacggggtttaggtgattatggcggaggggtgctagtgtagttttggtctggcgttggtattgccactgaagggctacgatgctggcgtggcggagaatgacacaagaggctagctttgcttcgtggcttatgatgtagatggaacctcagtgagattgatgaggcttagcaatggtaattatctctctagagggtgacgtgaacgtttatcgcatatacagctctggagcacctcaggtcgctgaagcagttgtcaggaaccttctagtgccaagccacgggagcagcaggtggatcagcggagcaagcccaggccggccacacaggcaaggcaggtcggagaaaagaaccggctcaccgggactgcacattcacaccatcctcagaggtgtgagcagtgggggggcccaaacccaagtggcctgtctcatgggtagctgagtagttgccacgtttgcggcctcgccatattttgcttgaggggaaggcggcagtggggtcctaaagtgactagctggatggggagaaagccataagtatcatccccaggtcagcgtagggatgtaggcccatatggggggcgatctttggtgtgcttcacgcanattcttcttggtttcaaacccgggaggttgtgacaagacttccagtgggacaaggggtcgggggccgctcaagccaaagtggccttcaaggtggtgcccttggtttggacactttaagggttggtaatcccagcaagcagagtcgaaatgggcttgtagggccccaaagggaaaggaacattgcatctcacgacggccgagcatatagggggggcccccccgtgtgtaccaaagaagggggggtaataggaggtagcaaactacgatgggggagcgaggcggtcgacccgtatagagagacgtcagcaggagcacttgggagcggcgcccagaataaaaaagaggaagatcgaagcaacacaagaaggggagaacatgaaaacagaagagcgagcagagcgaagggcgaaagcatcggagggcacgatcaaggaagaagtaggaagaacgtgaagaagg

SEQ ID NO: 710703 - DNA, 337 bp, Homo sapiens
tctagcaggatccccatgctgttatgtttgcttcatctcctcttatctactgttctatcctggctcctggagtcttctggctctagcgtccactgctgacccctaccaggttgttatccttgccagtccacactagcatatgccggcctttagtgagaccggcagtgtgtgcggagtagcggcctgaggcctgttttcctttgttcttcttcagaatataccagcaaacttgcttttgtcctgtatggttatgtttctttgagcataggttctcacctctgtcacccagactggattgcagagtggcaacctctgtctcactgctacttctgcctcc

SEQ ID NO: 710704 - DNA, 161 bp, Homo sapiens
aatgcgtccggacttcctggtgtgtatggtgttcttgcaaatgaccacaactcagtaaagaacacatacacaacaaggaaaggccactggtatatcccaaatatcctaaatttctaaacagcgacaaaggaagaatgaccaccaacacaccaatggaaggt

SEQ ID NO: 710705 - DNA, 407 bp, Homo sapiens
cttgaatgagctgctgtatggatttattcgaatatcggcagaattccattcctcccaaggtggcaaaattagctctactgatgtaattatcattttcctcggtctgaattccctcacacacactcttgtcctacatcattgtatgacatgatagattgacggaccggcttcgtggtcctacacttgtactgatggagagaggccctagactgtgatagctaggtgggggctgcgcatcatgtgggctctggcagatcatggtgacggagtttgagtttcataaggattaaagcaatgcagggctactgtcacttttgcctttttggaatttcctggctgctcatgtcattcattgtgtaccgtgctcgatctccgtatctctgtcttagctctttcctgtgttgaaa

SEQ ID NO: 710706 - DNA, 284 bp, Homo sapiens
cgcccgtcaagtgcccgagacctagggagcgcagacggatccatgcctcgcaccgtgcccggctctagcatgaagatgggctccctgagtagctgatagaaattacgcgctattcacgacctgtgcgactttgagaagtgtgatgcgctactccggaaaccggctttcagatactctatcgcacgatgctcaacctagaagttcgcacacgtgttcgaccgcgtacactgcaggccagtccacgggcatggagggaggaagcggtggagtgtgtcctcggcgtg

SEQ ID NO: 710707 - DNA, 1710 bp, Homo sapiens
  misc_feature (1250)..(1250): n is a, c, g, or t
tggagcccagaaagcagattaatttttctttagaattaaaggtctcaatacagaaatagtgtgttacagtgctcgagggagtattcctcaggtttaacaccaaagagggtcgagaaagtttagtggcaggtgaggtgcccgagggtgataggagtggaggaaagggaaactttcatagaacagagcgggcgcgggggtctcacagcagacaagggcaaccgtcacacgaggtttccaagagttggtggcggcgcgtggccactggcgaacagagggagtgtcaccacagggggcacgagtgtcaaggcagctcagaggaaaatagaggagagaacacaggggcgcgcggatagagggggggcgaaaaaagggggtggcgccatgggagctatgggcagcatcggctatgggaaggggggatgggcactccacaataacccgggggaaagggccaagtgtcgcgcggagggcacaatcaaggcgcccaggagcacccgtggcgccacaggggggaaggacaagtgcaaaaagaacgaccccgagggagggcacaaaacagggggagatcgcgcactagggtgagggcaacaaagccactgtgacgcaagacacgagaggaggagacacctaaaaagcgccacccgagcgcacagatgaaagatgcgcacgtgagacaagagcacagtgagaggtgaggtgaacgacaaacaaataataacacaacaccaaagaagcagatgcgaaggacccccataacaacaagagtggggcgccgaaacaacgaagaggagacgatcaataccacgacagatactccccaggagggagagaacaccacatcagaggagagaaacacgaggaggagagaggagagaagtggagggaagaggccgaaggcagccaccagcagtaaacaccgacatacacacaacacacattgtaaatcaatcaaaccacaatccaatcacagccggaaggaagagggaacaaaacaacaacaccccatcgtcaggaggaacacccaccgatggtgagaagacagacgaagggaggcacgaagacgaccgacaccagtgcacccaaccaaagaagagggggcatggtggtcacaccacaacacgacgaggagaaaaggaggaaagatggggcacccccccagccaacaaccgccgataggatcgacgaacgaaagactgatatgggacggggcaaccccacaagggggggacacaccccacagtggaagaaanagcacgcggacgtagtagagagccacacaagggggggacgccccggacgacaagataggagaagaaaggataatataacacagaggcgaaggaacaaccagataggagatgcaacacggagtaagatatgtgaacacatcacacaacaaccacaacgccacaccacagcagtggagccgccacccagctcaaacaaagcagaatgctaacacatgcacaacacagacaagaagacgaacgagagaccaacatggttgagaacacacagaagagagacaacaaaacaactaagtgatgcacacacaagcaagagatggaaggatatgaatatacccacagacacacaaaaccaagtggggaggaagaaaaacgacggcgacagacaaaaacactgaaggagcacacaaagaaacaagaaaacgagaatagaattcaacaaccccacaacagatgaaagaaa

SEQ ID NO: 710708 - DNA, 143 bp, Homo sapiens
ccagctacggatgtggaggagaatatgtgtcctgctgcagtgacaagaatgacctgtcagctccaagtgcaggcggaacaagacaacctggcagatgctgagtgagcgctgtgcatcagctgtatcaaacaactagtattcag

SEQ ID NO: 710709 - DNA, 274 bp, Homo sapiens
cacgaggcctcgtgccggcgccgccgccggcagcgccggctgtgaccggcgccgtggccggcggcgcagcgctctgcgtctgacccgaagcgccggtttgcggctgtcccgcggtgccggtttgcggctgctgcgcctgcgcggaaggctcgggccgcgccttgccgcgcagcctgttcaggatttcgccaaagatgctcattgcagatcctccggttgcgatgtgctgccaagtaccgaaatgtggtcgtggtgtgcagcccgaagtgggtgg

SEQ ID NO: 710710 - DNA, 675 bp, Homo sapiens
cgtctttgtgtcatgcgtctcatcattagctcccattataagtgagaatttggtttctgtacctgcgttagtatgctaaagataatagcctccaggtctatccatgtacctgcaaaagacatgatctctttttttatggctgcatagtattccgtggtatatatgtaccacattttctttattcagtctgtcactgatgaacatttaggttgattccatgtctttgctgttgtgaatagtgctgcaatgaacactcacatgcatgtgtcttatggtagaatgatttatttccctctgggtatatacccagtaataggattgttgaagtgatggtagttctgcttttagctctttgaggaattgccatactgctttccgcaatggttgaactaatttatactcccaccagcagtgtataaatgttccttttctccgcaatcttgccagcatctgttatttttttggctttttgataatagccattctgactggtatgagatagtatctcattgtggttttgattgcatttctctcatgatcagtgatattgaactttttaaaatatgcttatgggttgctgtatgtcttctttgaaaagtgtgtgtaatgtccttgccccttttatgagtaatcggaggggaccacccatctactggctactcttttttaactccc

SEQ ID NO: 710711 - DNA, 234 bp, Homo sapiens
aagtctcatgcttacagtcgaaaggcacatatatccacacatgcacacacagcacacacacaaacgcacagcacacacaaacgcacagaacacacacacacacagcacacacacgagcacacagcacacaaacgcacagaacacgcacacacacgcacacacagcacacacactagcacacagcacacacacaaagacacagtacacatggaatgcacacacacgactggtagg

SEQ ID NO: 710712 - DNA, 277 bp, Homo sapiens
aggtacccagtgccacttcacttccagaatgcttctctgctgaactcacagcactactatatgctgcagaatttcctgcagacagcctccacagctgcgcacgcctttatacaatatggtgataataaagacatataactggatacatggaacactacccctatctccccatataacacgctacagtaatttatttccacagctgctagaaagagccaagtggggaaaccaaacatagacctgttgtccaaagtggacacaaacaggagctgcccac

SEQ ID NO: 710713 - DNA, 184 bp, Homo sapiens
cgcgtggcgtactacgacactgaacgcgcgtatcacaggacctggatacacagactgtcagtacctgttgtatagcgacaaaggcgtgctgcgtcgcctgcatgcccaccatttgctcagtgaggggcatgccaatgtgcgcgtttatcgacccgccctaagacgcgggccgcgggtgacactt

SEQ ID NO: 710714 - DNA, 986 bp, Homo sapiens
ggtccggaggatctggaaccgagcaatacctctctgggagctgcctggatcaggaggaggttcagctggctgatacaatggtttggcccttaccaagggttacagcatgagcgacactcaagcgtttcagtgtgcgatatctgcgacctgctcgcagatcttgtcttcccttgggttctcccctgggggctcaggagttacgagtgccgtgaaagcgtccgtagaggcgtaatatgccagggggatggagtgagcgtacgagggaaagccactaattccccgacccagcgcctaccacaatctgtttggattaccactggattagtcgtcggagatgctgaggtggtactgacgattcgtgagcttgacagcctggccttgaaccagtccacggggctgcctacccttactctaccccgaggacacgacctgcttaccccctggcttactcccttacctggaccagttccggcggcttgtcttctggttgggggatgagcttcggtcctgggaagccgccaagttgtttgcacgatagctggaacccaaacgatgcttcttggtgcgaccaggagagcaagcagcccgtccctggaggcctgaacggaggcttcaatcttctcgtattcttcgtaccgtccttgcttgctggcacacgtccatcgtatctttccggcagcttcggaaggaggtgctaagaaaactgtcaatgtggggcaagcagtggcatcccgcggaggccgcatttcagaacgctaatcggaatcttgaaggggaccttaaaggggcaaaccggaagagcatcacagagggccaacaggagaggtgacagacgacattcaccaagagagatattcccaggaattgtgtccccgggagtgacccccacggcgtggcaaacgggagagcacgcagagataaccgggttacgcacgcttatgaacgggagtagaaacacaggggaaaagatcaagagacacgaagac

SEQ ID NO: 710715 - DNA, 1303 bp, Homo sapiens
ctcccgccttttttcccggcggcgggagaagaaaaaaaaaaaaacaaaacaaaaaaaaaaaactttgttgggcggccttgggacccctgcggaaaaggctttcttataaaccattctcgctgtgggcgccgggggtccacagtacaggtataccgtggaacccgtgtcggccaaaagcgcggttaccccagagaggagaacaccgggcaccacgcgaacaacagggcccgggcgaactctctccaccacaatataaacaaagccccgcgggggcacaaccgaagcgcgttgcgggaacaaaaatctccaagaagggcggagagtcccagagaggggcacaactaacgcggggggctcctcttcaacacccgaggggaggcccaaaggcgagaagccccagaatactagaactatacagcccccgggggcggggggaccaacgcaccaacagcacccaccagaggagaggagaagacagagcgcagagagacggcagaaggagagagggaaagggcacgaggaacggcaggagggagagaaggaggagggaaggacggaggagaagggcgcgagcgaagaggaaacggagacaaagagggaggagcgaaggcaagagggagaaggagggacaggcgagaaaagacagcaagcagagtagcacgcggcgagaacgagaaagagaagaggcgaaaacgagaggagcaggagtgcaaggagacggacgccacacgaggagggaccaggtaggcaggaggagaggaaaagtgactaaggaagtaggggggagagcgagagagagagcaagcaggggaagacaccggggagcgaggagggcgcgaggaccgacggagggcggaaccgcgacgaggcgccggcggccgcacgggaccggcggcggcggagcaccgcgagaggggggggagggcacaggcgagcggacgggcggcgccgggcggcgcgaggggcggagggaagagccagcggcggggacgggcgggggtgagggcgcgggcggcggaggggcgcgggagacaggagagacgacagagcaagcacaggccccagagggccggccggccgagcgagggggaggcagagccgcgccagcgaatcagccggcgcaggcagcagacgacgggtgggaggaggagactgcggcggacgacggacgcgcagcgaccaaccgacggggagcgtggacgaccgcgccgcatacgaaaggcaaagagccaccggaccgacgaagacacacggccgacgcgacgatcgagcgcgcagcggggcaaggcgggagcagaggaaa

SEQ ID NO: 710716 - DNA, 310 bp, Homo sapiens
tggctcaggcctataattccagcactttgagatgccaaagtgagaggttcacttgaccccaggagttcaagaccagcctgagcaacatagcgacaccttgaacatcagtgatcattaaagaaatgcaaatcaaaaccacaatgagataccatctcatgccagtcagaataaaagtcaagaaacaacagatgctggtgaggctgcggagaaataagaacactagaaatagggagaggtggctgttttttcacatgccaatttttcaacaaaaggtacaaagaaggcaggcatgttagcacacacctataat

SEQ ID NO: 710717 - DNA, 166 bp, Homo sapiens
cccgactagcccgacagggcttctaggaggaagaacaggaaggggacatgagagtgtgtcaggaaggggagaaggggcatcagcgccctgggtgggcccagcccacctgcagtctcactgctctattagaggtgatgggctgtcgggctagtcgggctagtcgggg

SEQ ID NO: 710718 - DNA, 102 bp, Homo sapiens
atatatttatctggttttcatattcttttgcactaaagaattgtatcacttcttgcagtgcaacgttgcaggctatgacattcccatcaacttctgaggatt

SEQ ID NO: 710719 - DNA, 104 bp, Homo sapiens
agaaacgggggcagtagccaggcagtaaaatcatgtggggacacttgaggggtgcattcaggggaggaacagccccatgtctcagtctggtgcatcccacacac

SEQ ID NO: 710720 - DNA, 150 bp, Homo sapiens
caggtgatctacaggatcttatcccggatctgggtaattgctttgcagtattttttttttttgaaacgtatttggctcttgtgcccaggttggagtgcaatggcgtgtactctgctcactgcaaacctccatctccgtgggtaacaagcg

SEQ ID NO: 710721 - DNA, 370 bp, Homo sapiens
agggggtggcaggcctagctgctacaaagaagacttgtttagacaaatactcttgtgtatgggcaaaaaaactcgaggactgtattggtgactaatggtataacaggttattttagtttcggtgcgggggaaagtgtaaagcattccaacaaggggttttaatgtagatttttttttggccccccatgcggtggatggctaaatgtaccgagtcggatcgtgacgcgtgaaataagtgtctttttttttttttttttttttttttttttttttttttttttttttttggggggggaaaaaagagttttttttttttcccaaaaaacccactgtgtggggccgcggcggggggggggggggggggggcccc

SEQ ID NO: 710722 - DNA, 165 bp, Homo sapiens
  misc_feature (2)..(2): n is a, c, g, or t
tnttttcaaactccggacctcaagtgatctgctgcctcgtcctcccaaagtgctgggatggagggcgagagtcaccgtgcccggcctgcttcgatcatgtaactaagtattggtgaggccctcaggctgtgttcagccggaagagacacaggaacacagatggag

SEQ ID NO: 710723 - DNA, 290 bp, Homo sapiens
tgaaaatggttcaccatctgcagaaatgaccctagagttgttgctacccgatatggttcggctgcgtaccccacccaaattacatcgagaattgtagttcccataatccccatgtgtcgtgcgagggacccggtaggaggtaatcgacatcatgggggcaggtttttcccatactgttctcgtgatagtgaatacatctcactaaatctgatggttttataaagggcagttgccctgcacgtgctctcttgcctgctgccatggaagacatacctttttgctccttcttt

SEQ ID NO: 710724 - DNA, 148 bp, Homo sapiens
aaggtcgacaagggggaacggccgacggaacttaagcgcaaatttgaacagatgaaacaagataggatcaccagataccatgggctgttatatcttatatgtgaagaaatcttgactgactggtattgtatgtatgagacgtctccgg

SEQ ID NO: 710725 - DNA, 1155 bp, Homo sapiens
  misc_feature (1)..(1): n is a, c, g, or t
ngtggggcgacagttgtgtgggttgtgggccccacaaaaagaccgatgatttgcgtaatcgcctgcaggtcctgcctggacagcttcttatcgagctcggtgggtagaaagaattatgtttgtgtaaggcagtctgttgtgtggtggtagccatgtgagatcggtgtggggcagcccctcgtgagtgttgtgatgtggttgggtttgttgcatacgactggtagaaggcacgtctgattggtcgtgtcaactacgagcttactcacgtactgtgtggccgcaaggtccttcaacgactcttgggggttgtacttctcatgaggagtgtgcgccaccacatcctcttgtgttggtctccctctgcgggggaagtcctcaacgacgcgtcgcgcggttgtggggcgacaccgctcctgtggagagtgttcttgtgggagtaccctctgggggagtagtcctcctctgtggtctctcatgctcagcttgtggacaacgaggggaagagtaggactagtggtgtctgtgtcaacactcctcggcgtcacttctatccacagggttgtctgcgctcacacacgcgaggagttgttgtgcctcctacagagaatatgtgtggggcgccgcgcccactagtgtgtgtcacatcgcacaattgtgtctacacacacacagtgtttaatctggtgagagggagacacacagggctacagatactgtttgtcacgagtgtctcactgtcactctggcacttgtcacagcggctgttcttttctgaagatactgcgctcacatgtatacggagaggtcctctgtctgggtgagacacaccacacatgtgtgtgtcttgtcctgtgtgcgtgtggtgtgagagccactctctcctcgaggtgaggccctgtctcttgtgtgtgcgtggcctgaggttctccacggaagcatgttttggtggcccctggtgagtggcgccctgagggctggagaccccccatggccctgcccacgccctggcgtcttgtttgttcttgtctctctggtctccccccttctcccccgccccgtggtggcctgactcccactccctggtggcccccatccccccggttcctcacaatatggtttttacattctggggatttaataaaaacttcacccagt

SEQ ID NO: 710726 - DNA, 273 bp, Homo sapiens
  misc_feature (22)..(22): n is a, c, g, or t
agttcgacggagactctcctcntgcaacagcaaagttggcagaggagagacggcggagaatttacaggaggaaaaggaaaggaagttggaatgcgtgcccctgaaccttcccctgatgaccctgaaagtgtcgagatcatcttcaaattacctaatgtgttctcgagttgagagacgattccccttttcaccgtctctaacagtaatccacgagttcttattctccttgggagggaaggccagaaaagtttcagattggaggggggttaccgg

SEQ ID NO: 710727 - DNA, 423 bp, Homo sapiens
tgtgcatggaattctgtgcttgtaagatctgagctgaggaggcgtgtggcggagagtacaggtggtccaggccagtgcatgagtctggtgacatggtgcacaaacccagaggatcctgtggacagtgggttgggggaggcagaggtgacgctgggtgaggctgtggttgaagctggggaagtgcacccttgcaaaggtgcctgcaatcacaatattgattatgccttctgggtagcagctggaaccaagggtactgagggtcaatggagaacttgccatgtaagtaaaggtctggtttctaggttgcagagacgggagcaaagctgctggggatatgggagatccaacgacctcttctctccagtcatgtcaatattgaatcatgacatatccggacaatccgttcatctggtcaaaggggcc

SEQ ID NO: 710728 - DNA, 1212 bp, Homo sapiens
tggtgtttaaacaagttcgatttttcggccggcgcgcgggggctcacgccgtgttagttcccaggtgtttgggctctacttgtgaattgtgtaaagacagggtctccctcgtgttacacccggaacgtggagtgtgccagtggcctcaatctagtggctcacacagcttctcaacctccgtgggctgaaggtgatctttcccaccttcagccttccgcgcagtgtggctctaggacataccagggtgtgtgcgcatacccacacccagccttacaatttctttatactttctgtgctcacaagacgggctctgtgccagtgttgtgcccaggctgtggctctggaacattgccgtgggccctccacagctatattccttctcgcgccctctcagtttctcccaccacagtatacgtgggaaatatacaggggtgtctgagcccatgtgcccaggcccacagccaattggctaccctgtgtttcccttacgaatgacacaattcaccagagtggctggcgggtggctccactccctataccccatctaaagggctctccctctcccgtgcggtggctatgtgctcccctttgtctctgtctgcgttgacctttatcgcgtggcatagcgcaaatccatttggacccagcactccttaggtgtcaactcgtggggcctcttggggcaaaagagcccccccaatctccccggggttccctctagcgggacccaggggccctctatgctcaccctggcccgagcaccgggcgcagcctggcgcccaaccccaataagggcggggcacggccccgacggtccccacgggaattggcccgacctcggcaggggcgcttaaccctccacttcgccgcacccctcatcaatttacccaaccgtgccccttgccccaaatcttctctcttactttcttcacgcttcctgcgcccctttaaccttgcaaccttccggcgaatggtacttcgttgtcatcccacgcgcctgtggcttccatgcctgcgcgtctccctgaggccgggcgtcaaacaccccgccccccccctggcacaccgcgtctacccagcaacccccacacaccgtggggggcacccctgtactcccgccccagggcggacccggcgcccccccgcgcaaaccgctcccacacacgggcacatggcgatgtgcaaccacacgaagatatatgacgccaccgt

SEQ ID NO: 710729 - DNA, 111 bp, Homo sapiens
tactggacgtagtgtaaggaaaggacaatattcttattatgaaagagattatcttaagaaaactaactcaaagttcagcaagatttatacatcatgatgtgtgacaaacat

SEQ ID NO: 710730 - DNA, 181 bp, Homo sapiens
gctcgacgacagcttgtccagtgagacagggaacaacacagatgcagcattaaggagttttttgtttgtttgttttttaaggtaggggatattattggacttcgtatgtgatggcaatgactcaacagaaagaaaaattgctgatgcaagaaaaagagtgtcttgcctcgtccagtcgacg

SEQ ID NO: 710731 - DNA, 785 bp, Homo sapiens
ggctgcgctcccgttgctcctgccgggtgatggaaaaccccagcccggccgcgccctgggcaaggccctctgcgctctcctcctggccactctcgcgcgccgccggccatcctcttggggtgagagtccgtctgttccgccagagcccctggccatatacagcatcaccttcacgggcacgtggagccagactggtcttccaccaagcagtaccccctgttcctgcccccctgagcagtggtcttcgctgctggtgggccgcggcatagctccgactacagcatgtggaggaagaaccagatacgtcagctaacgggactgcgacgcactttgtcgggagacgcggcgaaggccatgggcagctgatgaaggagatcgaggctggcgggggaggcgctgcagagcgtgcacgatggtgttgttcggcgcccgccgtccccatgcggcaccggtgcatgacgtcggcggagctggaggtgcagctgcaggcactcgctggtctcgtttgtggtgcgcatcgttgcccagccccgactggttcgtgggcgtggacaggctggacctgtgcgacggggaccgttggcgggacacaggcggcgctggacctgtacccctacgacgtcctgtggacggactagcggcttcccttctcctcccccaattcgccagcatcccgggggacacggtgaccgagataacgtgctcctctcccagccacccggccaacgtccttctactacccgcggctgaaggccctgcctcccatcgccagggtgacacgtgtt

SEQ ID NO: 710732 - DNA, 103 bp, Homo sapiens
gcagtcgggatcttctgccaatcctctaatacctgcagcaagcatgtagacttaccttagccggtcgcgcttgtataaggattaacccttcatcgggggcgac

SEQ ID NO: 710733 - DNA, 186 bp, Homo sapiens
tgagatggagtcttgctctgtctcccaggctggagctcagaaacagacccggtccaggataaataatttttttttttcttgagacagagtctcactctgtcgctcaggctggagtgcaggggcgcgatctcagctcactgcaaccaagcaaccccggggttaccgagctcgatttcactggccgtc

SEQ ID NO: 710734 - DNA, 282 bp, Homo sapiens
agctcggtaccgctctcgtgagatgatgacagtgatgatcatctgatcacgacaaaccgtcgtttgtggacgcacctggttgagcgcgacctgaccacgtatgagttcgatcgcatgttcaatcaggttagcgaaaacgtgagctgggctgatgtttcgctcatggctcgcgaattcggcgttacggctgctgatgtgtcgcagtggatcctggagcgacatggcgagctggtccccgatggagcaggggcacaggatgacgaaggctctcgatttggatag

SEQ ID NO: 710735 - DNA, 718 bp, Homo sapiens
  misc_feature (101)..(101): n is a, c, g, or t
aaaattccagattgtgttttagttggttcagcccattatgaagccaagtgccactccccttctgctatagtctctggaagcctagcaacagtcggctctanatttgatagcactctgcaccataataatgtcctgctcatacactattctatctgtggtgctaaacagtctatgtgatagcataagagaacgtcagtaagttcggtagctgcccatcctgcactaatagcctcgttgaaagtcgtaccacgagtctaagctgtggcagtccatgtcccatgcgtttcgtatcactttagtgctgccacggtccccttccgtctatacatacgggttcatatttagaaccagagccgcatccattctcccattctccctggtgacctcgtgacgcgcatgtctctcgctcacatagtgcacgtaggcgctgtcattatgatcatagcagctttcgtatataacttcctcaagactgatttcatgcacatctgctttcttgaccacggtagtgttcttgttccccatagacacactgcagttcatgtatagcgtctctgtcatgttggtctcgctcctgcctatagtgattaatggtaaggtttcgcccaaagcttattctgcagttgatgatcatcgttgtcgcacaagcagcgcactgtctaaagatcgtattctgcgtcactcactttccgtctctgcgtagagcttccatttctta

SEQ ID NO: 710736 - DNA, 454 bp, Homo sapiens
gaattcaaacattcgattccaagagctacctaaattaaggtggctttaaaaaatatttaaattatcaatgatttaggaacgaggctggaagagtaatataaagatgtatatttacaatgccacattaggaaatgtagttccctactctgcactttggaaagacatgaatctgtccagagtcaatactatcatatggctgcttcctactcttccactggaaaaaccctctccacttggaaaattcattttatgcatgctcccactgttgatactctgcatctctcatatgagttaggcaaaatgaatctaataggttacttttgttttcaaaataaaccacccaaacaggttttttaaaactttcaaaaatggaacatttaacccttcacacaaacttccattactgagtacctagtctaatggcaagtacagtattaaggattattgcttttat

SEQ ID NO: 710737 - DNA, 632 bp, Homo sapiens
atcttctttatgcgatcgccatgcctgagccacatcgctgagacaccatgtgtgaaggtgaaggtctggagtcaacggatttggtcgtattgggcgcctggtcaccagggctgcttttaactctggtaaagtgtgatatatgtttgccatcaatgaccccttcattgaccatcaactacatgtgtttacatgttccaatatgattccaaccacaatggcaaaaaatttcccaatgtgacaacactgatcaaaggggcatgagaactgtggaatgctttgtcatcaatgtgaaatcccatcaccatcttcacagtgagctgagatccctccaaaatcaagtggtggctgattgcatggagcttgagtacgtctgtggagtccactggctgtacttcaccatcatggagaaggctgggtgctcatattgcagggtgagtgagccaaaatgggtcatcatctactgcccacatcatgctgattgcacaccaatgttacgtcatggagtgtgaaacagtgagaaggtatgacaaacaagcttcaatgatcaatcatgaaatgactccaagtaaacaacaacatgattaatcaatcactgtgcacaatgtcatccaatgaaaaattttgagaatagt

SEQ ID NO: 710738 - DNA, 912 bp, Homo sapiens
tggcgagggctcgagcctgggtagcatgcagctctggatgcctcggcccaccccttggtgggggcctggggcatcatcaaccaaaggaagcttggccaggatccacgagaccaacctgaagacagacagggcctgctgctctgaaccccttttcggcgttgaaaccgtgtgcgttgaaacattaaccaaaacgcagatgcatgtccatacacgccttgtgggacacatgctttgagccattccatgggtccctcgcaaggactttccagcccctgtgactataggccccctgtacatgttgcatttccaatttccaaaatgtgtccaaagccccccaaatattgggggacccctgaggtgcatgacccaagtcccgtttcaccatttgaaaaagtgcctaaacggaacgccagttttccagaaaccttggaatggcaaaccgcccaagacaagttttcgggacacgggttcggggttttccccggtggaccagaaggccattttgatggagccaaaggtttgtgggccgccccgtttctctagaccgcacggccagcattcgcacaaaaccgcgtgggcaaacaaccccttttttggtggccccaaataacacccgcaactcggctactgttaggcccaaaccgcagagtgcagggccccccaatcggggacgtttcgggccccaccaccatagtattttcccaccccagcccagccgatggaggagttactcgcctcctcacacccaggtggagcaccccccccagtagtgagcccacttggagagagccccccacgagtattattctcaaaaaaccaagcaggggaagtttttctccacgacaaatgtgtcacccgttttttccgtcaccacacaaaaaccctctaggcacgtttgggcagccgatttta

SEQ ID NO: 710739 - DNA, 103 bp, Homo sapiens
  misc_feature (101)..(101): n is a, c, g, or t
ttcggacaattgtcgaacgcgctgctgcgcgattgccgctatctttctgcgatcgggatgcacacccagggcatgacacaggagcaatcgcgcaaaatgtncg

SEQ ID NO: 710740 - DNA, 409 bp, Homo sapiens
cataaaaacttggtgttcaaaatgtacaattcactttaatacattattaatagtagataaatttggtgtaaaatgtatcggctgctgtccagcatgcttttcttctttttatccaaacatgaggccaggaggataattaacttgaggaatagacaacttacattcactacatatttaatcatgcttaaaatgtttgtatttactgccatgcaattgatatagtaaatcgactagaaaattagtatgccacttaattaagataaaaatgcttagttatttatgttagtatctagcttttaaagaactacatgtgtctttaaaagtatttattgtgcaaatgtactatagcagttcatcttcatgttccagccttactctgtgttaatactgcttcacaattctgaatggc

SEQ ID NO: 710741 - DNA, 305 bp, Homo sapiens
tcgagcccctacgcttagcctcctgactagctgggcttacaggtgacgccgccacatccagctaacttttgtatttttagtagagatggggtttcactgtgttggccaggctggtctcgaacgcctgacctcaagtgatccgcctgccttggcctcccaaagtgctgggattacacgtgtgagccaccgtacctggctccctccctctctctttccttcctttctttcctttctttcatttttcttttttttttctttttctttttttttcctgagacagtcttactctgttgcccaggctggag

SEQ ID NO: 710742 - DNA, 581 bp, Homo sapiens
  misc_feature (372)..(372): n is a, c, g, or t
  misc_feature (468)..(468): n is a, c, g, or t
  misc_feature (470)..(470): n is a, c, g, or t
gttccactatcctcaatatgtggctcccaaagtagcccagtgaatgaaatacactaaggaaagtagagaagggaggtgtttgggcacacatcccatttgcccacatgccattggttagaactcaatcacacagtcttacctatatgaaaaatatgctgaaaaatgtactgattgtatacccacttgtcagcagctccatactatgaaagcagacaggaaatttcagtggatagctagccatctctgccagagcagaaagattttgggttctcaccctctctctctttcaacacccgacacttgtttacttgttatagggatcacaaaatgaggcaagacttttgataaaaataaatgaaaagagcaaataanaaaacttttattttgtggaacttgcttgacgttttgaattaagcagagttctttgactggtttagctttaagatagtcagcttgttaatggctaanantttaaggattgatgaatgtaagtatttatacctatatccattttccctccaccctccccaatcaccaaccaggctgcgctcatagagtgaggcacattattcttcttgtgt

SEQ ID NO: 710743 - DNA, 383 bp, Homo sapiens
aagcttagtaggccagatgatcctacaactgcgacactatcatgcgcgctcgctacttgataagtcactcgacagtgctatattgtctgacgtacgatcgacatcgttggactatccagagtcattgaccagtaacctatcaagacctaggctcagcctgcgactacgatcctcggatccgccagttgtgcggaaagactaccggatacgacagactgataatgaggagccttggatactactacgacgtatagataccagtcagtgataagacaacgagctgcgacgttagtagcttgcatgtctgcctaagtgtctcattaaggcaccggtacggcaccgcagtatcgacgatatatggagtacaggacttaatcacggta

SEQ ID NO: 710744 - DNA, 194 bp, Homo sapiens
accggccagtagaaatgggtggagatgtctgttcttccctgttcgccgtcatttatgcaggtcacgccgcatcgtggcgatcttcccgctcattaacatctatgtcgacaaccagaccgccaagcttctgctctgcgcctggatcgtcgccttcttcccgatcctgtccaacacgactgcttggattacaagga

SEQ ID NO: 710745 - DNA, 738 bp, Homo sapiens
  misc_feature (480)..(480): n is a, c, g, or t
ttacaaaacccttttttctcacaccagtgagttttcccctcacagggatgggtccaaaaaaaaccaaaaactgcccttgaaacccccactggtgtattcttcttccgcgccccaaactaatatctccagtccccctctattgaaattcgcaaattccatgggaacacccaatctgggccacacaccgtacgcatctgaattctagtctattctagagaaggtacacacccgcgaattttctataagacagctaacaatattttggtagcacccactcattcctgtgcattccgacaatacactctccgtggtaagttgacacaaataatcattgagttacccccccaacactagttgtccctgactcatctgctcctttcttctaccacacaaattccgattttacagacaaaaatcgcaccgagataagacaacacatcccccggtgatggacaataggtaacaccctactaatactgncccacgcgtataccatttttcatatcaccccttgcacctctatatacactacgcctgtatccaccttatgctgtttaattttccagtagaacttcctgcgcccccacaatattccttcttcataaacccccccaatatttccacgtttctcctgaagacccccacgatacctgtgatacattcaatccacgcctctcaaaaaaagttcttcgtgcgatcaccacgccacataataaaaacctctttcaacaaaacaca

SEQ ID NO: 710746 - DNA, 900 bp, Homo sapiens
  misc_feature (457)..(457): n is a, c, g, or t
  misc_feature (897)..(898): n is a, c, g, or t
tatcgaatgcgaagcattttggagcgccttagttctacacagcaggctgcaagattgctcctatgatgtgtctctaaatacatctgtgttcacatagagcaagaaaggggggttctgagccagtaaggccccactgggaaatgtctcacaggattgcactctacagctctggttgttcattgtttcattttctccaccagcgtctccaagtcagagaaaacagttttgaattgatacagcaagttgagatcttaatcttctggtcttacaagggcatgcaacggctttacccaggggcacctcaccagggagaccagaaaagtaccaaactgtacagtctttgcttttcacacaataagtatacgaacggtactaagtgtacaaaatgggcaaaccagtacacaagatatatcttcttcccccaggttcttccccagaatcaattgcagatactaantttcttattcattcttccagagatgttctatacataacaaagtacaagcaaataacatataacttcccccttctttacaagtggccattgcagagcatgtcaccattagcttattttgcccttattacaattcagtccgttaaaaaacgcaatttgctttcatgaatgtgttagtactccactgcattgatggtccccactgtttttaacatccctcagtggtgctattcaggtgtcccaggcatcctctcccagggactgcaagactacctcacaatgtgtccttaagggctgagctctaggatgatcctaagaaatgggaagatatcattagccaaactacaggcccagggcatacagatccaaactggaaagagagcaatcgcgaacaccgcacgaataaaaccaccagacaaactctctccttccacgtttctcgnngt

SEQ ID NO: 710747 - DNA, 145 bp, Homo sapiens
tctcaatatgttcataatttcctgctgcttctcccatcgttagacatctgccagtaggcctgctgagagaggcctcagcccactcatacctagagacggtgcttgggaaggtcaacacacccaagactttgggagtttgtgtctg

SEQ ID NO: 710748 - DNA, 279 bp, Homo sapiens
atatagagtatactagagtagtcaaattcatagagacagaaagtggataggtggttgccagggctgtgggagagggaagaacaggaagttattgtttaatgggtaaaagtttcagttttagaaaatgataaatgttctggaaatggataatggtgatggttgcaaaacaatgtaaacttggagcaaacttaatgctactgaactgtacacttgaaaatggttaaaatggtacattttatgccattgtgtacttggtttaaatcatgcttaaccatgatt

SEQ ID NO: 710749 - DNA, 555 bp, Homo sapiens
  misc_feature (352)..(352): n is a, c, g, or t
aagttggcaaagcaatttcttcccttgggccttaaaaaagtaacccctataaaggtttcacgcggtgggttcttattgattcgctgtgtcatcacctcagctccactgttgcccaactttgtcgcctgcataatgtatgatggaggcttggatgggaatatgctgattttgttttgcccttaaaggcttctcctcctggagggctgcctagggccccttgcttgatttttcttgagagaagaggagagagagagagacttagccctaggagtgtgggtatgtgtgggtgtgtgggggggggtgtgggggtatgtgtgtaccgggaaatgtgggcggagcgagagcaaaaggnctgcggcctgatgcctggtggaaaaagacccgcttttcctttttggtccgttgggcttcctcctatatcagccccgcggccctacttcgccttttcaggattttgggtgggggcctgggggggggggccgtttttcttaaaagcctttccgttaattttcccggggttcctccccggggacttaaagcaaagccctttttgta

SEQ ID NO: 710750 - DNA, 201 bp, Homo sapiens
ccagcctgggtatatagtgagacaccatctctataaaaaatacaattacctgagtgaggtggtgcatacctgtggtcctagccactcgggagactgagacagaaagatcatttgaacctaggagttagaggctgcagtgagctagaattgcaccactgcattgcaccttggacaacagagtaagactccgtcaccaaaaaa

SEQ ID NO: 710751 - DNA, 192 bp, Homo sapiens
cgcatctacagggtcactgtgtcctcacctcagtcagggctaatactcacctctacctctatatgtggcgtgtcacatgatacactccgaggtagtcatacatccatatagcacatatctataatacatcatatgtgtcaagcacagtcctattgcacacagaatacagcagtgaattaaacagggaaaaat

SEQ ID NO: 710752 - DNA, 208 bp, Homo sapiens
  misc_feature (119)..(119): n is a, c, g, or t
  misc_feature (122)..(122): n is a, c, g, or t
  misc_feature (151)..(151): n is a, c, g, or t
  misc_feature (193)..(193): n is a, c, g, or t
  misc_feature (200)..(200): n is a, c, g, or t
tgcttagcacctcacggaactcggggtcgtcgtggcttgtagcggcagccgaaacacacggcactcatgacgttgccacggccacgacggtcagcggcctcgggtcgaggaaaggcgcncgntcctgccgcgcaccagcagcgccacccantcgcgcgcctcgctcagcacgtggccctcgaggacttggcgntgcgcgntggcgcgt

SEQ ID NO: 710753 - DNA, 523 bp, Homo sapiens
gttgcctggaatgcctccaggcatacctccattaatgccagagtgttcctcctctgatgccaggaatgccaacagtatattgccagggtatggcacctggattgcatcatcagagaaaatacagccagtcattttgcggtgaaaacataatgatgccactgggtggaatgatgccacctggaccaggaataccagctctgatgcctggaatgccaccagagtatgcccccatctgttccacgtcctggaattcctccaatgactcaagcacaggctgtttcagcgccaggtattcttaatagaccatctgcaccaacagcaactgtacctgccccacagtctccagttactaagcctctattccccagtgctggacacatggggacacctgtcacaagctcaaatacagcttcatccaattcagaaagtctgtctgcatcttctaaagctctgtgtcctagcacagcacaagctcaggcagctgtcccaggacctgtaggtacagatttcaaagccttaaata

SEQ ID NO: 710754 - DNA, 266 bp, Homo sapiens
tccgttccggagcagtgtggagcgcgtgcccgcgatagtgacttggccctggattctatgagctgcgtcgatcacccctaagtctcactgcttgatctcccctctagagttcacgaggatcctggagggcttcacatctcggtgcatgatctgatgtttctctcgaaggtacgccaagccccggtgaaccgcgatgctgagttaccccaggatctcctctgtaatcctcttggcctctttcagcacctagtccaggcagccgccat

SEQ ID NO: 710755 - DNA, 192 bp, Homo sapiens
attttcccgaagcctcctcagcgatgtgactcaagttaaacctacttctccgtttatcaattacccagagcgacagtggttcacggccgggtaatcccagcactttgggaggcatgaggcgggcggtatgatgagttcagggagttccaggaccatgcctgtaccaaatactggtgatagaccctggtctct

SEQ ID NO: 710756 - DNA, 503 bp, Homo sapiens
acacttctttcctggaatggcagccacgagagagggaattgtatatggtcacggagaatggcaggcaagtcaccgaatatttcctatgatggtgtggtagcatgctcagagctgctgggggtgggaggtggatgctgtgagcaacgtctcagactctcagcatctcttagaagcaggagagtgagcttgatagttctctgggactcaaaggaaaaaagctttttctaggaagctaaatcaggagaagccatactcatgtgagaagtacgcccatctcatctgtggatgagaaaccagatggccaccactgaattactttcctgaaaactgaaacatccccatggaggaaaggagggagggggaggctcataagactctggaagtaaacaaaacctattagcctggggaagctcagaaagctaccaagctcacagggcttttccccaaggttgtatgagcagtgagtggtatgactagggagaaaagacctctttggtcgacgc

SEQ ID NO: 710757 - DNA, 509 bp, Homo sapiens
gtgatctagaggatccctggccagggctctctaccggatgcgtatcattgcttcttctcctccttcaagggtgcaaccctccggcgaattttcctcatcctcggcggccacggggccctctctcctttgattggttcagcatatggatctctctccagcgggacttcttaaagcgactccttcaacggggtcacgtgtcctttcagcagtatctgctcccgtatggacggctctaactgccgctggagaagtgcttgagggcggctcgagaacccatcgggcttcttcttcgggggggcggcgacagcacagagagaccattctaactctcctataggcggcgatgaacgtggcgggcggccggccagatcctgggactcttcttcaaggtatcggagagaatggtttcaggtgatacgggtccgtattaagtttctttggctcggtgtccaatctcgggattggaccctctagctccctttcagctttcggtatctcatggttaactt

SEQ ID NO: 710758 - DNA, 355 bp, Homo sapiens
gaggatcccccatcggatgccccgtgagcccagctgtctctctaccatacaatagaagaatatattataatctttgaagaagaagaagtggattggatcagtgtgcctgtttccatagttcgcagatagtgatcctgccaatgttgttcatgactttaacatgaaacttgcagcctattttgatctttgcctggttgagtgctatttgatccctctgaatacttccattgttttgccacccagtaaagcttctggagttgcttattaccatctaggctggcaactatttgcctcagtcctctctgattcatgagcacatagttcttactgatcgcattgaatactcttatcacct

SEQ ID NO: 710759 - DNA, 575 bp, Homo sapiens
gagcagatctctcaggaggagtgtatcagtcaggctctgcgacaggagactgcagacaaagagcagaatctcctgcagttacgcagcgctatgaaggagctctcagtgcagaaccaggagctgatggagcataatctaaccctgcaggagcgtcttcagggcgaggagccatccagtggctgtggtttgctgcctgccggagctcgactcacccagaggctgcatggagagatggcggcctgtctgtgtgacttgcgctccctatgcaacgtcctcacgcagagggctcagggccccgacccaaaacctctccatgctgctcggcattgcatcagctcctcctccagtagcagagcagtgggacgactggctcagtcctgaaggcctgcagaagaagctgaatgaagcccaacagctccgtcgagacgtggaggaattaagaactacagtctcagacagatacgctcaggatatgggagaaaactgcatcactcaatgagaatgtgttcaacgagggtaaatccacatcacacgtgccttcaaaaaacactacagaaacaaacctcgaaaaaaaa

SEQ ID NO: 710760 - DNA, 299 bp, Homo sapiens
  misc_feature (182)..(182): n is a, c, g, or t
aatataattgccttttttctcacctgcacttagaggaaatttgaaccagttgggaaaaaacaatttttggttcaattctaagaaacacttgcagctctagtaatcacttgagtcctcctgtttttcctgtaccgggtcatggtaaattttgggtgttttggttgttttcctaaaaaacaagntaaaacctggcgatttctgcaggctgtgtaagcatgtttacctgttggcttgccttgtgtgtctgttaaatgaatgtcaaatgtaaatgctaaaataaatcgacagtgtctcagaaa

SEQ ID NO: 710761 - DNA, 129 bp, Homo sapiens
tgtgggtagcagcaactgtgtacatccgagatgaagtggacctgatgctgtatttgggtatttttctcctctacctcctaaaaaaaaataccataagaagaatctagaatgtacgcataagcaaatcaa

SEQ ID NO: 710762 - DNA, 285 bp, Homo sapiens
gaggaagaatggactgtgtgttaaggggaagggcagcagggactaagtgaccagatggtggactgtagctctggggactggcacaggtgcagcaatggactggctccctctcactgtgaaacgaaatatgccatccctgcaagagcctacacagcacttcttgatacctgggcagtcagtatctatcaagcagcggttagggggatacaacatagggcaccggatcatgatactggggcaggagccaggctaaactggagacttggaccatatgactttgctctt

SEQ ID NO: 710763 - DNA, 105 bp, Homo sapiens
tctcagggtcttcccagctactcacggaggcgacgtgagagtatcctaacctggagatcgaggctgagtaagccaagattgcagcactgtatctccagcctgtgt

SEQ ID NO: 710764 - DNA, 179 bp, Homo sapiens
tgcgagatgaggcaggaggctcacttgagctcagaagtcaataccagcctcatctctactaaataacaaaatatggctcacacctgtaatcccagcacttgggagcccaaggcagggcggatcacgaggttaggagatcgagaccatcctggctaatagggtgaaaccccatctctact

SEQ ID NO: 710765 - DNA, 159 bp, Homo sapiens
  misc_feature (9)..(9): n is a, c, g, or t
tgctgacgntgtggacttgaccacttatgccaaatgatattgatactgacttctgttgggagctctccaaagaaactggttggttttaagaaaatagtttcaagaagttcaactatatttcttttagaatattatgtataggttttactcctgaattag

SEQ ID NO: 710766 - DNA, 559 bp, Homo sapiens
ggggggctgagcgcagaagcggctcgaggctggaagaggatcctgggcgccgccaagtctttagcaccagttggtgtacggatgttgagacctacttcacagtatgttctggtggacaatcacaatgcggaatccaaggagggtctgtcctgttcgggctgctgctcgtcctggctggtcttctgccattcaggtcatagcctgcagtgctacaatggtcctaacccaattggctgactgcaaaacagccgtcaattggttcatctggatttggatggcgtggtctcattaccaaagctggtgttacaacgttgttttcacactgtgttggcacagttgtgagcattgcaattttcaacgacggtcaacaacccggttgaggggaaaaatggagctaacgtactactgctgcaagaagggacctgtgtaactttaacgaacagtttgaaaatggtgggacatccttatcagagaaaccagttcttctggctggtgactccatttctgggcagcaagcttggagccttcatccctaagtcaacaccaggagagcttctcc

SEQ ID NO: 710767 - DNA, 191 bp, Homo sapiens
taagagtcatagtctggaaaacttgtgccttgtatcgtgtccccatgggtctcccactgcagcctcgagtgcccgggtcccacctggctccccctgctggatatctagtgtttttttatgtctctgttttattctcaggaaaatttaattctaggagtgaacattttcttattcatctttagaaacagttc

SEQ ID NO: 710768 - DNA, 466 bp, Homo sapiens
gacagtccctgctgttgactatatgttgggtgtacgtaatgactgggaatgtctagtgctgtccatgcactacactttactttgttctttatgacatgttctatatgattctgattttaaagatgaaaaaacaaacacacacaagttaactgtacagatgagctggtggcacaatcagcgggtcagcgctagaatcaaacctcagcagctaggttggaacactcagtgactgaataaccttggcaagttacttgaccttcctgtgcctcagttttcttacccgttaagtagggctgatattgataactacctcgtaaagtttctgtgaagactaaaagagatatgtaccatgttcgaaatagtgcctcgaatgtggtaagtcctctgtgtatgaaagactaaagctggccttcatcttctacagattagttgaaaaatgcaccaaatagtcaggagcacggaaccg

SEQ ID NO: 710769 - DNA, 110 bp, Homo sapiens
ccaggatacacccactagtgcctcaggtgcccggccctgtgacttcagccatggccacaggcgttagctgtttaacgggaaaggttgaaaggatttttgacaaaaaggga

SEQ ID NO: 710770 - DNA, 425 bp, Homo sapiens
agcacgcggggcatcgcgtcagtccagtgattccagttacctcctggagagcagcgagttgaccccagcgggtctgagatgtccaagactgcccgcgagaaagcagtgtcccgcagacaggcgcgggaatggtgacagagacgtcccgcaggcggaggtaggccggggaggcgggagacggccccggcacagacctgaggaggccggggaaggcgcgataggcggcggccaggagagagcccggttgccggaggccacgaaagatctcggagtgacagcgagagtcgcacaacatagcaggaacggacgacaatcggccccaaaagagacccgaggaaatgagaaccacagaacaagacaagagaacaaaaagaacagaaatgacaatgaaaaagaccataagataagaaagagagtcaatcaaa

SEQ ID NO: 710771 - DNA, 520 bp, Homo sapiens
tggaaggtaacaggggcagaggtaggcagttctccatccaccgggaatcctggctagaaacacccagtgaagggaacaacaattctcagaagagaagcttagccccagggcaacggcccaagggctgggcaacgatggacagggttacagagccctggtatagtgaagaaggtgcgggaagggaagtcaggaggccgggggggtagtctaggctctctattaattggaaaggactacttatggtatgattccaactttacaacattcgggagaaggcaaaactagggagacagcgaaaagaccaggggtggccagaggttagagggaggcatgattaggtgaagcagggaggatttccagggcaaggaaactactcggtatgatactatgatgccatcaggcattggtagaaacccacagaaggtgtgacaccaagagtgagccctaaggtgacctagggatcggggtgatactgatgtatcagcgtaggtccgtggagtagaacaaatgccccggtctg

SEQ ID NO: 710772 - DNA, 769 bp, Homo sapiens
cacaccgtgttagggggggcactacagactctatttttccccgtgttgtgcgccaccgcgggactcgtgcgccacagccagtgttcgtatttggggtgcccccgccgcgccccgacacgtttgttgtagtcccacagcgagtctgagaaataatgtggggcccccctcattaaccccttctgccaccccctttgttgtacaatcacagccacgggagaccgccctcgtgttgtgtatctctcccccccgccctctctggtgcccctgcgccacacatagtttgtgggtggttgttgtcccccgcaccagctgcagggtggccacccccacacccaccctttgttcgctctttccaccaacaggggggtctcgcagaactatattttttcagggggtgtctcacaacttctgggttattccccccagcgcccttctcccccattttttttcataaccgcggaaacaccacaacaaatttttgttatatagaccaccacctcccccccctccacaatctgttgtctggggaaacaaacacatatgagagcaactcttctccactacgacacttgtaccacaaccattttttgtgttgacacagacaccacttttaacccaccccgtttttatgatatctccgccgccagcaactacccccctttcctgcccactaacacccccctttttaattttctcccccccccccccccttttttttaaaaattttccaaaacccctccattttcccccattcccccccaaaacctta

SEQ ID NO: 710773 - DNA, 156 bp, Homo sapiens
  misc_feature (1)..(1): n is a, c, g, or t
ncctaggtgtcacagatattgagccctggactgcgaccacgggttctggagtccattcaattcccagccttggttattcctggctgtgtaacctcaaggaaattacctaaacactctgagttttgattctatcatcaataaaatgaaggaaatgct

SEQ ID NO: 710774 - DNA, 486 bp, Homo sapiens
ggagggtggggggccagaccgggacccgatgaaggggggttagccagatcaagaagaccacctcccaaaagcaccgagacttcggtggcagagcccacgggggagaagccagggggagccggctgggaatggtgaagtcctgggcaagaagctggaggacaggggctccgacaaggcctatgttgtccttgggcagtttctagtgctacagaaagatgaagacctcttccgggaatgcctgaaagaaacttgtggcgccaacgccaagcagtcccgggactgcttcggatgcctacgagagtgatgcgacccctacttgtgatgctctctgggaagctctcaatccccagccctcatccagagtttgcagccgagtcgggactcctcccctgtcctctacgcaggaaaagattgctattgtcgtactcccctccgacgtactccggggtcttttgggagttttctcccctaaccatttcacctttt

SEQ ID NO: 710775 - DNA, 884 bp, Homo sapiens
  misc_feature (884)..(884): n is a, c, g, or t
gctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccaaagtggcgccatgtgcactccagcctgggcaatgagtgaaattctgtctcaaataacacaataacaactaaaactatttgtgaccttgtgtttcatttagtttggaacagactatttgcaaaagtaccagagttactcttcagccaattacttcacaactttagattgttaccaagagtgacacggagatcttgttttggcagaatcattattagatgccaacaatgggagacccaacgtgttgatttcttgtaacctatttgtggggaacaaggacctaatgacctaatatgcaatttctgcctcgtgttcttttttctcctaacacacagcatgggtggaacatttcagaaacctcaggcaggcctatggttctaatgtgagactacctttcattaaaaaaaggtgaagggtggagccctggtagttggtaaactttttatacaaattcgcctggaagtgaaaaatttgtataactgattaggtggtacgtatatagggtaagttggtggatgtcaaagaaatctaaagggtaggcgaggaagataactggtagggggtcctaaaagagaaattataggatagggggtgtgtaacatttaagaaaaaaaagggtggcagatatggggagaagggagtagatgtatacagtttgtttttatatggn

SEQ ID NO: 710776 - DNA, 404 bp, Homo sapiens
ttcggcacgagaattcctcacatgaatacagaatacttgtgctactgctgatgatcaacactttatacagtgcctggtataccacaggtctctgcattaacagcaagatggcaaagccagcccacagcagctatgtccttcagcagctaaacaaccaaagagagtggggttttctctgtgactgctgtattgcaattgatgacatttactttcaagcacacaaggcagttctagctggctgtaggtcctatttggctgttttcctggaccctacagcctaagtacgcccactgattccaggcccatgaccttagtgcagatgttttgtctcatttgcagttatgtatttagggccttatgacagctcccccagttttgagccgtttaaggggcatgaacaccac

SEQ ID NO: 710777 - DNA, 584 bp, Homo sapiens
ctgtttgagcctgctgaggggcagtgatgcaatcatagctcactatagcctcaatcacctgagctcaagcgaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccaccgcgcccggccgcttgtatttgttaaggaacaaaagatgtgaagctcttattcttgtgttactgtttagtggtgctctgctctgccactggagtatggtaacatcttcatatcttatccagacttgttaactgtacacctctcatgcttaataacagtttagctttctgctcatattgctggtattttgaacacaagatacttcttggacgcttgagttgtggttttccatttctcattggagatgatgagagtttgagcagcattatggaagaataatgttgtaacaactttctcctggaaatcacttcgagttctaaaccatcaca

SEQ ID NO: 710778 - DNA, 810 bp, Homo sapiens
gctggctctgggccttgaacattccgaaactgtcaagatgggcaacaggttgattgtacacaggactatgaactctgctccggaaaccaggtgcgtggctatcccactctctctctggttccgagcatgggaaagaaaggtggatcagtacaagggaaagcgggattatgcgatcgtcacttgaagggagtaccgtggagtcgcacgctgcagcgcagctagagacatggacgcgacggaagaccacgccctcagaggccccggtgctgggaggctgagcccgatggttgacaatgggccactgtgtaggcaaacgtcacttgaacataatcgttcgatgagcaccagttcagggaaggaaataacacttcaatccaaggtttgtatagcctccatggtggtcggtacatggtagcgacattctggctcctactatgaggaggaactctctacatacaaggaattgccctgagtctaggcggggggtcaagatcgccgaagtagattggcactgctgaaccgtgaatatctgcgagcaagtattcggtacgaggcctaccccaagtaattgcttttgcgaggaggggaatgaaagtcagtgagcacagtggaggcagagaccttgactcgttacaaccgtttgtcctgagcccaagcgaaagacgaactttaggaacaccagttggaggtccactctcctgccagtcccgacctgcgttaggagtcagtcccacagaggcactgggttcccagtggttgggtgtcagaaagcagaacattctaggcgtgaggaatcttcttgagtgtgtg

SEQ ID NO: 710779 - DNA, 307 bp, Homo sapiens
tcggataaggcgagacttctagaattaaatcactctcctggataggcggtactgaggaggctgctgagtctgtgtgcaccattcgcccggccccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcaga

SEQ ID NO: 710780 - DNA, 1136 bp, Homo sapiens
cgctacaacaatgtcttccacaactcaaactcccaccgcgctcacacaaccggtccactcctgccttttcactcacacagctcccgactgcttcttgcagaggctgagagtccccccccccccacctttttttttccattttagattgtaacaaacctagtagttaatgtccactcaatgggtcgggaattatctcataatatttatatccagtgtactctttggagtgtatagaagtagttgtgcaaactcatggttcacctgtggggctaaagtgaccgagaatgctgccacgaggacctgagacactgcatgaaagggtgctatcttgggcactttcaacatgctcctgttgcgaaggtagctcgtgatggaagttattctttaatttcccatggtcctacaaaaggtcgtcgggcacactctggtatccctgaaatgtggtcctactaagacctgggatttcgacttggttttacccataggatggtcatcacagtagtgcgcataatcatatccctacagagaggtagcacaggtttagagccgaattcgcttaccagaagttgtgagaagaccaatggtcctcagtgagcgcatggacgcatccacgggacatctgccagagcacgcgctacgcagggagagcaaattcacacaaacactggtcaatttcaactgtcacacaaaattctctcttaccatatacaccgggatggtccactccgccagttgcactgtaacactttatcgcaacaagacgaaaactgcccaacgaaaatgttgaaccacgggcaatttctagcaggacgatgactatcatatgggaggggattcactatatcaccgtcggtgctgtagaccaacggcgacatacattcgggtcgcgcaaacaaaaacagacgggagcacaaaaacacagcgattagttagcagaagcggataataacactgtccccccccctggggaaatgaaatcaacggcgtacaaaaagcacttgggcaccaccacttggacatgttacgcccacgatttttcttaaaacaagaggacacccctgctgagcgcaccaagtatttttcaactcttggtgcaacaacacaaggggttctagacgaaagttaaccgtgaaact

SEQ ID NO: 710781 - DNA, 654 bp, Homo sapiens
  misc_feature (26)..(26): n is a, c, g, or t
  misc_feature (83)..(83): n is a, c, g, or t
  misc_feature (108)..(108): n is a, c, g, or t
  misc_feature (129)..(129): n is a, c, g, or t
  misc_feature (144)..(144): n is a, c, g, or t
  misc_feature (163)..(163): n is a, c, g, or t
  misc_feature (165)..(165): n is a, c, g, or t
  misc_feature (167)..(167): n is a, c, g, or t
  misc_feature (186)..(188): n is a, c, g, or t
  misc_feature (206)..(206): n is a, c, g, or t
  misc_feature (212)..(212): n is a, c, g, or t
  misc_feature (215)..(215): n is a, c, g, or t
  misc_feature (235)..(235): n is a, c, g, or t
  misc_feature (303)..(304): n is a, c, g, or t
  misc_feature (308)..(308): n is a, c, g, or t
  misc_feature (310)..(310): n is a, c, g, or t
  misc_feature (315)..(315): n is a, c, g, or t
  misc_feature (318)..(318): n is a, c, g, or t
  misc_feature (327)..(327): n is a, c, g, or t
  misc_feature (346)..(346): n is a, c, g, or t
  misc_feature (374)..(374): n is a, c, g, or t
  misc_feature (392)..(392): n is a, c, g, or t
  misc_feature (401)..(401): n is a, c, g, or t
  misc_feature (403)..(403): n is a, c, g, or t
  misc_feature (406)..(409): n is a, c, g, or t
  misc_feature (423)..(423): n is a, c, g, or t
  misc_feature (451)..(451): n is a, c, g, or t
  misc_feature (465)..(465): n is a, c, g, or t
  misc_feature (477)..(477): n is a, c, g, or t
  misc_feature (483)..(484): n is a, c, g, or t
  misc_feature (491)..(491): n is a, c, g, or t
  misc_feature (533)..(533): n is a, c, g, or t
  misc_feature (654)..(654): n is a, c, g, or t
gagacccactaatgatgggcccatcnctccagtgccgcaccattccctcccgacctggcacaagagattctaggagccacggncctagagtatacagaacagcccggncaaacctcgtaccacgacggngcaagcgaagagccnggcctccctccctgcctgncntnggcaccggccacatcactnnntgcgtatcttcttcttcnccggcnccnggacattggccgcctttgcncgggcactggtcaggaggccagaggtgtcctccttctctggcgagcccctctctggccacggcccctnngctnanctcgnagnagggcccgntcagctgatgactggctgnacaccagcctctgcacgcgcctcggggncggcccctacacccctcntccagctcntntgnnnntccatgcccgggcncgggggctccttctcacctttccctctntactgcagcaaccngagaaagaagcnactgcnngctgcgncttcttctgccgcctccctacaagcaggcgcatgcaggcctnctctgggatctcatcttcagggaaaatgcctcctgccaagtcctgcagcttccggatcactctgtagagacgctttctgtactgagaaggggtgcactggcggctggccatttcaaacagn

SEQ ID NO: 710782 - DNA, 164 bp, Homo sapiens
ccacgaataagcaggcagaaaaagaagataagaaaaagaaaagaaaagagaagcaagtacacaacaaataagaagacgaatatcaataacagaacacagaagaaagaaaagaaataataaagcgacaaacatgaaagaaacaggaaaaagataaaacgataaaa

SEQ ID NO: 710783 - DNA, 664 bp, Homo sapiens
  misc_feature (21)..(21): n is a, c, g, or t
  misc_feature (37)..(37): n is a, c, g, or t
  misc_feature (350)..(350): n is a, c, g, or t
ttgcattaacttgatgagacnttgttggcatttggancatctagattggcaatttcattgataaaaacgctgtgcaatggctgtatagaaacttctgctacaccactgccttctcctggttcatccttaaaggtgactttgactctgtgcacagccattggcgtggtagcacatcttcggccaaaatggttgttaagctgtctcatagtctgctgaatgagaagatcccgatcgcgatcgacctctagtgataaatctcttgattgctggtttctcagtttttccatctctctacggaactttgattcttttacctcaaaaccacccaattcagttaaaatcgatccagntctgcaccaacatcttccatgaatactctgccgaacagttctaaagacaggcgccagcgtcccagcagcatgtcatgggagataaccatgcccatgaaactgcactgaggcctgaaagatgtaagggggggcccttcactttccgtgagtcctatctctgctagtaaactgcttttcaactgggcagcaacatcaggagcggatggacctggctttgaactgtcagcttcttcggccagcaggctctgttcttccccttctttcttctgccggttttgcatgttcattacattttttagattggcagcataaga

SEQ ID NO: 710784 - DNA, 382 bp, Homo sapiens
  misc_feature (145)..(145): n is a, c, g, or t
ggatcccggaaattgtgtggtgttatgatttttggaagctttatctgtttgcagcctttatccgttcctgagtggaagtgggatcagatatctatggacctcatcgttggtttactgagaacgaggagaggtcatgactctattngagtgatagtagacaggcttacgaagtaggcgcactccttgcctgtgaggactacttatactgtggataagctcgcaagactctatattcaggagattgtatgacttcatagcgtacctcattacatcatctcagatcgagatttgattttcaccttgagattttagaggaggttacattcagcttagggcactcagttggattattgcataacaccacacaattccgggtaccgag

SEQ ID NO: 710785 - DNA, 604 bp, Homo sapiens
acaaatcaaggtatggacgagatatgttctcgtagacaatcttatcgagttcacactatgacaatatccaataatataaacaaagatgacatattctcaacaattattatatgcatgctgcagtatcactcaggcgagcatacgttctccacgttctacattcgagtagttgtgtgagtaccgtgtgcattcctgcaacgtcataggaacaagatcaatcacaatggggattcttaattcatacgctcgttcacgttgggcaaagcaaagttcatacgacgacgcatcgctgggatcttgacactgcgccagtgacaacgacacttcttctttataccttgacatatattgcgttgcttcagcttatacccgtccataatactgtcgtacacttacagtgctcgatccaagttttaccagaggttcacctctctcgcgtgttccctaacccattccagtccacggacattcacacacatcatcgcgccatctgtcattaacacactggtggcacagacagctccatacgtggcatataacacattcagcacgtcagcatacatcggggtcaccctttgactcgccctctgtctacatctactcg

SEQ ID NO: 710786 - DNA, 222 bp, Homo sapiens
gacgcaggaagaagtcagagctctatgtataccatagactctaggatctttggtttgttttttaattttaagttccaggcacatgtggaggatgtgcaggcttgtcacataggtagacatgtgctgtgatgtttggctgcacttatcaacctatcgcgtaggtatgaagcccagcatgcattagccatttttcctgatgctattgaaacttctaaaactagg

SEQ ID NO: 710787 - DNA, 272 bp, Homo sapiens
ggtcatactagaaatttatctttggatattgcaaagctaaaggaacaagtatttcaagcctctcagatacatctgacactaatgccaggaactgaagtgcttgaaggagctacaggcggattagcagctattaacctgctaaaatggatcaagacacttggaggctctgtgatttcaatgattgtgcttttaatctgtgttgtttgtctttatatagtctgtagatgcggaagccacctctggagagaaagccaccactgagagcaagcaat

SEQ ID NO: 710788 - DNA, 750 bp, Homo sapiens
  misc_feature (228)..(228): n is a, c, g, or t
taggatctgagctttacaaagtgttctgggtgagggcaaattacgagaaccaagtggaaacgtacggggggccattataagtcctgggtttttaaggttcgtgccgatccggcagctgcaagaggggctcctgggactccgagcaggccctaatccgtgcttggaccacacttcccagcagccttcacgccgcggacgggtcctttgctgggggaagggggattcctntcgaatgcaggctggtcggtgtgcagaggacgtggagctagtcacgagtcagtactgcacggcagtgctattgacttggatgacgggaacgtcctctaagtaggtgcctaggaatgctgtgcgtgcaggtgcgcatgagagatcggcgtctactatagtcgaggtctcgcgtaaggaactaacagggcaagacatgcatcatttgctccaaagtgtgcacagtcaaatcctggggagaatcatgataaccctgatcactgagcagctactgaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcaagccttctccca

SEQ ID NO: 710789 - DNA, 361 bp, Homo sapiens
agccgacaggcgtactgaccaggtactgacccattggaggagggccatggcgcccaccagggagggggccctggttggtcttttttgggggttgcatccaccggggtgggggaacatcgaggtctgagctcatgcgatttaccaccatgcccacctgtcgggctgggtaatgggtgggggaagctgtgggggccacctccgggcccaccaggaccacctccatgcatgccttggtagggccgactctctgaagggccaaaattcatccagggtgggcggctttgggtggaaaacatgagaaacggtggaggtgggttgttggcgggagcagcacgacaaggtgccctggccaggggtgagg

SEQ ID NO: 710790 - DNA, 386 bp, Homo sapiens
gagaacgctccgccgccgctgctgtcgcgacccggactgcgcgccagcacccccctgccgacagctccgtcactatggaggatatgaacgagtacagcattatagaggaattcgcatagggattcaggatcaacgcgagcgagaatcagcaggatgacggttaaacgtttattggaggcttgagctgtgatacacagccaaaagatctgacacgagtacttgtctcgagttggggaaggcgaatactgcacaatgtcaacagatcccgtcactgggagagcaagaggagttggatttgcgcttttcaaagatgctgctaatgatgatacaggttatggaactgacagaacacaaactggatggccttgatagtcccgggccgcttt

SEQ ID NO: 710791 - DNA, 322 bp, Homo sapiens
  misc_feature (165)..(165): n is a, c, g, or t
tatacacatctgtgtgaggcctcaaaagattgtgcactttcgaggctgaggattacaggcacccactaccatgccagttaattttttgtatttttagtacagacggggttcaccatgctggccagctggtctggaactcttgacctcagctgataccacctcggnctcccaaaagtgctgggattacaggcatgagccacagcgcccggggcgcaatgtacgtatttctaataatagtctgtggtcattgctgtcattcctattttgaggtgattaagtgccctcctgggcctgactcgaacaagatcacggtggtatagct

SEQ ID NO: 710792 - DNA, 338 bp, Homo sapiens
tcccggatgaggaacgtcactgtgaaccgagtgcaggacctgaggaggagacccgcgctccagcaggcagcctggatctaggaagtgatccgtctccacacagagccgggtctgtctcagcgagctccttacttggctgagctctgcccaggtgaacctcgcaggcctgggaactccgatacacggggcggagctggggtcagagttcatttcttcccaaacgggcggctccagaaacgctccaaacttttcttccgttttccactggcaagggacccagcattttactgggagcctaaggaggagaaaggtctaccgggcttgtccctgcggtgagg

SEQ ID NO: 710793 - DNA, 216 bp, Homo sapiens
gacgcacagacaggatccaggaaccagtgttctgatgaagcttggactgagcgacgctaagctagcaagcagcagttcgtggtgaatatcggaaaagagtccaggagccagtgcgatttggtgaaggaagctaggaagaacgaaggagcgctaactatttggtggatcaagctaggaaaacggattcccggatggagcgagtgctacaagtgtgct

SEQ ID NO: 710794 - DNA, 956 bp, Homo sapiens
gggatcccagggtggatctggattcgaatcccgttgccgactcgcgctctcggcttcgtgtccgggtgcttcttccctggctccgaccggcggtacctggacgcgtggcttcttccccgcggctgatctgcgcagaccggagggcgccctgcaaggagctcgcggcggcgggtgcgcgctgagcgggggaggcgtgcggcgcgcattctgcggggcggtggcgtacgttctgccggcgtgatgcactgctcggtcgacctacctggcccgggcggacgtcgatgtctactaatgaccaatgtcggctgtaacaatgggagcgtatctagtgtgttcgtcttatctccgtccccatcggctttcctctttgtgcatcacgctggggtcctggcgactgcactgagatgtggcgagtcagtctgttggtggcgtgctggggactcactcgtgtatcagcgtgtgaggctgcaccagttctgtcttctctgtattaccatcgctcgtgtacctgggccctcgattacacggccacagaccctgtgtcgcatgcctagcgcctctggctctggcctggattttttcttatctcctgtacttgcgattccctgaggcgcctgggctggcccatcccacgcccttaacaaatgcgtgccaggctgctgctgacgctgaagctggtgagcctggcagttgaagttccagtgactgtgtcttggccagaggagggagatggctcaggcttcaggaaggggccaccttggggttgttgcccgacgtgccctccttggtggagacactcagtacaggtacgtgtacggggggctccttgacgggccgttttccgctaccggcctaccttggtgggtgggagccttcccgggggattgccagctggggccctgttgggccggctggggcccgctttggcggggtcggccctccccttcggggggggg

SEQ ID NO: 710795 - DNA, 167 bp, Homo sapiens
cggtaccgatcatgggttctggacgtcatctgctccagctccatgtgcggtagagctgctgcagctgcgggggctagacgctctgtgagctccgtgaagttgttctcggcgaaactctcgaactcgctgtgcacgttgtgggggtgtgaagtcccacgtaatggtcg

SEQ ID NO: 710796 - DNA, 278 bp, Homo sapiens
  misc_feature (38)..(38): n is a, c, g, or t
tcgagaggatccctgtgccaggtggagtacagatcatnagctcacgcaccttgaactcctgaactcaagcaatctttccatcttggctcccaaagcattcggattacaggtgtgaaccactgcacctggcccgatgctgcagtcttgaggcagaatttcttcttctctgagaaacctcagttttactctgaaggctttcaacagacccacattatcaagagtaatctcctttatttaaagtcaactaagtgtacatgttacccatacctataaaaatg

SEQ ID NO: 710797 - DNA, 919 bp, Homo sapiens
gcacccccaacccggtcatcctccaggactgcatgtggagcggcttctccgcccgcgagaagctggagctgcgcctgtgagcgagaatgctgcagcacggccgcgggccgccaaccgccggttccacctgcccagtcccctgggagccggcgcctgccagccctgcgggtcgctgggcactggctggggctgcgggagcctggcctgcgcctggtggccgccctgccctgcctgagctctgcccaccctggcctgccgagtgcgtggatccctgcctgtggtcttcccctttccctgtgaacaagctgcgagccagtgcccgtgccctgcagcccctggccagtgccccgtgcggctgggcccgtgcggtctgcctcgtgggtgctgtggtatttgcctgcaccagcctggtggcccccggtggtgtctgcccctcctgctgccccagtgctgtgctgccatgaccagcggctggcgaccacataggcccctcagtaccctccggacgaggacaccctcgagcgattcagatgatgaagatgatgaagaggacgatgaagaggcacgacactcgacgtagagcccagacggaacacagcgagcgaccatccctccccaccacgcaacggatcgacaccaagagtacagccagcacctagaggtagcaaacaacaaacgacctaggtcccgagagaggagccacacccaccagagcagatgcccacagacgaatgccatgccgagctccacaccagcgacgcaaaccacatacgcaggaccgttaccaccgacatgcgcgcgctgaaggatgcccacaaacagacgacgataaagcaagcagaagaaaaagatcagaccacaagtgcacacccaccacagctcacagctctgagcgcgcacaaccatccaccgccgcggc

SEQ ID NO: 710798 - DNA, 279 bp, Homo sapiens
  misc_feature (171)..(171): n is a, c, g, or t
aggctgacttagaggattcgtttcatccctcacagatctggcaacaggtctttcaaacctatttacctcgccttaaacagctcgatcaaggccctaaagaacttgaagactttatggctcagttgaaaagtacccgtctaggtctacgctttgaaatgttcatgtggtttnggttacgggatcatcactatcatgcttatgaattattgggtcatagtatccaaatcattgatggtgcacgtactacgggtgaactggactttttaattaaaaataccg

SEQ ID NO: 710799 - DNA, 269 bp, Homo sapiens
ataacgcaaaatgacttatggagacaaccactgacggggcaccaggaatggaaataccaaacctctggttatcaaatatgatgccacaacattatatattggcctttgttctggcacgcttctagcaatagaaaaaggtgtctttgaatttcatgattcacaaacattacaaatgctacaccatgacaaatattattgaaacctgtggactcatcatcctggatagagaagctgcttctttttagttgatgacacaaaaccttttttga

SEQ ID NO: 710800 - DNA, 151 bp, Homo sapiens
gaattgtgacgatcattagtgtatagggaaggttaatggttgatattgctagggtggcgcttccagactaggtgcctgagtaggtcgcctgtcgttaatgttagcggttaaacgtacggccagggctattggttgaatgagtaggctgatg

SEQ ID NO: 710801 - DNA, 167 bp, Homo sapiens
tgggtggagcagggttctcatttggtgcttcacctgccttgggctctttgccatcttgtgaaggagcgttaggaggacgcggcgacacccgtaattgtagggacgcccgtatccacggcgaacagacggctggtttggaccactggggggttgctgattttctttat

SEQ ID NO: 710802 - DNA, 205 bp, Homo sapiens
agatcctgagggggggtggctctggtgtaggccggcggctacagctccgattaaacccctagcctgggaacctccatatgctgtgggagcagcccaaagaaatagcaaaaagacaaaaagcaaacaaacaaaaacaacaacaacaaaaactcctagggtgcatccagtagaagattcgtcagaaaacacaatactgaggataacc

SEQ ID NO: 710803 - DNA, 113 bp, Homo sapiens
acggccgtgtattactgtgcgaaagaaaccctcgggcctaagaaggcatattgtggtggtgactgctatgataacgactactactactacggtatggacgtctggggccaagg

SEQ ID NO: 710804 - DNA, 382 bp, Homo sapiens
  misc_feature (371)..(371): n is a, c, g, or t
aaacctccttagaaggaagacccagttaaagttgtttcaaagggtcccatagagaagccttaaaagtatgaatttagggccgggtgtgaattgtcacgcctttgatcccagcactttgggaagtcaaggcgggcagatcacctgaggtcaggagttcgagaccagcctgaccaacatggtgaaatctcacactactgaaaatacaaaaattagttgggcacagtggcgcatgtctgtagtcccagctgctcgggaggctgaggcgggagaatcacttgaacctggaaggcgggggttgcagtgggctgagattgtgccattgcactccagcctgggcaacaagtgcaaaactccatctcaaaaaacaaaangcaaaaaaaaa

SEQ ID NO: 710805 - DNA, 266 bp, Homo sapiens
cgcaagaatgatgagaccaaaagcagactgtacatttacaaacccatataaaacaatatttatttacatcacctcccactagggcaatggcagctctaaaatctgtgtataggagggcttaggagctggaaaatttatcttgaagttatgcttcacataatcaacccaccagtttttcagctcatgttagcctcattcattcatcaatcagcaatccatttttatcagcattttatttggtactttcatgtacaagcattgcagca

SEQ ID NO: 710806 - DNA, 127 bp, Homo sapiens
ctgttctgccagcgcgacttatctccaactatgtagcaactgcccatgctgggtcggcgccctgggtccccggagagcaagtgcagccgtggatgccctgtatcactcggcttttccatccttggtg

SEQ ID NO: 710807 - DNA, 355 bp, Homo sapiens
  misc_feature (185)..(185): n is a, c, g, or t
  misc_feature (275)..(275): n is a, c, g, or t
  misc_feature (280)..(280): n is a, c, g, or t
  misc_feature (311)..(311): n is a, c, g, or t
  misc_feature (316)..(316): n is a, c, g, or t
  misc_feature (334)..(334): n is a, c, g, or t
  misc_feature (339)..(339): n is a, c, g, or t
agttgactctgcggaaggcgtggcggttacactgcgaattgcagcccagaaggtgatgcagagcctgctcacttaaatggaaagacgacagatggccagcttgacatcagcatctccctgaagactttctcgcaccatctcccctgcggaggctgacgttttttgttaacgacgcgaggcaatanaatccccaacccatggagtacggggccccaccactttacttctgtgccctaaacctttctttatcgcacgcagcccccaccatatccagnacggnttcgcctgcctatcgcaaagtaaacacatgncccgncctcccgctttgagttgntccgnaaaccccgcgcccatt

SEQ ID NO: 710808 - DNA, 189 bp, Homo sapiens
caggaaatgcgctgactccaaagctggccccggtgcaaattaaggttgaggaaaactttggctttgaaacaaatgaggccctggattccagttgggtttttcggggtccaaacaaaatgttgccctacccgaccctggccagcccagcctttgattgacgcatgcccaataaactggcccccccctcca

SEQ ID NO: 710809 - DNA, 247 bp, Homo sapiens
gggggtcgtctcttcggggctggtttggtttactctggtccttctgggtctctttggtttctttttctctgtttgctctcctgttcttggtgctcgtctctgggctccggttgcttgttctatctgtctgtttctcattctctagctccctcagtttctggttgggtctcctggtgtctcgccctctcccatttctttctctggtgtcctctctctttgtcttggtttctggctccccctttctctg

SEQ ID NO: 710810 - DNA, 119 bp, Homo sapiens
acaagggggcaagagcccaggctgtagctctgggccctcgatcagcccccatcatgggaataaactaattttcgcaatgtaaaataaaacaaaaaaaacaaaaataccgcctgcggccg

SEQ ID NO: 710811 - DNA, 419 bp, Homo sapiens
ctaagtggaacttcttttgaggttaatgtttatatacaattactttaacattggatttgggaaatggaacaacatactgcggatctttctgctaccgatgaaagaagaaggttgagttttaccttctagagctttacagtgtaaacaagcagtattagggtttgtttttaccttctcccctttggcccggtcacagaagcactggcctttgtctttacagacacaaccctaggaagagggaaagagaaagggttttgtttagaaacagctgaataaatcccaaccggcagggtaaaagcaaatgcatttctctgttcttcgagtattggacactatctgttaggagccaggtgaccttgtagcaatatatcaatagaaatatatcaatatatgaatagcaataaagtagaaaactgaga

SEQ ID NO: 710812 - DNA, 1207 bp, Homo sapiens
ggagagagagagagaatcctctccgagtttttattttttctatttctgtattttcatgtaaacggcaaatttttccccatgttggccaggatgttctcgatctcctgaccttgtgatccgcccacctcggcctcccaaagtgctgggattacgggtgtgaggctaccgcaccctgccaatataacactattcttaagctcaggggctatgcaaagcctataggctgacccctgatccagaactgtcttctgagacaagcatttctgtgagctgccccatgtgcatacactgcagttgtgcagtacgctagatagtggtataatggcctatcccatctaactgcattgtcagaccaaaactgactgcacagtgaccatgtgtggagggcgcggctcgcatatgccaaccataactcttcaatagagtgtccttacatgaagctcatctcatactctctcatatactgactacctcagtgtagaaaccctcatattattatcccccagaacactatcccttgtcaacccaattgttcgccctctgattatcccctggagttggggaatacaacttgcaagcgcagcagcaatttcttagagtactccacaaactaatatgttgtccccagtcaatttctcccctaaattatacttgaggtaagcgacgatctccccagccattttgttacaccctttatacgtcgcctcatacactactactccaagcagtaaaaagcggctagacgcttggaacaagtctcttgaggcgagcgccccgagtagccccaatgggggatttcccccagtactacaggaccttagagatcaattctcctctgtaggagggaaaatacacagccaacatgtaacccccaagacggagcatggtcatatctgaaacacgccgcttcgcaacgttactcgcagttgttatacacccaggttgtcaccaataatatgttgcaccgcgcttgtggtacccgcagtgggctcacataagaaacggtatgccacctttcctgcatatacgccgacaaacacactcagattgtaggtgtgcgtggcaacggaaatatctctgggcggccgcagcagaggttatatacgccggtgcgttattatggacccccttgtaggcgcccccgtgagcaagtggactctctggtatggaagctaggcgcataggcacacaacagcagggccgacga

SEQ ID NO: 710813 - DNA, 833 bp, Homo sapiens
ttgttgatcagtctaggtgcagctgcgaatccttcagcgtctgatctcgggtcgcccggtaccgtcgcccgttctccgcgctctccggggggtcgggcattggtccacagtctggtcgtgttcaccttcccctgactgagtagtcgcatggcacagggtctcagaggcatgtgatggattccctgattggatgaggggtggatgaaaacttcttcgaaggctatgaaggctgggcacagatgaggagagcatctgattcttgtggaatccggaagtaatggtcaggcaggaaattctttggaggtttaaagaactctgtgggcgcaggatctttgtggaatgaccttgaattcagattaagtgggaaaattttggaacaattcatgggtgggtctgatgaacccttctgcgggttaatagatggtaatgaatgaacacttgctttgaagggaggtggcaacacttggacatgtccttgacagaattatgggtcaaggacacctgaagaagtgagagcatcaaacaggttatgacgcagaatatgggtcaacgctgacagatgacgttgtggcgaccccttccggtactaccaggggatgtgggggtccttcaggtaacaagaaaccctgattgtggattggtgaacgtccaagtttgacaagatggcccaggttaattcagggtggaagctaaatggcgcacggctcaacaaattttcaccctttgggaacacgagggttcccttggacacgtctgtgccggacatctatccggtactggcacactgcccgagttggtaacacacccttgggacaacgaacgcctgagcgcta

SEQ ID NO: 710814 - DNA, 940 bp, Homo sapiens
gagacgcggctgtgagaagccatgagccagcaatagtctctcgccgacaccctgtacgaggcggtgcgggtaagctcctggagggagaagcagtcgtcgagctgcacggcaagagtatcgctggaagacgagtgagtatgttgacaagatctagtcgttgacagaatctagtgaatcccactagcataggtacaagtcggcattcatcgaggccacgcgtcagggcattgaatgtcgcgagctcgcgccgcccacgtaatggttactcctgatgatgtgttccatgagaggtgacctagacagcaatcgtgtgacggaggtctaatggccgtctggtattatcgcccctgctatggcagatcggagggcgcctgcacagaaaactcaagactagcaagtacacatacacacctggtgtgcaacgtaacgactgcggccataggaagctatgactgccgctgttttcgggcctcagcagtctctgagtccaatggcagatttccaacgcaaattgcatcgtgtccacggttctagtagtgaacgcggcatggagaaaggtgtccacgttaccactggctccagcagctacaaagcggagaaaagccatgggtgggctcatagggttggatgaggtgaaagtccacgcaatcagagttgtccataattgaacgaaagggtgtttcactgttctgggtctgctatgactggtttgtggtcacggtgaaagattgaagcagaacgaatgagggctatgatgtaataatgatttaacggtggcgcatgttcaatcgtatcctggggtgtcacatatgcgttcaaggcaaaaaagttggggaggaaattgttccgggggggcttagtattagtgctaggaggcaacccaatcgggggcacaaggccccccaggctggccttatcattcacaggggaccatttggcg

SEQ ID NO: 710815 - DNA, 117 bp, Homo sapiens
taagctggtacggtgttatgatgcacggtggtggcatgcgcagacagacttcgctcgtactcgtgcgctcgcttcgcttttctccgcaaccatgttgacaaacccgatattgctgag

SEQ ID NO: 710816 - DNA, 286 bp, Homo sapiens
  misc_feature (14)..(14): n is a, c, g, or t
  misc_feature (82)..(82): n is a, c, g, or t
  misc_feature (95)..(95): n is a, c, g, or t
  misc_feature (113)..(113): n is a, c, g, or t
  misc_feature (116)..(116): n is a, c, g, or t
  misc_feature (126)..(126): n is a, c, g, or t
  misc_feature (128)..(128): n is a, c, g, or t
  misc_feature (139)..(139): n is a, c, g, or t
  misc_feature (141)..(141): n is a, c, g, or t
  misc_feature (146)..(146): n is a, c, g, or t
  misc_feature (153)..(153): n is a, c, g, or t
  misc_feature (155)..(155): n is a, c, g, or t
  misc_feature (164)..(164): n is a, c, g, or t
  misc_feature (166)..(166): n is a, c, g, or t
  misc_feature (169)..(169): n is a, c, g, or t
  misc_feature (171)..(171): n is a, c, g, or t
  misc_feature (173)..(173): n is a, c, g, or t
  misc_feature (179)..(179): n is a, c, g, or t
  misc_feature (181)..(181): n is a, c, g, or t
  misc_feature (186)..(186): n is a, c, g, or t
  misc_feature (190)..(190): n is a, c, g, or t
  misc_feature (195)..(195): n is a, c, g, or t
  misc_feature (200)..(200): n is a, c, g, or t
  misc_feature (206)..(206): n is a, c, g, or t
  misc_feature (213)..(213): n is a, c, g, or t
  misc_feature (224)..(225): n is a, c, g, or t
  misc_feature (227)..(227): n is a, c, g, or t
  misc_feature (239)..(239): n is a, c, g, or t
  misc_feature (245)..(245): n is a, c, g, or t
  misc_feature (270)..(270): n is a, c, g, or t
  misc_feature (284)..(284): n is a, c, g, or t
ctaattttcacaanccatcccataacacacaatctaatttttataagtacttgctttgcaaattcagcttcaagataaatcnccctccccctgcnccacaaccccatataganatnttgaattgtntntggggggagananggggnggggaangngccagagcngnggnangngcgagngngatgngtcnttaanaactnacaggnaaatgcnaaaaaatagtnnanaacaataatacngggganacacacagcttataaaaagggtcanggatctacaaatgngg

SEQ ID NO: 710817 - DNA, 265 bp, Homo sapiens
  misc_feature (149)..(149): n is a, c, g, or t
gtcttgactgatgattcataacattagcttgaggaacttcctcctatttccagtctttgggagtcaagcttctcacctggggcgggtgggttctgcaccaccctcccacccgccttcctccgtagtggacgatagtagccacatccagncaccacggcacagctcccgggtcgccttcatctcctcgctcctccagggcagcacaaggccacttgtggaatctccaccagggtgtacaggaacggtgcctctagcgtcctgccac

SEQ ID NO: 710818 - DNA, 422 bp, Homo sapiens
catggccacatccaacatttcctcaggcaattccttttgattcttttttcttccccctccatgtagaagagggacagtataggctatgaaagctgcttctgggggatttcaagggactgggggtgccaaccacttctggccctgttgtgggggtgtcacagaggcagtgccagcaacaaaggatatgctacttcgtgtgctcgggaaacaaaaggcaggggatgtcaaccccgtgtcagtgggctttggttggggtggggcgggaggccacgggggagcccgaggcaggggctggccagagggcagaggaagcacaagaagtggcagtgggagagggagccacgtgatgaagagtagacatccccctccttgccgctgggagagccaaggcatatgccacatgcagagtaagagcggccgct

SEQ ID NO: 710819 - DNA, 141 bp, Homo sapiens
gctcaccgacgagttgtccgagttaggacgagcgaactttaacgaaagaataagtgtgcggctcaacaagctttaaaccaacgaaaggctacgaccgggttggggaggaagcattgactgagagaagagggtgatattgaa

SEQ ID NO: 710820 - DNA, 362 bp, Homo sapiens
cccatttggataaaaacttgtacaaacctccagctcactcagataaaggaacaagaacgacctagcacagaaatgcctttgtttggccagccacggtggatcatgcctgtaattccaacaatgtcggaggcagctgtgggcggatcatctgaggtcgggagtttgagaccagcatgaccaagatggacaaaccctgtctttactaaaaatacaaaactagccaggcatggtgctgcatgcctataatcccagctacttgggaggctgaggcaggagaatcgctagaacccaggaggtggaggttgctgtgagccgagatcgcaccattgcactccaggctgggcaacaagagcaaaactgca

SEQ ID NO: 710821 - DNA, 575 bp, Homo sapiens
  misc_feature (330)..(330): n is a, c, g, or t
gaaaaatgaacggagctggtactcatgtcaaaaaagtgaaggagacttagggggaataactagattagctcataaaggctaggatccattcagaaaactgggaaccatagccatggaccatacaactgcaatatcaaactgagctgcacatagtggtacacacctgtggtccgagctactcaggaggctaaggataacctaagccgacgagttgtaggctacagtgcccaatgagtgaatgtatcactgcactacagcctgggtgatagagggagaccctgactctaaaaaaataatgaggctgggccctgtggctcgcgcctgtaatcncagcacgggacgccgaggtgggtggatcacagggtcaggagttctagaccagcttggccaacaaggtaaaacccagtctctactaaaaatacaaaaattagccgggtgtggtggtgcacgcctgtaatcccagctactgagggggctgagacaggagaatcacttgaactcgggaggtggaggttgcagagagccaaggccatgccactgcactccagcctgggtgacagagcaagactcgtctc

SEQ ID NO: 710822 - DNA, 111 bp, Homo sapiens
agcagttaatacagactcagtctaaacaaacaaaacttgcttcagcgagcaaacattagcaggtttgccccacattttgagaaattggtatgagtctgtattaactgcttg

SEQ ID NO: 710823 - DNA, 1880 bp, Homo sapiens
  misc_feature (15)..(15): n is a, c, g, or t
  misc_feature (19)..(20): n is a, c, g, or t
cctcgaagtaacgtnagcnngtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcaggttggcaaataaacaagataaagaaggagctttaggagaagctgatgtcattgaatgtctatctctggaaaaaattggtccatgagcacaagtgcctgtgtcagatagaaccatgttcagcaatctcggggtatggaaagaaaattgacaagtccattaaaaaaggcctttattggctgctacatgtttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttacaaaaataaaagaagcacaatgaccagtacatgaaatcagcatttggaccaaattagcaagatttactgttgactctgggtttatacatccccactcatgagcatacttctgaaggaaaacttacaaaaagagccatggactcagcacttttctttactatttgttcataggctatattctcgatttcaatcttttccgccagaatttgcccttgaaaggggcctcgcgtttacccaattccaacctcttctcttgctcacctcaacattttcccggcttggttcacccttctgacatctgttcacctctctggaaacggtctccccgacgtcaaggaatcatgcggattgacacgcacagcgcgcgcgcctaaattagcggacgctttcactagagcagcaacagccgctacaaagaacgacgaacatga

SEQ ID NO: 710824 - DNA, 350 bp, Homo sapiens
caacagcctgtaccttttgctcggcactactgaagtataagccagagacatctgaacatcacgcattacttatcgtacctcatggcaaagatgattataaccttgcgtgatctaggcaggactcacccctacacaccttgcttagggcatatgctaaacataactttttactgtaagccgaagcttatactcccgaacctcaacgagctacctatgatcagctagtagagctcacccgattatctagctcaggttgtccaagatatagtctgagtacatctcttaatgtgcccacagagacctctatataccctgggcttaactgatagcacgaagaggcatctctttgg

SEQ ID NO: 710825 - DNA, 2202 bp, Homo sapiens
  misc_feature (15)..(15): n is a, c, g, or t
  misc_feature (19)..(20): n is a, c, g, or t
cctcgaagtaacgtnagcnngtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttggttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaaattggtccatgagcacaagtgcctgtgtcagatagaaccatgttcagcaatctcggggtatggaaagaaaattgacaagtccattaaaaaaggcctttattggctgctacatgtttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttacaaaaataaaagaagcacaatgaccagtacatgaaatcagcatttggaccaaattagcaagatttactgttgactctgggtttatacatccccactcatgagcatacttctgaaggaaaacttacaaaaagagccatggactcagcacttttctttactatttgttcataggctatattctcgatttcaatcttttccgccagaatttgcccttgaaaggggcctcgcgtttacccaattccaacctcttctcttgctcacctcaacattttcccggcttggttcacccttctgacatctgttcacctctctggaaacggtctccccgacgtcaaggaatcatgcggattgacacgcacagcgcgcgcgcctaaattagcggacgctttcactagagcagcaacagccgctacaaagaacgacgaacatga

SEQ ID NO: 710826 - DNA, 388 bp, Homo sapiens
  misc_feature (178)..(178): n is a, c, g, or t
gtgtattcaccactgcggtgcatgcctccctgttcgagatccgtcgacacgtgagcaccgcgctgacctccaaatattgttaagctggagcctgctggactcttgtggatgatcctgtaccccaccatgcttgcttgcttgctggtcgacgagtattaaccactgctgcgcatgcctncctggacaagatgcgtcgacacctgagcaccgcgctgacctcctaaaaatagctgatctggagcctgggcgacgtgtatttaccactgctgtgcaggcctctctgtgcaagtttcgtcgacacgtgagcaccgcgctgacctccaaatatatttaagctggagcctgggcgactctataggatactccactaccccagcatgcatgcatg

SEQ ID NO: 710827 - DNA, 157 bp, Homo sapiens
atgccgtgcttgaccgcctcgtgcaggtccaccaggaagatcgacatgccctcggacttgcgcgtgacctggtccagcggcgtggtgcgcgccagcaggatcatcaggtcggagtgctgcacccgcgagatccagaccttctggccattgatgacgt

SEQ ID NO: 710828 - DNA, 707 bp, Homo sapiens
  misc_feature (307)..(307): n is a, c, g, or t
aaaaccaacgcttgtttaaaaacctacttattcgccccttatgaaagggaaaaggttttttcaaggggaattccaagaagaaaagtagaaaagtgaagaggagggttccaagtgggctttccctgggtccaagtaggggctcaagaaacctgtgaaactccctcatttcctgcatgcggactacttttggtcctggatgaataatattaaggatatgtgcttaaaacattcctaacatcagaattggcgcctgtgttttcttccccaaaaaagctataaacagcgaaaattttgttgtaagcttccntgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagcctacagcttttt

SEQ ID NO: 710829 - DNA, 2257 bp, Homo sapiens
  misc_feature (15)..(15): n is a, c, g, or t
  misc_feature (19)..(20): n is a, c, g, or t
cctcgaagtaacgtnagcnngtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggagtccatggaaaaattgtcttctgcaaaactggtccctggtgctgctgatctaaaggaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttggttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaaattggtccatgagcacaagtgcctgtgtcagatagaaccatgttcagcaatctcggggtatggaaagaaaattgacaagtccattaaaaaaggcctttattggctgctacatgtttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttacaaaaataaaagaagcacaatgaccagtacatgaaatcagcatttggaccaaattagcaagatttactgttgactctgggtttatacatccccactcatgagcatacttctgaaggaaaacttacaaaaagagccatggactcagcacttttctttactatttgttcataggctatattctcgatttcaatcttttccgccagaatttgcccttgaaaggggcctcgcgtttacccaattccaacctcttctcttgctcacctcaacattttcccggcttggttcacccttctgacatctgttcacctctctggaaacggtctccccgacgtcaaggaatcatgcggattgacacgcacagcgcgcgcgcctaaattagcggacgctttcactagagcagcaacagccgctacaaagaacgacgaacatga

SEQ ID NO: 710830 - DNA, 277 bp, Homo sapiens
gaacgcttcaaacaacggaggagtctggatagaaagaacccacgggagaaatacactagtcactgtaaagtaacagaagtggttccgatgtcactgcagtgcacaggcagggaggggagcgtgtccccagtgagagaccggagtggaagcgaggtccaggcttacatgcggggactttccagacagttcagatttattccaagagctgcaagaggctagctagaaaggttaaaggcaaataggtggtattggctgggcacggtgcgttggcccaacg

SEQ ID NO: 710831 - DNA, 757 bp, Homo sapiens
  misc_feature (15)..(15): n is a, c, g, or t
  misc_feature (19)..(20): n is a, c, g, or t
  misc_feature (489)..(489): n is a, c, g, or t
  misc_feature (503)..(503): n is a, c, g, or t
  misc_feature (509)..(509): n is a, c, g, or t
cctcgaagtaacgtnagcnngtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcaggtaggctggagccagctgtcctggccgtcctaggggttggagatggctgcgccccagggcgaggcgccgccttttccccgcgcctggacgagtctatcccaggccgcaagggatgctttcattcccaggntgtcccgggagggngagatnggaggatgtagccttgttgtctggtcgactttctgttgcgattgacaatgcttaccgttgttatattttaaataggtttgaatttgttaaaaagtgtgtgtgtgtgtgtgtgtgtgtgtgtgtgtggaattgcaaaactatccagtgtgtgttacctctgaagcttgtgtagtggacacttcttttaacaagagggggacatggaatatagtttacataatatccgatattccattcaagatacactc

SEQ ID NO: 710832 - DNA, 180 bp, Homo sapiens
tgagatcatgccattgcacttcagcctgggtaacaagagcaaaactccgtctcaaaaaaaaaaggagagagaaaattaaaagaaagaaatgggcctcttgagtccacaggtctttgaaatctgggatcatctgggatgtacccctggttcaaagtggttacccatcctgtaaaagggccc

SEQ ID NO: 710833 - DNA, 486 bp, Homo sapiens
ccatatattcagaacaaggcaggatataaataaatataattaattcatcttataaaatcatcttgaaatattaagtcctcataatttgggctacaggtctcattgtcccaaatatgcatctctgtgagtacaggttaaattcactcaactaataaataagttctaagggcccaccatgtgtcagtcactgttctcaacactggggaaatacctatgaagagaacgccaatcagagataagtacaatggagaacagtaaagcagagaagactagggatgccatgtagtgaggttacaattttaaataagatggtcaaagagggcctcactgaggtcacataacctgaagggcctaaagaagatgagagattaaaccagatagatatctaaggcaagggtattccaggcacagggaatatcaagtacaaaggtcctgaggcagaaggaagcttggcatttctaaggatcagctaagagatctgggctg

SEQ ID NO: 710834 - DNA, 264 bp, Homo sapiens
  misc_feature (215)..(215): n is a, c, g, or t
cctcccgggttcaagcgattctcctacctcagcctcctgagtagctgggattacaggtactcgccaccacacccggccaattttggtatttttagtagagacggggtgtcaccatgttggccaggctggtctcgaactcctgacctcaggcgatccgcctgccttggcctcccaagtgctgggattacaggcgtgcaccactgcgcccagcccanaaagcccagtttttagaccaacactcccatttctgactcaagggtctgg

SEQ ID NO: 710835 - DNA, 776 bp, Homo sapiens
  misc_feature (48)..(48): n is a, c, g, or t
  misc_feature (113)..(113): n is a, c, g, or t
  misc_feature (119)..(119): n is a, c, g, or t
  misc_feature (162)..(162): n is a, c, g, or t
  misc_feature (204)..(204): n is a, c, g, or t
  misc_feature (232)..(232): n is a, c, g, or t
  misc_feature (238)..(238): n is a, c, g, or t
  misc_feature (246)..(246): n is a, c, g, or t
  misc_feature (248)..(248): n is a, c, g, or t
  misc_feature (255)..(259): n is a, c, g, or t
  misc_feature (262)..(262): n is a, c, g, or t
  misc_feature (338)..(338): n is a, c, g, or t
  misc_feature (376)..(376): n is a, c, g, or t
  misc_feature (399)..(400): n is a, c, g, or t
  misc_feature (402)..(403): n is a, c, g, or t
  misc_feature (405)..(407): n is a, c, g, or t
  misc_feature (445)..(446): n is a, c, g, or t
  misc_feature (449)..(449): n is a, c, g, or t
  misc_feature (482)..(482): n is a, c, g, or t
  misc_feature (484)..(485): n is a, c, g, or t
  misc_feature (492)..(492): n is a, c, g, or t
  misc_feature (500)..(500): n is a, c, g, or t
  misc_feature (508)..(508): n is a, c, g, or t
  misc_feature (525)..(525): n is a, c, g, or t
  misc_feature (541)..(541): n is a, c, g, or t
  misc_feature (566)..(566): n is a, c, g, or t
  misc_feature (570)..(571): n is a, c, g, or t
  misc_feature (576)..(576): n is a, c, g, or t
  misc_feature (578)..(578): n is a, c, g, or t
  misc_feature (627)..(627): n is a, c, g, or t
  misc_feature (629)..(629): n is a, c, g, or t
  misc_feature (657)..(657): n is a, c, g, or t
  misc_feature (773)..(773): n is a, c, g, or t
aaagagctaaaagtggtatcatgattccacagacagtgattgtaaganagtgagccacagggtaatgggaaaacgtgaaaagaaacaaaaatcaggaccaaattagagaaganatgagnagggccatcactagaggtgaaaatggagaaacctaagaaaaanagtgttggcatgaattatgcaagtggaaaatacatctgtagngggacgagatagaaggacctagatctanctccangtgcttgntnggcgccnnnnnggnggtagagaatttatagaattaactgtatagaagcctaaaaaataagattatcagcctagtcatgtaaagtctagangttcctttatttgctcatcacctttcctttttctatangactattaagcagaaggtcagtnncnnannntttaccctttcctctcctctcttggtttatattttatnnggnttctgatgaggctatggttcagttggcattgcngnnggtggtncttattgnagcaaggntgacaataggtcttgtnattctgctccctgaanatgccctttgacaactgtgtggggngggnngcacncncaaagtgctgagggtggggcttgtaccccatagcactgatacaacggcnantgatgggctgcccacacccatggcagancgttccccggcggtgatggtaatggagctcacagaatggacgtccatccagttcaaagaaggagccagtagaaaaactggtgaagcagtccccacaaacaaagcactctgggtgcngag

SEQ ID NO: 710836 - DNA, 197 bp, Homo sapiens
aggccgtgtagtgcgccatgctaattcatagaagtaaatcagagtggcgtacctcgggtcacgcaggaaggagccaggagcttctggaggtagactccagatccttctccctctctcaccaagctcttgagttttcccaattatctttttgggcggaagcaggtttttatcaaaactttctcaactgacaacggcct

SEQ ID NO: 710837 - DNA, 119 bp, Homo sapiens
  misc_feature (93)..(93): n is a, c, g, or t
ctcctggccgctcgtcccccgccgcagtgccatggctgcccgggcgcccgaccttggccgtggacaccttgcggtgcgtgctgctcctccccntctgccactggaagatgctggggcga

SEQ ID NO: 710838 - DNA, 156 bp, Homo sapiens
atagaggatcccgaatatagctagtctcaggcaagtcacttaacatttttgagtttcatatttctaccatatctagtaaaatagaatcgactaggatcagtagtattgtaggataataacctaatgtagagatatagtagtgtgcatatattacct

SEQ ID NO: 710839 - DNA, 152 bp, Homo sapiens
cacctcacaagcctcagagtactacgagtctcacttcaccatttcctgactggcatctacgagatcaacatttattagtagccacaggcttccacggacttcactgtcattattggctcaactttcctcactatctgcttcatccgccacaa

SEQ ID NO: 710840 - DNA, 601 bp, Homo sapiens
  misc_feature (343)..(343): n is a, c, g, or t
  misc_feature (539)..(539): n is a, c, g, or t
  misc_feature (550)..(550): n is a, c, g, or t
  misc_feature (564)..(564): n is a, c, g, or t
tttagcgagctgctctgcatatttgttgctgcaccacttcttgaaagcctgatatccttttatttttgttatcacaaagcatttattaaccattcatatgaatgtaaagctgagtcatctcaaaatatatctcagtgtagtcatagttgacactctaataactttagtatgaaaagatcatataaaattatgtaagatgccacttaattgaatttacttttcttaatttatccttgaatgacatggaatattttttctatatttttccctacattaaactaaatgtaaacatataaattgccccattttgtttaatctctaaagttagtgaaaacattacatnggcatttttggttaataaaattgaaaagaaatttagtagtcattgtctagactacctatctgtgtgaaacttctttgaccatatccctgatacttgactaataaatcagcctctgcttgagaagccttagggactggggcttcagatacttatgacagtctatacttatcttaactctgcctttctgtgaccgacntcatggctctngtacgtttcacttngggcttactaggcactacctacgctggaatggaattg

SEQ ID NO: 710841 - DNA, 458 bp, Homo sapiens
agtatagcactgaccactgcgcggaacacgtctagtgtatagattggcctctgtgtagacgatgaatgcctggccagtgctgtgactggccgtgtctaggctccgagttgcaaactgccgtttcagatttgcgggaacatctcgctgtatttgcttgggtaatcagatgcgaggtagcccttcagctgctccaggttgctggctgtcaaaaagccatcttcaaggtcaaaagtgtaggtcagcagcagactcaccctgcagagcaaaccatcggatcgaccttcactgatcagaacggcagctgtcaccaaagcctcccgtcagcctcctcttatttcttcaaagcagttttcataattgacggtggccttaaagccctagaatggagcaggtgaccaatgctggcaaatattgggggtgaaagctgttgatgagggacacgaatatagcgtgctcct

SEQ ID NO: 710842 - DNA, 132 bp, Homo sapiens
gggtccagtaagagatggagatgtcattgcctgaagatgaaggacatactaggacactgacacagcaaaagaaatggagattacagaagtagagccaccacggcgtttggactccagtactcaagacaggct

SEQ ID NO: 710843 - DNA, 299 bp, Homo sapiens
tggtcgacctagagatccccctccatcacagaacaggaactagttggctctgccatatactgcatgtacaggttcttttttttgattaacatgtcatagtcaggaaagaaatgaatacactgcgaaacaaggaacaggaacctcaaattttccaaaggtattcggggatagggggttatagaaagatttccaaagcagcgtgacagacaccctgtgaaaaccacctcaaagtttgccccctctcgtggcatgaagacccaatgccgtgcccacccccgacaaaagacaaatcaatcctc

SEQ ID NO: 710844 - DNA, 148 bp, Homo sapiens
  misc_feature (91)..(92): n is a, c, g, or t
ggcagccaagatggagccggcagtcggcgttccgggcccactgatcgtgaacaacaaacagccccagcccccgacacctaacacgcctgcnngccgcactgtcaccacccggggcaccgcgttccgccgcgggcctcctgcctggggg

SEQ ID NO: 710845 - DNA, 85 bp, Homo sapiens
cgaattcggcacgagtttctttatcttccctccctcacttcccttttctcccaccctctttccaagctgttcgcttgcaatatat

SEQ ID NO: 710846 - DNA, 155 bp, Homo sapiens
gcgcggctggaggtgtgaggatccgaaacccaggggtggggggtggaggcggctcctccgatcgaagaggactttgactaccggccgcacgccaatgagggccctctgggtcctgggcctcttctgcgtcctgctgaccttcgggtcggtcaaag

SEQ ID NO: 710847 - DNA, 1110 bp, Homo sapiens
  misc_feature (7)..(7): n is a, c, g, or t
  misc_feature (34)..(34): n is a, c, g, or t
  misc_feature (593)..(593): n is a, c, g, or t
aggaagnccctatttttccaagcacgaagccacnagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaacgttcccagaattcagtttccaaaatctctttttaaagggtttacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaaacaaaaaancaaaaaaaaacccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgtaaaaaa

SEQ ID NO: 710848 - DNA, 1121 bp, Homo sapiens
  misc_feature (604)..(604): n is a, c, g, or t
ctgaactgaaccctgaagatcaaacaggaattcagtggtgagaggttaaaagctgggcattctagatgaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaacgttcccagaattcagtttccaaaatctctttttaaagggtttacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaaacaaaaaancaaaaaaaaacccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgtaaaaaa

SEQ ID NO: 710849 - DNA, 151 bp, Homo sapiens
gtactgtggtgtaccgtgaatagttttcaacgatatgtaatcattcttggtctggctgtacaggacaggtcgaggccatgtctgcctggggcacagctggctaccctgttgtagacgtgtgggtggtgttttaccatcaatccatagatgt

SEQ ID NO: 710850 - DNA, 1014 bp, Homo sapiens
  misc_feature (7)..(7): n is a, c, g, or t
  misc_feature (34)..(34): n is a, c, g, or t
  misc_feature (593)..(593): n is a, c, g, or t
aggaagnccctatttttccaagcacgaagccacnagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaacgttcccagaattcagtttccaaaatctctttttaaagggtttacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaaacaaaaaancaaaaaaaaacccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacacaactaaaacaagaattttttttttctttttttgagatggagtctcactttgtcacccagg

SEQ ID NO: 710851 - DNA, 801 bp, Homo sapiens
  misc_feature (12)..(12): n is a, c, g, or t
  misc_feature (66)..(66): n is a, c, g, or t
  misc_feature (84)..(88): n is a, c, g, or t
  misc_feature (96)..(96): n is a, c, g, or t
  misc_feature (125)..(125): n is a, c, g, or t
  misc_feature (127)..(127): n is a, c, g, or t
  misc_feature (187)..(187): n is a, c, g, or t
  misc_feature (204)..(204): n is a, c, g, or t
  misc_feature (226)..(226): n is a, c, g, or t
  misc_feature (351)..(351): n is a, c, g, or t
  misc_feature (364)..(364): n is a, c, g, or t
  misc_feature (386)..(386): n is a, c, g, or t
  misc_feature (699)..(699): n is a, c, g, or t
  misc_feature (705)..(705): n is a, c, g, or t
agtacagagggnattggttaagtgtcccaggaaccacacaagcagtgactcctaaagaagttcccnggaaggagagaacccatnnnnngggggtgnagtgggggtgggtcagggtgggctccctngnggggagaatggtctaggcaaggatgcagactggccagttaggtgggtccatgcaggaagntgagggaggtggaaggnccgtgggtttcgagcgcatttncccgccctagttggggaagagcaggaagccggagaagacgctgttagagccctggatgcccaccatgtcgtagtagttattgacagccagccacacctcctcgcccacctgcaacctcagcagcncaccgcccgagtngacctgattggttttggacgtntggccacagaaggtgaccactttgacgccgctgcggtacaggagctggtacaggttggctgtttgcgacgcgtggtagacaaagtagtagagggcggggattttgcaggtgaacttgccagtgctcgtgtgataatctccctgggggttggtgaggaccgcgttgaatctgatcaggctgttgggtgcagggggctggtgggtctgccgagtgaccgtgtacactgactggaatttctgcttgtatctgccctcctcacctggctctccagggatgcccatgggccagggcaccactgcatcacagggggtcncatggnccatttttcacggatgccgggtaagccagggttctcccttctgccatttggtcatgatcaccgggaatggctgggattccgtacgtcccacccggt

SEQ ID NO: 710852 - DNA, 117 bp, Homo sapiens
caagtttcctctgcgtcttttttttctatagacggtttgtcattcgatgctccgaaacgggtaaactgatttccgagatttaaagacaattcgattaaaaaaaaattcggataggtt

SEQ ID NO: 710853 - DNA, 576 bp, Homo sapiens
  misc_feature (545)..(545): n is a, c, g, or t
cgtctccgcgaccgcccggccctcgggcggagggggccccgggctccaaagtgggggggaccgggcgcgagtgggcaggttggcccgagggcgggtgcaggctgggagcggggggccgggcgcggcccggggagtgtgacccggccagcgaccaaaacctggggtgacggagctgaagagcagggcatccagattctcctcagaagtgagattttccaagggaccatggattcggtgtccggcgccctttctttttttcctactcggtagttatgtctcgatcccggcaggcaaggccttccaaattagtcgggagggaagatgtaaacaaaaaacagaaaaacagccaattacgaaagagaagcaggggagccaacaaaattgtggcttcagtcaagactttaggcccgggaaaattaaggcatttaattcaggaaggagatgtcaagaaaaaaacagaacctaaaccaccggtgccagtcagaagccttctgacaagagcgggagcagcacgcttgattggggataggacggaggttcttttncagaacccagagtccttaagcggcaatgggt

SEQ ID NO: 710854 - DNA, 545 bp, Homo sapiens
  misc_feature (525)..(525): n is a, c, g, or t
  misc_feature (545)..(545): n is a, c, g, or t
ctgggtcacattgcgaaatgaagtctcgctcggacagccgggctggagtgcacaggcgcaacctcagctcactgcaacctgcacctgctgggatcaagtgattctgctgcctcagcctccggagtagctaggactactggcatgtgccatcacacccagctaaggtttgaatttttagtagagacagttttcaccatgttggccaggctgggactaaactcctgacctcaggtgagtctccctgctaggcctaccaaagtgctgggactacaggcatgagccaccagggacagccgtgtcctaacttttgttgcttggctcatacagccctgctctgatctccacccatatcagtctctatgcccatcctccccatacggacacccgagaggatgggcatttgtttctgcacactcatacaatactctgaagacatgggtgagtgcaaacagagtcatacaaagattttgccattgtatgatctatacaagtggcaatgtattatgcatacttcaatattggtcntctcacttaattatacttan

SEQ ID NO: 710855 - DNA, 828 bp, Homo sapiens
  misc_feature (429)..(429): n is a, c, g, or t
agcggagtgtaatcttgaagcaaggtgcttgtctgagtatctgaggacagagtggaattttccagaccttcttgaactggaccagtggatgcctgtgtggtttcgaatcaaatctgctcatgcttatgaatcttgctggtatagaagccctgccattcactactgtagggatgatccccatgtggagaaactgacgaaagccttttttctggagtggagctggaagttactcctaactatctcagtgttaaagcagcaggggatgaggagaaattcttgaaaatgctgtcacatcaaaaccaacttcttatagaatgccacagtgaagagtggacttctcaggacaacccacttactatagatgctcagattctgaaacaattttgaaatacttcaatactctaaattacaggcgggaatcattatttngttcaatacctgctgacaagaagtaaaagcactttttttttttttttggagacccagtctcactctccaactcaggcaggagtgcaggggcattatctcagctcaatggcaacatctggcctccggggttcaagccattctccggcctcagcctacggattagcggggattacaagcttgtgccaccatgcccgggctaaattgggattcagtggagaactgggtttcacccatgtgggccaggcgtggtctcaagactccggacctcgggttgatccacccaattcccaaagtgcggggatatacagggcggggagacaccatgcctgggaaaaggcctttacacacgtgtgtcacatactagcaagaaaagggaacccaactgtagaagtgtccctg

SEQ ID NO: 710856 - DNA, 150 bp, Homo sapiens
  misc_feature (75)..(75): n is a, c, g, or t
  misc_feature (102)..(102): n is a, c, g, or t
  misc_feature (113)..(113): n is a, c, g, or t
catcccaggcccccccctccgaggatgaaaaaatggctgcctgcagcttccccggaatccctccctcactgccanagcagcattttttttgtgtaccccctntgctgtttcanatgcccccagcaaataaacccttttttcgttggtcag

SEQ ID NO: 710857 - DNA, 513 bp, Homo sapiens
  misc_feature (513)..(513): n is a, c, g, or t
atacaaaagggggcatagtttctaaagcccagagctgtagagctgtggcttgagcctggattaaaagcaatcgagatctttacacagtaagagggtctgaggctgacaaacagctaataagaagcaggtgccggagccagccaccttgcatggtcacttggtgagttgactgtataacccgcataaaacgacgttggccaacagggctggataacacgggtgctggggaactccattgaatgacgagcacaaggtggtgttatttccacatttgaagaaccggctctgggcattcattcctcatttaagcgggaagatgaccgaccatttgacatatgtggccaaagaaggggcaaaaggctgtgcagaccagtataaatgtgctcagcgagcctatcaccttggcaaaggtccaccccctggtgaagacaagacttaccggtgtcgctgctggatctggagcttcagaacagtttagaaccacaagagttatggcgggcttggaaaacttan

SEQ ID NO: 710858 - DNA, 439 bp, Homo sapiens
cgatcaaggatcgcccggagccttaccctctaccgtgatctcaaccgggagccttaaccctccggacccttaccctcctccagttaatctttatgcttagggattaaacgtgtggttcttttttttgtttttttttttgggaaacggagtctcgctctgtcacccaggctgaattgcagtggcgcaatctcggttcattgcaacctctgcctccggggttcaaacgattctcctgcctcagcctcccaagtagctggaattataggcgcccaccaccatgcctggctaatttttaattttaagtagagatggggttcaccgtgtgggccaggctgttctcgaactcctgacctcgtgatctacccacctcggcctccccaagtgctgggattacaggcgtgagctagcatgcctggccagggtaaagggctcgcggggt

SEQ ID NO: 710859 - DNA, 218 bp, Homo sapiens
gtagtaagctgctaggggcatatcagacgacaatttcacagacacgttaaatgagaggcagcaggatgtgatatgtaagtagcactcatatgtatgctgaggagtgttccaagggcatgtcctatcactgagaaaataaaaggcactaacagattggctctaatcttccatctctcttccgaatggccttgtatgctggatacctgacaccttagttt

SEQ ID NO: 710860 - DNA, 583 bp, Homo sapiens
gggggcgcgcgaggtgggtgcgtcccgggacacgtgtgggttgctgtggttcttggtgctctggggcgtctgagtcatctttgatcttgggttccgccgcaccctgcttcgtgttgtcttctcctgtcgacgccctgtgcctgcccccccactgtcgtggcttttgtttgttcctcccccccgccggcattgttgcggccgctcgtttcttctccatcgctcctctctcgctgcacaacgctgatccccttcctgattggtgtgtcaccaggtgatcttcttactagctcttttcgttcctgcgcaccgcgcgccgcttttctgtgctgcgtcttctccccctccttcttcttccccctttttttgtgctgctgtgctggggaagttttaaaggcgccctttttctccgcgtgctttcggttggtggcccatctctccagggagctcccccccctcccccctttgggtacatcggagaaaccccttttttttttcttttttttttttggagagaccacacagcgggtgggggggggccccctttcttttcccccccctcctttttaacccccccccccccaca

SEQ ID NO: 710861 - DNA, 246 bp, Homo sapiens
  misc_feature (60)..(60): n is a, c, g, or t
  misc_feature (118)..(118): n is a, c, g, or t
  misc_feature (132)..(132): n is a, c, g, or t
  misc_feature (138)..(138): n is a, c, g, or t
  misc_feature (151)..(151): n is a, c, g, or t
cctcaatataaggtggagccaacacaccattatgagaaaggtgtttttaagctagaagtnatcattcctgagaggtacccattagaacctcctcagatccgatttctcactccaatanatcatccaaacatngactcngctggaaggattngtctggatgttctcaaattgccaccaaaaggtgcttggagaccatccctcaacatcgcaactgtgttgacctccattcagctgctcatgtcagga

SEQ ID NO: 710862 - DNA, 1017 bp, Homo sapiens
  misc_feature (82)..(82): n is a, c, g, or t
  misc_feature (138)..(138): n is a, c, g, or t
  misc_feature (674)..(674): n is a, c, g, or t
  misc_feature (678)..(678): n is a, c, g, or t
  misc_feature (687)..(687): n is a, c, g, or t
  misc_feature (692)..(692): n is a, c, g, or t
  misc_feature (695)..(695): n is a, c, g, or t
cccagggctaggagctgcgcgccccacccggcccgcgagggatggcaactacccggggtccggaggcggggctgcgagtgtnggggcggggggcgcgggccgggtcgagcaccgccccgacgagggcccaggccagtncggcccgccccgggttccctccgtgcctcaggtcccctccgtgccccgcgtctcccgcgcattccggtcatgcctcagccgcgccaaggcctgggacacggccggacagaccgcggggcagccctcggagaagtgggaagaggggagaaaacagtggcgaaaagaaggtctcctgggaaggagcgccctgggaagctggacgcggtgggtgctcttgaggggcctcaggagtggacttggggaaaccgcccgccctgaaaactgactcagcggcgcgttactgaggccgttcctagttggaagagaattaatagcacttgtttgagaattacaagttagttccagaaatgaatcgagtgacctcacagcccgtaggcaggggtgggagagccaggtgagcccctcacctcaccccgcccccgccccggcagcgctctggaaagcctcaaagcccagcgctgcgcggaaatgttagaggcccaaggcaggtggcctgtctggactcagacccgacccagatgtccccccaggcccancacncagtcccanctgcncgncgcaggagacagtaacccgactggaacaccagcctttctgaggccatggaggccctgaactcgtgagcacggaaacgtgccacactgcgagcaaccgggaaagagagacactgcaggaggaccaggcaagctctgactctgaggttggaaggctgaacattatgctcttgctgtgtcctgcacggcacagcgcgcgatgccccactcgtcgctgtgcaactgactgacgcatcgtagagttggagactcttcggggctgccctagaagcaagatcggcctccacctgggccccagcaatgcgctcccgtttaggaacactac

SEQ ID NO: 710863 - DNA, 485 bp, Homo sapiens
atctgctccctgaatgtggtgagcccggtgtccacaggactgtgtaggagggacagccagcatctgccctttccagagacctttctcctggcactcgtgtctgggcgctagggatgatcttgtttctgttccttggatttttacttctcttcagctccatctgaagcttttcccctctctcatttcattgtaatcataactcgcacatcaacctcaaattaccctctatcaatcactctcttgcctagaaacttgctgggctcctcctcttctgctgccctgggtgtgtcatgcagagtgccctgcgcctgccaccaactcccaccgcccttgctctcccactgccagaaagttagcctccaggcctctggagtccgagttgggctcacggttccatctgagtgtgtttgccctgagctgtttgtaaatgggacttacaaccacagccaagctcttcaaattatggagttccgtttaaaaaaaaa

SEQ ID NO: 710864 - DNA, 153 bp, Homo sapiens
ggactcaggcagcaagcagatttggtttttaagagacaggctctgctgtcacccaggctggcgtgaagtagcacgatcaagggttcactgcagtctcaacctccggggctcaagtgatggttccccgcgtggtaccgatgctcgaacttcgta

SEQ ID NO: 710865 - DNA, 310 bp, Homo sapiens
  misc_feature (53)..(53): n is a, c, g, or t
gacccaaacaaacaacactagaactagactctgctgaactggcccaagacctncacttcagcatataaggcaatggagaaccagagggatagtgtctgctctaaggtcacacagcagacatgtcagcccagatttcaaccaaggttttcattccagttattgccttggttctttaagattcaaaccccactgtttttatttaggagagaacaagctgctctcttgtgattcttatcctatgactcacttctgccatctctggcgtctcaacgcaccaacacgcttagcaactctcctctcccccggtctc

SEQ ID NO: 710866 - DNA, 429 bp, Homo sapiens
ggctcccaaatagcgttggactacatgcgtgtgtgcaccatggtaggtagttatcgtgatactcgggagagacggtgttcaccatgctggcaagggcttggtctggaactcctgacctcgtgatctgacaaagtgctgggattacaggcgtgacccactggtgccggctattgtggtacagaagttcgtaagagttccaaattattggtgtagagatggggtcttgctaatggttgcccaggcttgttctcaaactcctgggctcaagcgatcctcccgcctcagccttccaaagtgttgggatattcggcggtgaacccactgcctccagcctggtgtattcacctagcccaaaagtagatagatacatagaaggtacttaaaatgtttctccttccccttgtaaaaattcatgtggtaaataacaga

SEQ ID NO: 710867 - DNA, 596 bp, Homo sapiens
  misc_feature (20)..(21): n is a, c, g, or t
  misc_feature (28)..(28): n is a, c, g, or t
  misc_feature (98)..(98): n is a, c, g, or t
  misc_feature (159)..(159): n is a, c, g, or t
  misc_feature (161)..(162): n is a, c, g, or t
  misc_feature (180)..(180): n is a, c, g, or t
  misc_feature (208)..(208): n is a, c, g, or t
  misc_feature (304)..(304): n is a, c, g, or t
  misc_feature (331)..(331): n is a, c, g, or t
  misc_feature (360)..(360): n is a, c, g, or t
  misc_feature (367)..(367): n is a, c, g, or t
  misc_feature (380)..(380): n is a, c, g, or t
  misc_feature (397)..(397): n is a, c, g, or t
  misc_feature (437)..(438): n is a, c, g, or t
  misc_feature (449)..(449): n is a, c, g, or t
  misc_feature (462)..(462): n is a, c, g, or t
  misc_feature (470)..(470): n is a, c, g, or t
  misc_feature (473)..(473): n is a, c, g, or t
ctgcctctatcttgtttttnntttttcnttctggggggggtctagaacagtgcctggcacatagtaggcgctcaataaatacttgtttgttgaatgtntcctctctctttccactctgggaaacctaggtttctgccattctgggtgaccctgtatttntnnctggtgcccattccattngtccagttaatacttcctcttaaaaatntccaagaagctgggtctccagatcccatttagaaccaaccaggtgctgaaaacacatgtagataatggccatcatcctaagcccaaagtagaaaanggtagaaggtagtgggtagaagtcacnatataaggaaggggatgggattttccatnctaaagntttgggagagggnaaatccaggctattcanagtcactaaatttctaagtatgtccatttcccatctcagnntcaagggaggngtcagaagtatantctccacnttncaactctcacactccaagactctagtcgggaaggagctctgtcccacatcgggtcaagttggaactccttcccatttccaacatcatacctcccatcactcagactccctttcccaaggatca

SEQ ID NO: 710868 - DNA, 169 bp, Homo sapiens
catcgcctcggcccgactcacacctcatctgctatgcattttcttcacgtgcagcttgcagtccgttgctgaaaatgattataggccctgcatcctgttaagctttattgtgattacgtgtatgtttcttctttcttttctctttttctttcttcttcttttttttttg

SEQ ID NO: 710869 - DNA, 270 bp, Homo sapiens
ctacatgatagaagacaatgcacatgtacagcaagcattcagaaaatacttatcattactcaatgaatgtctaccaagttcaaagtactttatcttgtataagttcctcaagaccaatctccctgtgcttagttctttacgttattatccatggaatgtggctgcagagtgaagtggtaaatagcagaattcacacttgcacgaatcagcatcatcactcccaacagtaattcagcagctccacacagtcattgttaccatttcacacca

SEQ ID NO: 710870 - DNA, 308 bp, Homo sapiens
cattagagtgcagatatctgaagacttggattaatgtctctctccaaaggtctcttggaagaaaaatacatgatgtctctcttcaggaagttgcagggcctacagaaatgtgtgaccagaggcggctgggcctgtcacttcattctgccctccagatcccccggcagctatgtcaagtagcagcttttggaggcagtaatattgagcctcgtgttcgccgcttcttcctgcctcaataacgctgcacctacaactaagtttgcgcagagttcatggattgggatgcatttgtgaaccggccgtccatg

SEQ ID NO: 710871 - DNA, 968 bp, Homo sapiens
attctagaagccgaggcggccgacatgtttttttttttcaaatcaacgtagtgagtgctaccaccaccatttgaaattagagaaaagattaaagaaatatctgaaactttgggccaggcatggtggctcatgcctgtaatcccagcacttagggaggccaaggcaggcagatcatgcggtcaggagttgggagaccagccgtggccaacatggagaaagcctgtctctactaaaaatacaaaaattagctgggcgtggtggcaggtgcctgtaatcccagctactcaggaggctgaggcaggagaatcgcttgaattccaggaggcggaggttgcgtgaagccaatgatcgttgccattggcacttccagcctggttgacaaggacacaagactccgtctcaaaaaaaaacaaaagataattcttcggaacccttttaatagtttacacgaattttaccaggattggagggcatcttcacccataggaatattacccccaaatttcagcgttcacaagggctggaagggaattcttcttgcccaactcttgtgttgggaaacgtcacacaaggttattactctggataaccacagttttcccccggtggcctttgtgggcggacaatctttcaatttagcgtggcattttgcccacatcatatcccctgggccacaacagtgtgtcaacccgtggaaccctacattggggagaccagggaggcagaacgataagctaagcagcaaaacaccagctggtgcaccagaggcacaacccccctgccgggggatattgggattaggggaacgctaccctgttgacggggtgtctgatcccgacctgtgtatgccgcggaccagaggatgtataggatacccggcagccggatacaattccacaaccacactgtggaggtacataattcaataaagaccaaaaatgtgtacaggacgtgatagtaaactcaag

SEQ ID NO: 710872 - DNA, 118 bp, Homo sapiens
tggttctcatacaggggtgtgggcgatgcatgctatattagggctcttgtatcacctggcagtgtactgtatcaacgtataatacagaaaaaacatctctttaccggtcctccttaca

SEQ ID NO: 710873 - DNA, 1579 bp, Homo sapiens
tcatatcactgtgctacagccttggatgacagacgaccctgtctctattacacaacacacacaacaaaaaacaacaaaacacacacaaacaagcacaaacaaaaacacaaccaaacagaaaccaaaacacagaaacaggaagaggcaaaccaaaatgggccaaacccacaatgacaagcaacaggacacccaacatacactgcagaggagggagacgaccataacaagaaccaaaacccgagaaaccacacgagacacaacaaccaacaagagagcaagagaaacaaccatcacaaatgtgagacacacacacaaggacaccaaaacgccacagaaaaacaagacaacaccaccagagcacacgagccaccgaaagccacacacacatcaacgccacatacaacgcgacccacaatgctcaatacacccctacgagcgaccccacaaacaacgacttccgaggcggccaccgccgaacaaacagcaggcaggaaaccacacccacaacaccaaaactaccaccccccttagaacccaggtgagcccaccaacacccacctccaaaccacaactaccacaaccgcagccgaacaaaccaccgaccaaacaacgaactaccaccgtccggcaacccaccccccaccactcgagagagaacactacgaggcagaaaccaccacacccacgaccacaaaaccacaaacacacaacaacaccaacaccgcgacgcaaacaaaatcgcacaaccacacgacacagggaccacaaacacacaacgggcccgctaaccacaaactcaccacaggacacgccacacccaactgggaccacccaacagcacgacacaatctcaccaacaccacccacccacggatcaaacagcaacaacacggctacaaccaacaacgacgcggcaaacaaagttgtcacgacccccccgacgacagaacacccaagcacacacccaagaaaaacgcggaaacaaacgcccaccaaaacccaacaaactgcgaaaacaaacaggaaaccaaacaagcatgtgcaaacagcaacataccaacccaacaaacagcaaaccacagaacgaaaccccccagacaaacaaacaacagatagcaccgtgggcaacaaacgccagtggggtgaaccacacccacacccacaagaagatacaacacacaacacccaaaacgaaccagcctcaaccgacagacaacaaccactacagcactacacaaacaccacgagacgaagaagaatagagcgatcgtagcacaccagcagcaaccacaccccatggaacatcagcccacaccacgcgaaacaaccagcccccgaggacacccaggcggatcagacgacagcgcacacgacaagcaacaactagtgggcaagtataaacacccgcagggagtgaccaaaggcttaggcacgcacacgttgtacaacagcaggacgcagccagcaccgaaaaactgcaaggcaccgaccgtaacgcacacacgcgacaacgtgttgtacagtaaccacacaccacacaacagaaccaacacaggaaccaacaaaagaacagaacacc

SEQ ID NO: 710874 - DNA, 217 bp, Homo sapiens
aactctgaagaccggctagttgctgacacgaaactgaaccttctaagcgagttgacgtaacacgtcaggtccagctagctggtctcaactaagctgttgttataccttgccttttggtagacttgcaactcacgcactggcgactttgcgccactcttctactggccacacacttcacgcacttggcgctacccgagccctcgcaacttcgctaact

SEQ ID NO: 710875 - DNA, 315 bp, Homo sapiens
tgtactttaacagggctgtatttatagtccagcaccgataagtcacatagcctggtcataacctgagttgtctgtcagaactagccggccatctgcagccgcagacctcaatctatggcacatctcaatgcaattcacttttttttttaatgttgtgaccttctctgcttcttgcaaggacttccggcatcaccagtggcacttttatctgggtcccatgatggttattcaagacttatggtactcacactaacctcagtgaaaaatacatgggacctgacaacacagcttgcgacacgcgacgggtaccgagct

SEQ ID NO: 710876 - DNA, 1466 bp, Homo sapiens
tgtggcgccacagggttgtttttctgtggtgcgcgcgcggggaggtgttgctcgtcttcgcgcgtggggtggacggttgtcgcgcgttttgcatactgggggggttgtctcgtgttgtcgcttccgcggtggttgtgtctgttgcgttgttatgtcggctggggtccgccggcggtgtttgtgtcggtcgccctctgcgctggttgtctcgttgtgtggttcgcgtgtggtgtttttcgggggtattttgtccgcgggacgctttctggggtcgcctgtttttgcgagtgcgtggggatcgcgcccgcgtgggggttcgcggagggggcgcggcgcggtgttggtgcggcgcgtgcgccgggtgggggcgggggagtgtccgctagggcgggccggttgttgggggggccgttggggtgtcgttgtggtgcaagccgtcaggggcggcgtggggtctatctgcgggctggggagggggcgtcgcgtccactggggggggttgctccggttttctcccgcgatagtgggtgggtgtgctcccccgcgtacaatttccccctgtgtagtggccgccgccctcgtagggggtcggcctcgtctcgtacgggcgtccccccgtggtctttggggagacgcctgtgtgtgggcgcccctattgggcggggctctctgttcggtgaggctggtggggatggggccctgaggcgcgcgattttcgtggggttagcactccgctcgctttatggagtgggggcagtctggggtgtgtttggccgccgcgcgtcgccggggccgggttgacgccccacgtgtccctctcttgtcctcttttccgccggagaggggtggtttttcgcacgcttcccttatcccccgagcgagagggggttgttgtatagagtgtggcgtgtcccaggcttgttgtgtctctcacgcggccttggcggacattttctctctccttggggtggggcgtctctcgggggctctgcgcggggtgtgggggagccccccacgcgctctttctctgggcgccccgacccctctgttcctctcttgggagttgattgggcacctcgcctatatccacccgctttcttgtccacgcgttggtgtttattttggagagggttttgtgtggctgttttttcaaaaaaaaaaaggtccctccaaatcacggaaagaataccacctccacagagacacaatgttcctatgtggaggggaggtaatcctaacacccccggctggcccccacgctggcaccctgcctctattcccacgacctgccctcgtcccacgcttctctgtcccacctgttgattaatgtgatttttttgatacgtcccttttccaatgcccgtgtgttcacatcttcgctctggcccgccccttctgtatttaaagcttttgaggcccccataaaatagtacgtgccgtcctgcctaacaaaaataaaaaataaa

SEQ ID NO: 710877 - DNA, 780 bp, Homo sapiens
  misc_feature (20)..(20): n is a, c, g, or t
  misc_feature (83)..(83): n is a, c, g, or t
  misc_feature (90)..(91): n is a, c, g, or t
  misc_feature (94)..(96): n is a, c, g, or t
  misc_feature (99)..(99): n is a, c, g, or t
  misc_feature (117)..(117): n is a, c, g, or t
  misc_feature (119)..(119): n is a, c, g, or t
  misc_feature (213)..(213): n is a, c, g, or t
  misc_feature (265)..(265): n is a, c, g, or t
  misc_feature (327)..(327): n is a, c, g, or t
  misc_feature (353)..(353): n is a, c, g, or t
  misc_feature (385)..(385): n is a, c, g, or t
  misc_feature (395)..(395): n is a, c, g, or t
  misc_feature (408)..(408): n is a, c, g, or t
  misc_feature (415)..(415): n is a, c, g, or t
  misc_feature (483)..(483): n is a, c, g, or t
  misc_feature (520)..(520): n is a, c, g, or t
  misc_feature (530)..(530): n is a, c, g, or t
  misc_feature (584)..(584): n is a, c, g, or t
  misc_feature (590)..(590): n is a, c, g, or t
  misc_feature (604)..(604): n is a, c, g, or t
  misc_feature (630)..(630): n is a, c, g, or t
  misc_feature (699)..(699): n is a, c, g, or t
tggtaggtttgatccctgcngttcagtttcccggggtaatcactccccagatagcagttatatttttgcacttatgtccggtnttttggnnctnnncancagctacccaggcatctntnccccacaaaccagttaatgggcatcgttaagctgccgtgcaacacccaggatgtttttggctcctttgctcagcaacaagttggccaggctgangcccaagttctgggcagccaactggggccctcgtggaatgttacgagcagtnatgcctaccaactgtgggttatcctcagggccatcttcatgctgggcagggacatggatggnagcctgcatggtctcttgtatgctanctgagccgtctagactccagattcctccagtnaggtacagtngcccatccttcanagctgtntgcacggctactggcacactgcagcttccttccaggtgccttaggaaggccctttcagcgatgcagcnaagagagtttcgggatcgtgcagcacacccaccaganccaagatgtnctggtccttggctcgcacttccacgcccaaggccccctgccccacccggttgtnccagcncatgcgctgcaggncagctgttgccaggatgatggcactnaacttctgctgctcgttcagcttccgaagccgggtgttgaggttccccgaatactcctgaactccagangcgggaactttctctgcagctgggctctcttcgcagggagctggttcccaccacactcttctctggcagggtttctagggt

SEQ ID NO: 710878 - DNA, 743 bp, Homo sapiens
  misc_feature (20)..(20): n is a, c, g, or t
  misc_feature (137)..(137): n is a, c, g, or t
  misc_feature (189)..(189): n is a, c, g, or t
  misc_feature (251)..(251): n is a, c, g, or t
  misc_feature (277)..(277): n is a, c, g, or t
  misc_feature (309)..(309): n is a, c, g, or t
  misc_feature (319)..(319): n is a, c, g, or t
  misc_feature (332)..(332): n is a, c, g, or t
  misc_feature (339)..(339): n is a, c, g, or t
  misc_feature (407)..(407): n is a, c, g, or t
  misc_feature (444)..(444): n is a, c, g, or t
  misc_feature (454)..(454): n is a, c, g, or t
  misc_feature (506)..(506): n is a, c, g, or t
  misc_feature (547)..(547): n is a, c, g, or t
  misc_feature (553)..(553): n is a, c, g, or t
  misc_feature (567)..(567): n is a, c, g, or t
  misc_feature (593)..(593): n is a, c, g, or t
  misc_feature (662)..(662): n is a, c, g, or t
tggtaggtttgatccctgcngttcagtttcccggggtaatcactccccagatagcagtaatgggcatcgttaagctgccgtgcaacacccaggatgtttttggctcctttgctcagcaacaagttggccaggctgangcccaagttctgggcagccaactggggccctcgtggaatgttacgagcagtnatgcctaccaactgtgggttatcctcagggccatcttcatgctgggcagggacatggatggnagcctgcatggtctcttgtatgctanctgagccgtctagactccagattcctccagtnaggtacagtngcccatccttcanagctgtntgcacggctactggcacactgcagcttccttccaggtgccttaggaaggccctttcagcgatgcagcnaagagagtttcgggatcgtgcagcacacccaccaganccaagatgtnctggtccttggctcgcacttccacgcccaaggccccctggcccacagcatanatgcatttctcagggtgcaggatctgccccacccggttgtnccagcncatgcgctgcaggncagctgttgccaggatgatggcactnaacttctgctgctcgttcagcttccgaagccgggtgttgaggttccccgaatactcctgaactccagangcgggaactttctctgcagctgggctctcttcgcagggagctggttcccaccacactcttctctggcagggtttctagggt

SEQ ID NO: 710879 - DNA, 141 bp, Homo sapiens
actcctgactcgttggatcttgcccacctcagcttcccaaagttctaggattacaggcatgagccagtggacccagcctccatgtttctgactattaagggaaggttttcacattcatccctgtcaaacatggacgttctc

SEQ ID NO: 710880 - DNA, 117 bp, Homo sapiens
cgtccacagcttctcaagctgctggggttacaatcattaaccaccacacctggcgaaacaatttttttagagattgtggtctgtcaatgttgcccaggctggtctttatactcctga

SEQ ID NO: 710881 - DNA, 505 bp, Homo sapiens
tgtgctaagagatgtgcctgcgtggcagggtggatttgcaagttcttattctcacaggtggcctgacctgatggaatggggagtgcagctcaaggcccagacagagacccacactctttttccataattatataaatgtcagaagtaaggctcagatgcttgaagtcattcggagtcaccaagccggtatccaatgctgatggcttgtacattcttctggattttgtgtgggctgcaattgcactgcatttattttagagatgtttgagagatgcatttattttgtagttgttagatcttctgctttcctaagcagatggaagagggcacagaagtgcacacacagagtgccgtgccgtgggcagggctgaggagtggaacgtacagtctcgctgtgggggttccttttgctgttggagcttcttgatgaaattctagacatttggggcagttttattgggggagaaatttggggcaggttgagaggagaggcccgtctagcccc

SEQ ID NO: 710882 - DNA, 247 bp, Homo sapiens
tgaggtgctctgaggatccctcagagagagacagatgctggtggcaggcatgaggacagcatggttgtatcagctataagagctcgttcgcatggtgctgaatggctgaggaccttcccagtctcgccagagtccgtgcctttccctgtgtgaattttgtatctcgcctagagtttcccttggctttcttgtctcagctactttcccttctcctctcttctcttgtacatctcgtctctttctcttg

SEQ ID NO: 710883 - DNA, 912 bp, Homo sapiens
tcacagtctagctgctaggcatcaactatactactaataggaactgaatgtctacacctcttatgctccctcggcggaggagaagacctacatgctataccatgcaccgtattctgactctctcggaacaacctcttgaaacgatttatatgcttaatagctaccagagtcggtcgcaatgaagtctgactgattgtaagctgactgctccggatctacacggcaccattcggtagatcagtaggcctatggtctgagctttgtggtctccaatctgccttactatgggttgatcgctgatgaggaagccatatattcaccaggcccgtgactagatgttgtacttagcgaggataatgtcatcctccgtataacatatgtacagcgatatacggccaatgggagtcagagatattttgttggagtcgtcgaaaatttcgacggtaatgattatgtgaaacatgatcttgctgtcagagtgatgagtaacttaggactcctatctattctgaaggaacctaagaagggttatgacttaaaactaattaatcttgttcattatgtccctctgaggaacctttaaaaaaacataaatgggaggcgaagtgagaataatttaaacttgttcgataatcgtgataatgaaatttgggggtatcagggggtgcgtttcaggtaaaagtcgagggagccttatgttaagatgatcagagagagactgagctaggaggggtaatgaaggcccaagggggaatgatcccagggggtttagacggaagtaatcaggaattaatttaggaaagatttggcggaagggggattctaaaggtgccttgggtgaaaaaagagtgtgcccgaaacaataggcgtctatgattagagagagtaagggaccatatatttgacaatagt

SEQ ID NO: 710884 - DNA, 872 bp, Homo sapiens
  misc_feature (27)..(27): n is a, c, g, or t
  misc_feature (87)..(87): n is a, c, g, or t
  misc_feature (104)..(105): n is a, c, g, or t
  misc_feature (114)..(114): n is a, c, g, or t
  misc_feature (117)..(117): n is a, c, g, or t
  misc_feature (135)..(135): n is a, c, g, or t
  misc_feature (140)..(140): n is a, c, g, or t
  misc_feature (167)..(167): n is a, c, g, or t
  misc_feature (169)..(169): n is a, c, g, or t
  misc_feature (219)..(219): n is a, c, g, or t
  misc_feature (234)..(234): n is a, c, g, or t
  misc_feature (236)..(236): n is a, c, g, or t
  misc_feature (271)..(271): n is a, c, g, or t
  misc_feature (280)..(280): n is a, c, g, or t
  misc_feature (289)..(290): n is a, c, g, or t
  misc_feature (317)..(317): n is a, c, g, or t
  misc_feature (353)..(353): n is a, c, g, or t
  misc_feature (639)..(639): n is a, c, g, or t
  misc_feature (687)..(687): n is a, c, g, or t
  misc_feature (725)..(725): n is a, c, g, or t
  misc_feature (730)..(730): n is a, c, g, or t
  misc_feature (792)..(792): n is a, c, g, or t
  misc_feature (806)..(806): n is a, c, g, or t
  misc_feature (846)..(846): n is a, c, g, or t
atttttcttaaacagaacctgtttgcnggatctcagttaagtacactttgcagttttcaaacacaatgactcaaattcaactttacnctttaaagaatcaaaannttgaatccnganattacctctttaagacgnatctnatgtcatcttccgacatcatgtatatngntaataatattcgcctcttctcttccgacgacgcgattcttttaacgccangccctcttccctctngngacctgacttagattgtggcggccctagaggcgantaagagatntggggcagnngagggggccttaggtaattgttaagantagaagtatttttaaaaaactgtggagagtggtttnggaggggattttgtccctggctgaagctggtccatgcctgggtaaactttacttataaaagaataccaggaacacacaaaatattcttctcctctttcttttgcaatccagttttggagccaaaaaataatctgtgtgcacatgtgttttgataatactgtctcgacttaggtggggaaattaaattcaggagttttatgactttcttttgttctgagtatcactttagagtataaaaagtttttcaaaagttctttatcagaaatagtttcaccctatgttgaantaacaatacccaggattgtgagacataaatcaacatgagttggaaaanccatctgagtttcatcattgtttgtctatcttggcaanatttnttcagaagcaccataatggggggcaatccttttgcaccaggctcaggcagctcaggaggcanctgtggtgagtgangctctctaccaagcactttggcttctagggataaagaacncatactccactaccttcaaatgccaa

SEQ ID NO: 710885 - DNA, 287 bp, Homo sapiens
cccgctgtaccagttgcgcagacatcagctggctgaggtcgtacaagcaatacaacatctcctgggagctggacgtgcgggaggtgcgcaattcctcccttcggcgccggctcatcctggccaagtgtgacatcagcaagattggggatgagaactgtgaccccgagtgcaagcacacgctgaggggccacgacgtctgtgaattgtcgccatactgcgccagcctgcgcttcgtgaagaagcagcacaacggggtgtgtgacatggaccgcaactggtacggcggg

SEQ ID NO: 710886 - DNA, 624 bp, Homo sapiens
  misc_feature (66)..(67): n is a, c, g, or t
  misc_feature (80)..(80): n is a, c, g, or t
  misc_feature (91)..(91): n is a, c, g, or t
  misc_feature (175)..(175): n is a, c, g, or t
  misc_feature (226)..(226): n is a, c, g, or t
  misc_feature (236)..(236): n is a, c, g, or t
  misc_feature (246)..(247): n is a, c, g, or t
  misc_feature (257)..(258): n is a, c, g, or t
  misc_feature (262)..(262): n is a, c, g, or t
  misc_feature (266)..(266): n is a, c, g, or t
  misc_feature (283)..(283): n is a, c, g, or t
  misc_feature (294)..(294): n is a, c, g, or t
  misc_feature (298)..(300): n is a, c, g, or t
  misc_feature (306)..(307): n is a, c, g, or t
  misc_feature (310)..(310): n is a, c, g, or t
  misc_feature (320)..(320): n is a, c, g, or t
  misc_feature (327)..(327): n is a, c, g, or t
  misc_feature (396)..(396): n is a, c, g, or t
  misc_feature (399)..(399): n is a, c, g, or t
  misc_feature (501)..(501): n is a, c, g, or t
  misc_feature (534)..(534): n is a, c, g, or t
  misc_feature (539)..(539): n is a, c, g, or t
  misc_feature (620)..(620): n is a, c, g, or t
aatacaatgaaaaatttttcattttttttggtaaatcttaattttctgaaatttcttcttctttcnnaacttttttcctnctgcatttgcngctttttcagccatgatctctgagtacttccttcggttgtatcttctgaattcagaatcagccagcagttcttccacaatagtncttttcctttgcttcttgggaattcgtgaatggtagaaatcagctggattntcaacaattnttccaatctnnaattactttnngaanccanccccatcacttttcctntaaaaagcctntgcnnntgccannccnggccgcgcancccgcanttgccttgagatcatttttcagttgcatttgtcatttctggagctttcataccaaaccagccatccccngcngtcttttgtcgttcttttctgcgttttttctgaagttgatactttgattcactatatggtggaacacagtggtttttttcaaaatcaggtgtaatgacggcnttctgcagaagctcatttttctttttctccttnatctntgttagggttctcttgttagactgtagtttatctgcattgaaattaatatacaaaccacgcgcaactggctttatactcanacat

SEQ ID NO: 710887 - DNA, 695 bp, Homo sapiens
  misc_feature (21)..(21): n is a, c, g, or t
ttatctcatccaccacagacnccccacattaaaacatgaattcctccagagccgccgtttagaatatgcacactaacccctccagagagtgactcaagtatattccacttctatctgtaaaatacataacgcggtggtctggtcactaataaattacccccctccaaacatacaatctacaaacacctctatcttgacacctcccacattaaacactaataccactacatattcaacctcaaacattttaaaactaatcccacaacccaatccataaattttaaaaattattacaatctcaatactaatacacgcttcataacctaaccccccttaactacaactactccaattcactcgaccactcccattcttacttttcaaacacatactcacatattacaactctctctatccaatttccctatttcaaataacataacaccaacctattattacatacaaacattttctacacactctaactccacactcgaatcttctcttcacaacatacctcataccacataatatacttctacacaactacttacataacatctcctatattactatctacaacaaactattcttatatctccttcatccacaaacaactcttctcaatctattctaacaatcatcatcactacaatttatcatatatcacttcccactctcactcaccctactcc

SEQ ID NO: 710888 - DNA, 474 bp, Homo sapiens
acctgattctgcacccacagcagcatcttcccggtaagaactcatcttcttatggaccgccttttcttcctgtactctgaggctttatatcttagaactcctcttgttaatagaacattcttacaaattgtctatatgagtttgatgattcatgctagagaaaatgaatgggaatagggttatgtactatgttaatagtttatccattttagataaaatttgagaatatccaaaaactttactgaaataccaacccatagacaagacacaggaacaaaacagcaagtttaaagaaattttaaacagttgttttaagaataattaaaacttgtgaacacagctcactgcagccttgaactcttagcctcaagtgatcctcctgcctcagcctccctggtagctgggattacaggcacaagccactgcacccaggcagaagacacattttagtatgtaacagtgtaaggaagaaat

SEQ ID NO: 710889 - DNA, 720 bp, Homo sapiens
ggttcgttgggcggtgttggtttctacgctcgtcgactgcggttcttcctcgggcagcggaagcggcgcggtggtcggagaacgctggcctaaaacttcggcgttgtggtgacagacaaatggcccgataccaagcagactgttcgtaagtccaccggtgggaaagccccccgttaaacagctggccactgaaagccgctcaggaaaatgcgctccctctacctggcggtggtgaatgcaatgcctcatcgctacaggcctgggaccgtggcgcttcgagtagattcgtcgtttatcagacagtcgatccgatgctgctccattccgtgaagctgcccttccagaggttggtgacgggagatcgcgcaggatttcaaatccgacctgaggtttcaggagcgctagcatcggtgcgctgcaggaggctcagccgaagcgtacctggtgggtctgttcgaagatacctaacctgtgtgccatcctacgctatagcagagtcaaccatctatgcccaaagacatccagttggctcgccggatacggggagagagagcttaagtgacaggcagtcatttatgcgcgcttttgtagataaagttctgttaacacatacctttgggcttcaactaccgtgacctaaatcgcgtaacccacaacacgtctatcactactcgtggcattttgtcaccttaaagtccattccatccttcactcacggag

SEQ ID NO: 710890 - DNA, 382 bp, Homo sapiens
  misc_feature (209)..(209): n is a, c, g, or t
  misc_feature (225)..(225): n is a, c, g, or t
  misc_feature (251)..(251): n is a, c, g, or t
  misc_feature (292)..(292): n is a, c, g, or t
  misc_feature (297)..(297): n is a, c, g, or t
  misc_feature (358)..(358): n is a, c, g, or t
  misc_feature (366)..(366): n is a, c, g, or t
tccaatgtgtcatacgtgcacacacatatgtctgcacatgcacgcatacatatacacataaacacacacatacatccctacgagacacaggatctggatccaactctcctagaaccaggattcctgccatgtttctctcccatcagcttacatctcccacccccagtgctgttcagctgggctctggggcaagataaattcccagctgnaagagggctcaagtgnaaatggggcctggaaccaggcatctnaaaagttctggagagtaaggatgttggggataagccagaangcaanctgaagactagtcttcccatacccaaggaaggacttgggcctctcagggttttgaaagaangccttttngcaaagcagctgggta

SEQ ID NO: 710891 - DNA, 171 bp, Homo sapiens
ccctggcaggggggggtgccaggcccctggaaagcaggggttcccgttacgaggttgtggtccggggcaagccaagtacgaagcagcagccttcgggggttgcttcttcccccagccgggtcccccccgggcctgtttcccagggtttgtttaataaccgcccccctccta

SEQ ID NO: 710892 - DNA, 1274 bp, Homo sapiens
  misc_feature (348)..(348): n is a, c, g, or t
  misc_feature (360)..(360): n is a, c, g, or t
  misc_feature (373)..(374): n is a, c, g, or t
  misc_feature (382)..(383): n is a, c, g, or t
  misc_feature (390)..(390): n is a, c, g, or t
  misc_feature (397)..(397): n is a, c, g, or t
  misc_feature (403)..(404): n is a, c, g, or t
  misc_feature (409)..(409): n is a, c, g, or t
  misc_feature (413)..(414): n is a, c, g, or t
  misc_feature (421)..(421): n is a, c, g, or t
  misc_feature (427)..(427): n is a, c, g, or t
  misc_feature (432)..(432): n is a, c, g, or t
  misc_feature (437)..(437): n is a, c, g, or t
  misc_feature (444)..(444): n is a, c, g, or t
  misc_feature (452)..(452): n is a, c, g, or t
  misc_feature (464)..(465): n is a, c, g, or t
  misc_feature (471)..(471): n is a, c, g, or t
  misc_feature (476)..(476): n is a, c, g, or t
  misc_feature (480)..(480): n is a, c, g, or t
  misc_feature (486)..(486): n is a, c, g, or t
  misc_feature (488)..(488): n is a, c, g, or t
  misc_feature (499)..(499): n is a, c, g, or t
  misc_feature (514)..(514): n is a, c, g, or t
  misc_feature (517)..(517): n is a, c, g, or t
  misc_feature (520)..(520): n is a, c, g, or t
  misc_feature (522)..(522): n is a, c, g, or t
  misc_feature (530)..(530): n is a, c, g, or t
  misc_feature (543)..(543): n is a, c, g, or t
  misc_feature (546)..(547): n is a, c, g, or t
tttttctttaaagaggttcccaggtttcacagggtgtgggacacctttatggggttcccccttgttggtgttggtgcccccttaacacctaagacacaccccgtttagccccaggggaatgtccctttctctcccacccaaggtctaataggagcccccagggtctcaggtccatatacaaattccccccagcccatgggttgacaggcttgggttcggttgtcccttcagggaaaagcagaattgcacgccatcataagctttgtgaccccaccgcatgggggtagtgacattccaggcattcattgacttcatgtccggcgagacacctgtctcagatctagcagnccaagtcatggnttccttcaagatnntggctggnnacaagantacattnccatgnncgagntgcnncgcgagntgccanccgancaggntgagtantgcatcgngcggatggcccnntacacnggccntgantccgtncnaggtgctctgnactacatgtccttcnccncgncnctgtacgncgagagtgacctntannccaccccgcccggccgccctcgtcattgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattagttttctgctaaaaagaataataaagttacgttcaaaaccaaagactacatattttattatagaaaaagatatttttttctccaccagacaaatggaaacaaaagaggagaagattaactagtttgcaccgaaatgtctttgttttgttgcgacataggaaaataaccaagcacaaagtaatattccatcctttttctactgattgttttttcttctatctgttccatctgctgtattcatttcgtccaatctcatgtccattttggtgtgggagtcggggtagggggtactcttgtcaaaaaggcacattggtgcatgtgtgtttgctagctcacttgtccatgaaaatattttatgatattaaagaaaatcgtttgaaatggctgttttctaagcgaagagaactttatgtggcttctcatttttgaatcccctcaagaggtgtgaacgtagtcctctgatcagcacacacatttggcaattgttaatattgtctactgaaatagacaacttggagagtatgacacttatatttagccagtgtataaacctccttt

SEQ ID NO: 710893 - DNA, 208 bp, Homo sapiens
ggtcatagctgttccatacatttaaattcagaattgcttgcaaaagctgggccgggatagatcgacatcctagcataacgatagtaccatcttaaacgtatgtggaaaggtcaaaataaatcatttcaaaatacttaactttcctcataaggatgtcaggttctcttctctttcattagcgggccatcagtcaaggtccttataacac

SEQ ID NO: 710894 - DNA, 326 bp, Homo sapiens
ggcccgctgattggcggacgatgttcttcagcaccggcagtacgccgccatcggacatgagttcgctgcaaaccacctatgtggtgatcgccgttctggtgttgctggtggcgctgttgatcgcccgcacaccgctgccggatctgcgcgcccaggagcaagcactgcaaccggtggccggcaaggggctgtggcagtatccggagttcgttggtggggtgatcacgcagtttttctacgtagcggcccaggtcggagtcggcgcatttttcatcaactacgtcaccgagcattgggcacagatgggcagccagcacgcagcctac

SEQ ID NO: 710895 - DNA, 726 bp, Homo sapiens
  misc_feature (23)..(23): n is a, c, g, or t
  misc_feature (49)..(49): n is a, c, g, or t
  misc_feature (241)..(241): n is a, c, g, or t
  misc_feature (280)..(280): n is a, c, g, or t
cgggccgggttcccacgcggatncggggccctgcaagttagctcgcganccccttgtttggagtgacaacagcgagtcagggcaagcgggccggcccagctcacttgcggctgcagtcagcccggacgccgagacccgttcctaagcccccgtgccccaggcctcccaggggtgctgagcgcccccaggcccagaatctccgggggcccgggcaaggctgtcaggtatgttccctcccgtngcgaagccggggctgggcctccaacagacccacccggantcgcgtccctgggcagaaccacacagcctgctcgacccccgggtgaggacttccacttggggggtcccaagatgcgacgtcacacaccgagggacacgaggcgggtggggaatagccacaagcccctccatcctgcgttcaccccacactacgttctgctccgggccggccggggaccctgcccctccgggtctctggtctcctccgaagcttctttgtctaggaagtgcggggaggtgccggccccgggcgcgcgtccccgtcccccacctttcttccccacgttgcggacccgaggccgccagggtcgtgggggcgggggcgaggctggcgcctcgagacccccgggttccccgccacccgcagggcctgagccgcggggaggggcggggaggggacgccgccgcgggccgggggtggagagcgacttcctcctccgcggccgc

SEQ ID NO: 710896 - DNA, 769 bp, Homo sapiens
  misc_feature (423)..(423): n is a, c, g, or t
gggcggaaccggcgagccccgtgcactgtgtctgctgccgaggccccgaccgccaccgtctcggagaaagaaccgtttggcaatgctgcaactctcctcccgggaccctccgggttctctgtccgccaagaaggtccggactgaggagaagaaggcaccgcggagagtgaacggagaagggggcagtcggcggtaacagcatggcatgctgcagtgcgtcctggcagcaccttcgtcctctagagctatggcatgccccgcgttcttgtgagctttgccctctctgtactgctgcgtccctccccggtccttcttctcggatgcagtttctcgtttctccgactggcagcggccgattccctcactcaggcctccgacttcacttgtctcagaccgtgtgccgacgcaacactgcatgtgtcncctcctactgcatgtctgcactgctccagcactctactcaatctcctccgtgcccagcgcgccgaccggcctgcttgccgtcgtggctagacgccatagtcgccgcgagtaacctaaggaggaagcagcggagaaggacgaggaggacggcacgggtgctctggtcggggccctggagaggccaggccgggtggcttcccgggcacggaggaacggcggagcgctgcaagccgaatgacccgagcataccgtcagggactagcagtgtccagagagagtagaccgaactcggagaagtagagatccgggagccagtgacgctagagtgacatgaggatcgatgaaa

SEQ ID NO: 710897 - DNA, 234 bp, Homo sapiens
attaggcgcgtctgcgtgtggcccatgagtagacactccagtactgagacctagagtcatatgcttgtaggagccgagtcgtgtactaagtatttatttaaaacaaaagaatcacgtcttcccatttgtacttcagcgctagcccctgttttgcacagccgagtactggccattatgtctatgttgggccccctgctgcaaaacaataaacagaggacgcagaacgcgcctaat

SEQ ID NO: 710898 - DNA, 758 bp, Homo sapiens
tttgtcttctccgcacgactgttacagagggcttgcagagccttctctctccatgtgcaaaatggcaactcttaaggaaaaactcattgcaccagtagcggcaagatagaggccacagttccaaacaataagatcactgtcgtgggtgttggacaaggtaggtatggcggtgtgctatcagcattctgggacaaagtctctggctgatgaacttgctcttgtggatgattgttggaagataagtcttaaaggagacaatgatggatctgcagcatgggcagcgttattatcttcgagcatcacctaaatattgtggcagtagtaatacgatatatctgctgtgaccgtcgcagattctatagatctgtagtggtgaactagcaggagttcgcgtcatgcaagtaaggggagagtcggctcaatctggatgcaggatgaaatgtgtaatgtcgttcgaaattcattattcctcagatcgtcaagttacagtcctgacttgtcatttcataattgtggattacgcaacccagatggacagttcttacgatagtgttgacctggaagactaagatggatgacccaaacacgcgcgtgattggaagtgcgatgtaatctgggatactgctagatttcgctgcttatggctagataactaggcattcatccagtcagatgcatggatggtaaggggacttgggatcagtgtgtgtggaggtttatggtcagttcctccggattgatcgactggagcatgtaaa

SEQ ID NO: 710899 - DNA, 1552 bp, Homo sapiens
ggacagctagaccctgtctcccaggctggagtgcaggggtgtgactgcaactcactgcactccagcctgggagacagggtctatgctgtcactcgtgccgacattcgccaccgagggcgcatcgcgaccatctaggagccgatactagtgactggccacgtcgttaaacgagagcgcgagacaaacatccgagagacgcagaggagggcacactcgaccggaacaagaggaggcgcgacaacgaccagagagcgacgcgacgaaaaacgagaaaaaacaggcagaagacggcgacagagaagagaaagagcagaagcacaagaaggccagcaaacgcgacgacccaagacgacaccgaagaacagacgaacaaaacagggaacacacacgcagacgagcacagaggagagcacacacacagaagagacagcgagcaaaaaaggcgagacagacacaaagccgaagagacaagaagaacaaagagggcaggcagacaggcgaacaggcggacacacaggcagagcaacaagcaacacgacgaggagagcggcggaagcggacaggagagagagacgaaaaggccaaaacggagaaagaaagagaaagcagaagaagaggagacaagaggatggaaagggacgaacagggaacgggcaccaggaggacagcggaaggcgaccagcagacccacagcccgaggagcgacacaaaaggagacacagggaggagcgagaggcgcgaagcagcggcgggagacacagcggaagggacggaggagagagacagacaggcagagcgagaacgagacaggcagggcagaagagagaccgaaaggcaggaaggcgcgcgaggaggaggagacggacagcgcgcgacggagaagccaagcgggaaaagaagacgaggaggaggacaggggagcaagagcagcgacacagagggcgaagagaggaggacggagccagcggaggagcagagagaagaagaccgaagagagggaaagacacgagcagaggcacgagaagagcgagaggagagcggaggcgacgaggcggagcacgcgcgagcggcaagcgagaaagagaaggagagacacggagcagagaccagagacaacagcgggaggcgaagcgagcgcacgacgaggggcgcgtgcagacggacgacggaagcgcaggcaaggcggaggagcggaggaggagagggaagcacggagcagggaggacaggagagaaagagagcgaggcggacgcacgaccaggacaaacgaaggacgcccgaggaacgagaaggaaggagagggcaggagccgccgagacccgcgccagaacagggaacgcagaggcagacgggaagccggacagacgacggaggagcgcaggggcagaagcgagaagccagcaagcagagcagggagagagacgacgcgccagcgagcaagaagaagcagacacggaggagagcaacggaggggagagtagcgaggagagcaagcgccagggaggaagcagcggcgacgcggagcagcacgacggagaggagcgaagcagcc

SEQ ID NO: 710900 - DNA, 212 bp, Homo sapiens
cttccaagtagctgggattacaagcgtctagcaccacacctggctaatttttgtatttgtaatagaggcgagattcaccatgtggcaggctgcgccgaactcctgacttcaagtgatttacccgccttggcctcccaaagttctgggattgcaggcatgagctaccactcccggctctagatcgcattttgaatattgaaccggatagcttg

SEQ ID NO: 710901 - DNA, 540 bp, Homo sapiens
  misc_feature (225)..(225): n is a, c, g, or t
tggctggggatgaggggaatacctgcagaaaagggagatgccaaaacagaccaggcacagaaagctgaaggtgctgggagatgccaagtgaagtgtgtgcatttttggataactggtgtacttctgggtgacggtacagtttggaaatactattttttattcaagttttattaaaaaggcagaatttggttttacttttttttttttttaaaaagctatgtggtnagcacacagaacacttcatggtggctcgggggggagggggcatatgtcactaatagaaggtctccaaagcgggatggagggggagaaaacacctttcccttctagtttggagagacttcctctgggctcccaggaggagggatccccggacttggacacacagggccacctgggcacaaaagcctgggggtatagaaaaacaaatgggttttaatgtcctcttctccctttccatctttcagcatagacttaattcccttaagcccagacttcggtggagaccggacccctagtcttgggttaccagggtgtcag

SEQ ID NO: 710902 - DNA, 243 bp, Homo sapiens
atctagaggatcccttgccagctctcaacgggctcgggccttcctcgggacacggctgggtcccacggccatgatgtgctagaatctgcggtaagaacaaggtgctagaatgaggcccagcaaccagcaaaggggtgggaaggggttgctacagccccagtggtgtgagatggtgccaagacgagtcttctgggggtcagcctatgatggagagcgtgaggggggtacggagctcgagatcgt

SEQ ID NO: 710903 - DNA, 484 bp, Homo sapiens
  misc_feature (82)..(82): n is a, c, g, or t
tcaatcacggttctcttggtatctgctacgatggactgataggtcatagggactctatgtctaacattctgaaaaactgacnaacgttttcaaagcagctgcccattttacactccccagcaatgtacgaagggcttccatatgtgaggttatccacattcccaatgtgtaagggtatcctcatcctcaccaacatttgttattatcttttttattcaaaccatcctagtgagtatgaaatggtatttcattgtggtttggggtttgcctttcctcttgtctaatgatgctaagcaccttttcaagtgcttattggccatttgtttatcttcttcagaaaggtatctattcaaataatttgcccattttaaaatcaggttgtcttggccaggcacggcggcccacacctgtaatcccagcactttgggaggtcgaggtgggcagatcacctgaagtcgggagcccgggaccaggccgaccaaca

SEQ ID NO: 710904 - DNA, 1305 bp, Homo sapiens
  misc_feature (9)..(9): n is a, c, g, or t
  misc_feature (100)..(100): n is a, c, g, or t
  misc_feature (304)..(304): n is a, c, g, or t
  misc_feature (335)..(335): n is a, c, g, or t
  misc_feature (371)..(372): n is a, c, g, or t
  misc_feature (381)..(381): n is a, c, g, or t
  misc_feature (443)..(443): n is a, c, g, or t
  misc_feature (453)..(453): n is a, c, g, or t
  misc_feature (460)..(460): n is a, c, g, or t
  misc_feature (468)..(472): n is a, c, g, or t
  misc_feature (478)..(478): n is a, c, g, or t
  misc_feature (481)..(483): n is a, c, g, or t
  misc_feature (487)..(487): n is a, c, g, or t
  misc_feature (489)..(489): n is a, c, g, or t
  misc_feature (497)..(497): n is a, c, g, or t
  misc_feature (692)..(692): n is a, c, g, or t
  misc_feature (832)..(832): n is a, c, g, or t
  misc_feature (847)..(847): n is a, c, g, or t
gcaaatttnttttttattttaaaaaattctttgaaactctaaagtctttgtgtctgcaatgaaattgtactccttgacagttgatagattatatattctnccacccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaanattttaagattctgaatgtcgatggagtctnactgaagagtcaccaaaggtgcctgccccccccccnngctgggaantgtcagttggagactgtcccaagggcgctgaagaacccagtggcaggggttctggctgcttnccatctgagngtgggangggagggnnnnncatgancannnggananagcaatcnactctgagaaatggaacacaaggagttacctatcactttcacttataattccaaaagatgactacaaccatgtccatgctcagattcaaacagttttccatatcacttttgggtggtaagatgatttacagtttttttttttaattggcagcaccactaaccattccttacattctttttggtatgtgtggtttnctttttatttaacccgcagccgacatcgtagtttctggttttgttttgttttacagagctgttgcatgacttatgttaccatcctaaaaaacactatattaaacatggaataaatggtctttttatgaattaggcttttngaacatcctggtgtngggattttttggtttttcaattggcaacaaaagctctgtagggctgcagacatttaaagttcacataatcatctgtaagacattatgtattttgtggaaatactagaatttttttcctgattttgccattatatggatttgctatttttggattaatgcaaaagtatatgactttgtgttttatgtgatacaccataaatattcaacggtgttgaatactaacagtgctgactacatattgcctgtgtgttcgcagagaaagatggtttctaataaagagtaggaaagcgtgaaattacacagtacgagtctcctttaaatgcacgtttgtgggggaatgggctctcaccaatatccttagacatacagtgtaagaacggtggaccgccacatatgagtccaacagaagtcaccatgttccccattagacaccggggccacaaagcggggggaccccc

SEQ ID NO: 710905 - DNA, 235 bp, Homo sapiens
acgagcccggccggccgccgggggaagcccgcggaggagacgcggggccgggcgagaaggtccggagagcggggggcacctgagcccgggcgggcccgccgcgctgagcggcgctgagagccgcggcggagcagcgaaggcggccggccgaccccgcgcgcccggaacaggaggcgcggcgcccgagcggcccgggcgagacaaaggcgccgggtcggagccctgcccgcggccg

SEQ ID NO: 710906 - DNA, 100 bp, Homo sapiens
aaaatttttgggtccccccggttttagggaaagggtccccccccctttcccggaaattttttccccccctttttttccccccaaaaaagggggcccttta

SEQ ID NO: 710907 - DNA, 857 bp, Homo sapiens
  misc_feature (9)..(9): n is a, c, g, or t
  misc_feature (100)..(100): n is a, c, g, or t
  misc_feature (304)..(304): n is a, c, g, or t
  misc_feature (335)..(335): n is a, c, g, or t
  misc_feature (371)..(372): n is a, c, g, or t
  misc_feature (381)..(381): n is a, c, g, or t
  misc_feature (443)..(443): n is a, c, g, or t
  misc_feature (453)..(453): n is a, c, g, or t
  misc_feature (460)..(460): n is a, c, g, or t
  misc_feature (468)..(472): n is a, c, g, or t
  misc_feature (478)..(478): n is a, c, g, or t
  misc_feature (481)..(483): n is a, c, g, or t
  misc_feature (487)..(487): n is a, c, g, or t
  misc_feature (489)..(489): n is a, c, g, or t
  misc_feature (497)..(497): n is a, c, g, or t
  misc_feature (692)..(692): n is a, c, g, or t
gcaaatttnttttttattttaaaaaattctttgaaactctaaagtctttgtgtctgcaatgaaattgtactccttgacagttgatagattatatattctnccacccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaanattttaagattctgaatgtcgatggagtctnactgaagagtcaccaaaggtgcctgccccccccccnngctgggaantgtcagttggagactgtcccaagggcgctgaagaacccagtggcaggggttctggctgcttnccatctgagngtgggangggagggnnnnncatgancannnggananagcaatcnactctgagaaatggaacacaaggagttacctatcactttcacttataattccaaaagatgactacaaccatgtccatgctcagattcaaacagttttccatatcacttttgggtggtaagatgatttacagtttttttttttaattggcagcaccactaaccattccttacattctttttggtatgtgtggtttnctttttatttaacccgcagccgacatcgtagtttctggttttgtttaagggctttgatactatgaacatccaaagacaattaacatggtaattgctttatgatagctttgacacgctggatattgttcatgacaagcgagctcagcattagtcatatactgagat

SEQ ID NO: 710908 - DNA, 1501 bp, Homo sapiens
  misc_feature (9)..(9): n is a, c, g, or t
  misc_feature (100)..(100): n is a, c, g, or t
  misc_feature (304)..(304): n is a, c, g, or t
  misc_feature (335)..(335): n is a, c, g, or t
  misc_feature (371)..(372): n is a, c, g, or t
  misc_feature (381)..(381): n is a, c, g, or t
  misc_feature (443)..(443): n is a, c, g, or t
  misc_feature (453)..(453): n is a, c, g, or t
  misc_feature (460)..(460): n is a, c, g, or t
  misc_feature (468)..(472): n is a, c, g, or t
  misc_feature (478)..(478): n is a, c, g, or t
  misc_feature (481)..(483): n is a, c, g, or t
  misc_feature (487)..(487): n is a, c, g, or t
  misc_feature (489)..(489): n is a, c, g, or t
  misc_feature (497)..(497): n is a, c, g, or t
  misc_feature (692)..(692): n is a, c, g, or t
  misc_feature (832)..(832): n is a, c, g, or t
  misc_feature (847)..(847): n is a, c, g, or t
gcaaatttnttttttattttaaaaaattctttgaaactctaaagtctttgtgtctgcaatgaaattgtactccttgacagttgatagattatatattctnccacccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaanattttaagattctgaatgtcgatggagtctnactgaagagtcaccaaaggtgcctgccccccccccnngctgggaantgtcagttggagactgtcccaagggcgctgaagaacccagtggcaggggttctggctgcttnccatctgagngtgggangggagggnnnnncatgancannnggananagcaatcnactctgagaaatggaacacaaggagttacctatcactttcacttataattccaaaagatgactacaaccatgtccatgctcagattcaaacagttttccatatcacttttgggtggtaagatgatttacagtttttttttttaattggcagcaccactaaccattccttacattctttttggtatgtgtggtttnctttttatttaacccgcagccgacatcgtagtttctggttttgttttgttttacagagctgttgcatgacttatgttaccatcctaaaaaacactatattaaacatggaataaatggtctttttatgaattaggcttttngaacatcctggtgtngggattttttggtttttcaattggcaacaaaagctctgtagggctgcagacatttaaagttcacataatcatctgtaagacattatgtattttgtggaaatactagaatttttttcctgattttgccattatatggatttgctatttttggattaatgcatactaacagcgctgactacaagaaggatgtagtgttttggctttctgcattacaacgtcttctggaggaagggagcaggatgggtttcatttgaatctagcgtgtgtcttaacatctttctaaatcggcggtggaactgcatagttcaacttcctgtctgtctccctcattatactcttccctccttggcttatgtttcggcttttgtgtataagagcatctttctttgcagcatcctaatcttgcttcagtttctgggggctcttttatcctgcttgaagatccggagtgtggaaggaggctagaaagtcttgggcagtatgtgagcagacctcttgctgaccagcccaaggatggtggtgcccacacctgtacttggggcatgccaacttgatacccctggcccatctttggagagccaacccatggaaaggtctggagccttttgctccccttctttcccggccatcctaccaggtaaagtaccttggttt

SEQ ID NO: 710909 - DNA, 133 bp, Homo sapiens
cacgaacacgatggtcttgctcagcttgcgttgcagttccagcagttcatcttgcaggccttggcggatcagcgggtcgagggccgagaagggttcgtccatcagcaggatatcggcatccatcgccaaggcg

SEQ ID NO: 710910 - DNA, 824 bp, Homo sapiens
gtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttacgaaaagataaagcaccagttttcatttactttataaaagagcaaagagttcagctcttcaacactagttgttgtgaacagtgtggtccacttcttcagtgtgttccaacatgttctcagacgaaagcctacatggtattgtaagtcattatgtttgccgtgtcataagaaaactcttagctgacaatggccgaaaactgtgagacatgctatggaagctgaatgccggacgctagcaccagtatactttgtccctttactaatcggctgatgttactctcacttgatgtggttaaaccatttcagaggtagaagaagacagacgcagtttgaatcatcgtgaaccttgtaagggctagggtatatctaggacttagtggtcctctgaaggctcaataggtcttctacttaagctggcaagttccattgaccttaactgcttaccccacataacctaacctactactgattctccctggaccatattacggaaactgggtcaaaagggccttggacgaacacatataaaaaaggggctcatcacagaacgtaccgtgagaagactaaacccagcaggaatcagtggcaaggagggaaagaacaagaggacaaaacatacaagggcagaacctacggaccaaagggtgaaaactaaga

SEQ ID NO: 710911 - DNA, 868 bp, Homo sapiens
caccctgtacctaatcctcaccaccccctccctgctttatcctgccaggagccttggggaaacagtctgtgacagaggattcactaaggacaagtctctcagttcaatctttaacattgaggtggtaaaagaaaaaactgcagaagaaataaaacagatttggcagcaatattttcgcagcaaaagatacagtctacgcagttattcctgcagaaaagtttgatttgatctggaaccgggctcattcctgcccaacagtacagtttctggtgatcacttcccggttgcttctcactgttgtccaccatgaacttttcacgcccatcacgtcatactccatactggctgaaatgagatagcagatctcgccgctcagtcactaggctctacatgttcgatctgttatacctaaactccaacatcttgagtggccttcgttgaccttcctcgatagcgcctttccgtccccctttctttaaagcgaggacttatttcctgaccctccgtcgctccccccaatcgtctgcgtaggcaatgccaccatcaacgtctatcaacacgcatgtcacgcgcaaggggagttaccttccacacaccccattgtggccgctgaaccaccatcatctctctcccccaagtccgttgctcccccctcccccctcactttccgcttcccacgttatgttcttccaattcttcccccctctttcactatactactcctccgcttccacctcccaacactcgaccacgcttaccccccccccgcccctcctctcgttactttccccccggcgcagtggggatccggtgtcccctattaccgcagatcgccgctctcacccgcacttaagtactagcactctgg

SEQ ID NO: 710912 - DNA, 812 bp, Homo sapiens
tcgcccctagctgtctcctactcaccgcaagagccccgcacccgccttttgctctctctcctctggcaggatgaggcgtgcaacgcctgggtgaaggagtaccatcctggcaactatgggaactatggttatgctagtacgtggggtatagtgcctgtgaacgaccagaaccatcgagaggtctcactgaaagtctgagaagcaacagtaactgctataaaatctctttccagtgagactaggccatgaagttaaaatccagaatagattatcagctgaaatggattcacaatttgattcctacaactggatttctaggtgaaactataggccaactgaagatttgatccagagggagcccaacaaaagctgctgtgctatatgatgctgttttcttcatttgtcttttttatcatttcttgccattgattacgcctgaggtgatgcggtgtaaattgtgaatccggaatgggttccaacttaatggcttgcaggtaccactttgataaccagctcagcatcaaaaggttcctagtgtttcaaaatactgtggcgtttccatggaaaatgctgagtttggcttattctataaatcacattagttgaatacagagacttgaacaagaggcaaataagacttccaaaaaacaattgttcgccggccggcgccctgaaaagttttttcaccctcgttgggcgccggcccaagaagggatcgtggcttcccttcaagaaatccggcccaagggggggcccccaaaaaccgcggcccgccttcacacacaagggctgggcccggcaaacggcccgca

SEQ ID NO: 710913 - DNA, 1702 bp, Homo sapiens
  misc_feature (124)..(124): n is a, c, g, or t
  misc_feature (553)..(553): n is a, c, g, or t
  misc_feature (621)..(621): n is a, c, g, or t
  misc_feature (632)..(632): n is a, c, g, or t
gctttctgtgtcgtcgaggtgcgtcgtgtttgtctgcaccgctcgtttctttgctcgcgcgtggtgtggatgtggtatgtctgtgccgtcttactcttatcttgtgggatgccctcgcctgtgncgtcgctgcctcctctccttagagtggggtgggtcctcggtgggcaatcttcttctccctcgattgggtcctctgtgtgtcgcctgcagcagatcgaccgtgcggttgttttttttcggggggccggacgctcacacacccccttgttgttgttgtccgggcgggccactttgggttgtggtcaccgcaggaggatcctctcgaagccaggggggtgttgttctctcctcccgtccacctggcgggttgctcctctcctctgttcgccctcttgtggtgggtggtttcctcagaggttgtgcttgttttgcgcgctcctccctctctctccgcgtggggtggtcgcatatgatttatttcctccccgcggcgttgtgtgtgataattatcatcgttgggggggccatcacaactacatgcgcgtggggnccgcatcatcaacatctgggggtggtccacaactcgtctgctccgacgcgccgcagagtattggtggnggagatttttngccatcacactcccacgggggttgtttgcttcttgcctcggtgtttcttttgggggcaccctcctctcctcatcttgtgttggtgcgtctcccctcccgccacaatattggtgtgtcttttgtattatcttcgggagctgcttcctcgtcccgcgaggagatggcgcggtagtggcccatctgttttgtcgtgtcgcaacactcgggggggtattatattttgtagagaagatatagtagagaaatatggtggtggcggccccctcgggggcgctatatgggccccatcccacgctctctctctcggtcgtatagcctctccctctcgcgcaatcttctcgcgagaatatatagctcctctctcgcgagaagtagagaagatattgtgtgtctccctctcgagagagagcctcttgtggatatgtcttgagatgatatatccgcacactctcgtcgagatagtggtatagagacactctgtctgtgttctgcgagtgttgtggggcccctctctgtgtgtttgagagagtgttacactctgtgtgtccccctctcgggtgattgtatacacgcgcgtgctcacgcgggctgtgagagtgtgtgttttcgggagtgttgtctctctatagagagggtggggcccacgagacacaccgcagttggtgtgtgtggtgtctcttgacggggaggtctctgtctccagaggtgtggggaaaatgtccccacaccctgtgaggcgccccctgtgttcctctctgtctgtgtagcgtgggagagtgtctcttggcgcgccagagcacacccctgcgggcgtggtgtgtactcttgctttgggagtgggacaccggtgttcgccatttacaccccgtgaaataggatctccattctttaatattatattgaagagtgtttttttgtacacgcccatatttctgaatatttttgtaaaagaatagcacccaccccaatttgggttttttaccggtaaggggggcaccctgggcccccccccccccccccttgggtaagggaaaaaaaaagggcgccccgaaccccacaaaaaaaaaaaa

SEQ ID NO: 710914 - DNA, 114 bp, Homo sapiens
ttgcattgtagcggcttgcttgtacccttgcattctaccgggaagtacgtacacggggtatgtgccatgcatcctcgtgctgacctgaacagccggggagcggttcccgcgctc

SEQ ID NO: 710915 - DNA, 894 bp, Homo sapiens
tgcggtggctcatgcctgtaatcccagcactctgggaggccgaggtgggcagatcacctgaggtcaggagttcaagaccaccctgggcaacatggcaaaactccgtctccacaaaaaatacaaaacttagccgcgtgtggtggcaggcacctgtaatcccagctactcgggaggctgcggcaggagaatcgcttgaacctgggaggcagaggttgcagtgagccaagatcgcaccactgcactccagcctgggtgacgaagcaagactccatctcaaaaaaaaaaaaattttgaaccagttggggataatttgattttgaaaattggtttaagatactttctaaggaattatagcagttacactctaaatggtgaggctatggatgctttaatctcccggactatatttctaatgtcctaagataaacgtatggttttaaatatcacaaattatttttcgaaaaaatttttgacacctagaaaacattaaaaagttatatattcttaaaagattttctaaacagtggtacttttaaattactcctcctcaaaaaattagttactttagcaaacttgaccaagtgatagacgaacaaaatacagggtcttgacgaccggtgttcatttaattgcttactaacacttaggtcagtcaaaccctcgcattggacgatggctaaacccggcgaaagtagctgcaggagcgaaataaggccgggcaccgaccggggacaccggggaccgtgtctcaaatatactatacagcagataagaagttcccatagtgctttcaccgagtactaaggtggccgtagaaatataaaaaaagtgtgggccgccgataaattacactgtgccccgagaaagatataccgacgagaagagatacacagg

SEQ ID NO: 710916 - DNA, 335 bp, Homo sapiens
  misc_feature (25)..(25): n is a, c, g, or t
gagacagagtttctctcttgttgcncaggctggagtgcagtgacataatctcagctcactgcaacctctgcctccctggttcaagtgattctcctgccttcgcctcctgagtagctgggattacaagcacccaccaccacgcccgactaaactttgtatttttcagtaaagacagggtttcaccatcttggccaggctgatctcgaactcatgacctcaggtgatacacccgcctcagcctcccaaagtgctgggattacaggcgtgagccaccgcgcccggccccttttcatctctttggggtgctgatgaggcagggactcaggaagaagcct

SEQ ID NO: 710917 - DNA, 379 bp, Homo sapiens
aagacggagtttcacttttgttgcccaggctggagtgcaatggtgcgatctcggctcaccacaactccacctcccgggttcaagcgattctcctgcctcagcctctcgagtagctgggattacaggcatgtaccaccatgcccagctatttttgtatttttagtagagatggggtttctgcatgttggtcaggctggtctcgaactcccgacctcaggtaatccacccgccttggcctcccaaagggctgggattacaggtgtgagccactgcacctggccgaaaacggctgttttaacctgcccagctgggtgtaagtttgaacagagtgaaaatgtgattgggagcataggcagcttctcttatcccctcttccctc

SEQ ID NO: 710918 - DNA, 457 bp, Homo sapiens
gaggatcccccgagaggagaggacttggctgactggtgcaagcgagtttcctgcgcagcagcatccatgtcaacatcactgcgagagcggagcacgttctctgcctttcaagaccgtttcatctcttaccggccctagaggctttcagagcggtccacgcgaatctatgagcgtgaactgtcactctgcagcaggtgctcaggaaagctactggtcaagagtcgcagtgtcccaggctctggggcatcatactgctggttgatctcaaagcagctgaatgatgctcctcacattgcctggtttgacttccacacgggacaaggggatatgaaatgtgctttgagaagagcttactggcttcccaatgtatttgaagatagggttgccatttttgtcctctatgcgttccaaacgcagagaggagcagcaagcatgattatgactttcttggttaacg

SEQ ID NO: 710919 - DNA, 611 bp, Homo sapiens
tactgggaaaaggaccaattgcaagggctagtctttactggaaaaaaaaaattttacagcaccatttggagtaattaagtgcagggtgccacatgtgtgccagctgttgggggcaccagtttgtacatggggctccacagcggggcgacatcgctgggcctcgcctttgtgcagccaaaaccaggacagccgctggtatggtcctcttacaaagactgcgccatactattctctggttggagaaactggaggggagaccataacactaggggtctaccccgtggtgcccctagaaggctccctttgtggggggccacttcggagaccacgacggacgaccacacactgcgccctgagcggcaactgccggggagacttgtcaacgcggggcccgcacccgaaaactaccacgtggacccacggggaggaccccgcgagggatggacagccctcggaacaacacaaggccccttgtgccgcccgagctcggaaaaaatcccttcttccccagccttcgcctttccctatcaccaaacaccgagtactcgggagattacaaggggtccaaataggtgactctttcgcacggtgtaaagttttccccgaggctc

SEQ ID NO: 710920 - DNA, 476 bp, Homo sapiens
gtggctgaacctcggagcagttgtgccctgcctaatgagctttttactgagacttgcaacaccccagtcactctggaagtcatcaatggggaagaaatggagggaaccttggtgttctcctttcccacaaggaaaatcaggtgcacatacaacctatgaggagacatggagggtcttgctgtcacccaggctgaagcggcatgaacatagcttactgaagccttgatctccggggctccagtgatcctcctgcttcagcctctcaagtagcggagactacaggtgtcagaggcatgtgaacgacaacaactccatcctgaataggaactgggtaaaacgaggttgaaacctgtgagctgcattcccatacagttaaggcattttaagtcacagcgtgttgggaattggtgggttcttggtctcactgacttcaagaatgaaaccgcagatccttgcggtgagtgttacagttcaaa

SEQ ID NO: 710921 - DNA, 319 bp, Homo sapiens
gtctgggctgatctgcttggggctaagagatgaagagagaagccagacaatagtccaaggccctctgctttaggtctttcttctaaattctgattctttaatttttttttttttggttaattttaatttttttttggtaaagatgggttctccctattttgcccacaagggtcttgaactccccgtttcaagtgatcctcccaccgtggcctttcaaagtgcggggactacaggcttgagccattgcacccagcctgaacttgcatactttctggtcatcttttggctacccgtgtttaacaagaagatgaggcccacg

SEQ ID NO: 710922 - DNA, 306 bp, Homo sapiens
tatctattcacaagatgacggccaatatgacgaacagctatagatattaaggcatgtgctataggttgtctttgttgacatatgaaaaatgctttagatggataagattctgaatatagttggattagtcacagctgaatcctgttgtgataagatgagttctacaaattgaaagctttgaaaagctactactttgacttctaatacatccagatgaacacgatgtagcaatatcagcttggttaggtctacctggccaggtagacctaactgctggcagggagatttttcagaagcatccacact

SEQ ID NO: 710923 - DNA, 902 bp, Homo sapiens
ttccagacagctgcagcggacgcttgcagaggagcagcacaagaaccagctgctgcagtgaggagctggaggcactgcagctgcagctgcgtgccctggagcaggagaccagagactggggtgtgcatgtgagtacgtggtcacagggagggtcctgctgcatctgagcctgacatgtggccccagtgcgggatgaggtcttgcagctgcgcgggaggagctggaggcacttgagggcggccagaaggggctgcccggggaaggccgcagggtgctcctcctgcagcagcggttgttggcctgccctgtgctttgagaccaggaacgagcctgggctgcagtgcacgcaaggtcacagatcgaacacgaggttggttgaaacttgcagaattgacccccagtctgtgaggcaagaggtaccaagccaggcttgcaaggcagggaccacacagcgccaggaccaagctcaggggagaaggccccgtgcaggtgcagctgacgctttgagcctttccctcccagtggaccacaaggcctcaccagaaggtgcttgcagacagcggacgccggggcccattgggcccgtgggggtcgcgggattccacccggtcggcgggcgggttgcctcaccgggcttgcgagtacaggggatcctgtgggcccgccccgcaggcagtggcgaggtgcttcaggcggattcttcgcgccggcccgagatattgctctgaccgatgcgcttgcacagggctcggcggctaggcccagcatgggcagcaacgcacggcggcttggtcccgtgggcgctatttgcgcctctggacgcgacggacgacccggcccacggtgtgtggctcccgggggccagcggtgcgggagcaccggtcgggccgaccccccggcgg

SEQ ID NO: 710924 - DNA, 119 bp, Homo sapiens
gattaaatcacacactggcatatttaagctcgaaggtcagtctcggacaataaatttactatatttgcctgacgtaccactctttgtgtaggtatttgtcatatatttacggcaagcta

SEQ ID NO: 710925 - DNA, 220 bp, Homo sapiens
  misc_feature (64)..(64): n is a, c, g, or t
  misc_feature (67)..(67): n is a, c, g, or t
  misc_feature (94)..(94): n is a, c, g, or t
  misc_feature (103)..(103): n is a, c, g, or t
  misc_feature (190)..(190): n is a, c, g, or t
tttgtaaataaagttttattggaacaccagccacactcattcgtgttcatgtagtgtctgtggnagnttttacattacaacagcagggctgagnatttgcagnagaggatatatggcctgcaaagccttaaaatcttcactttctacccctttacaaaaaagtttgccaattcctgctagagaagagatnacatacaactaaggacttaaacgagtgatc

SEQ ID NO: 710926 - DNA, 937 bp, Homo sapiens
gtctgtattccgtcaagtaggactcagactgtagaatgcgtgtagtcgcgctcctagtgagagtgccactccatggtgctaccgtgttgcagggctcaaaagagtgctgacaagtgttatgcgtgcagctcgctaatctaaactctatgcttcaggatacatgcacgacacaatagatcgccaggattcagaagtgttggcatctatgtcaccctctttgcaatgtgctgcgcattagaaccgctgtatcatttggcttccgagtgagatatatgaatccttgtccttaaatcgatgctagaaagaagatctcattcctcataaaacatagagtcgcccaattaacatagtgggtcggtgtcatgctattaggtaggatgagtatgcactcgggctatgatgtgtctccacttaggaaatggtcactcgacagttggaggtcttggacgataccggatgcaccccctggtttctaacattgtccattggtccgaacgtgaacctgcattcgatcttgctcccgctgaccctcattgctaactacaaagatgtatataaatatctacgcgattcgtgagcgagaatctttgaaagaacactcaatttgtattcgcgagaggattttaaaatactctgaaataaatcttaaatgaacagtaacagtgatagaactactcacattaagcaatgtacaacacgtgaccaccattgatcggaaataacttgatgacgatgatttatagaggatccaccataccaattgaaaaaccgaagggaaacgtgatcgtatactacactagtgagctggtattaaagatcccctagggttacaaaaatccacttataccccttgcggggggcaggattagcttactcttaaggaaggcaaaggttcctaccgggaaccgcagtagcatccccaccaaggattgagacc

SEQ ID NO: 710927 - DNA, 186 bp, Homo sapiens
ctgaggcctatggtgaaaaaggaaacatcttcagcccctaacaaaaagaagctttctgtgaaactgctttgggaagtatgcattcccttcccaaaggtaaactttcctttgggttcagcagtctggaagccctgtttttgtacattctatgaataaacatttaggaactccctgaggcgaatggca

SEQ ID NO: 710928 - DNA, 383 bp, Homo sapiens
aatgaaaacagactaagtgttccagttaaaagacagacattgtcagagtgggttgaaaacaaccaaattcagcggtagggttgtgaacgtgtgcagcggtaagcacaggaatattccaaccgcagggtgaagatggacaccaaacggccgtgcatcagttcacattgcatttttctgtcaaacagcaaacttacctcggatttgggaatgtggttgtgtggacgcctgttgcgtgcagccgtgagcgtgagtctcatagacctgttcctgagtgaaagaggcaaaaaggtgacaaaattattcatgccatgtggctttgttcagagttcaaaagcatgcagaagtaaacaagatattgccaatattcattaaagtataatttg

SEQ ID NO: 710929 - DNA, 127 bp, Homo sapiens
acaattgtggtagttacaaactgcgataacgctgctgctatgatgtggggcaagatgatattattggaactggcaaggaggaaggttgttggcatccttttagaaaatagatttttttcggagtctt

SEQ ID NO: 710930 - DNA, 1383 bp, Homo sapiens
  misc_feature (1257)..(1257): n is a, c, g, or t
gcgttttatgctgccaggcgagctcgaaggaccactggtgccccgcgcccggttcggcgctggccaacactagcctaccaggggaaagcagagacagtgcacgtgcggtggggactaatagataagtgtagtcatagcgcatgcaggaaccgacgcggagaactgtttacggagtcgagagcatgagcagcactagtgatggacggtggccacgcatgggatgaacgctactgcttgctgatggcaatggtagggtgatatctgagttacatacttacgctatcgagggagattatttgtctaatggttgacattatctaataaatgatagctggcgatgaccacgtagagtgttgatactagtgtagtgcgattgcacgttgatgccattgtgaattggggaccaaacggcagggcgccgccctgatggaaaaggatactggcaggcaatgcactgtggctgccaaggaaacttacctaggtaggggataacaccccattatgaatgaacggggcaagttgtgaaggcagctatcaattctcgtcacacttgccatgcgtactggtaactaccgttttcctgcgcattatagcgggcggcttgggagtcgcgcacaataggtagcatttccgaacaagagggcgacgccatggaagccaatagttgggtctccttccatttagtccgctttgtaaaggaaacttggtacaaaagtgaacgactatcaacaatgacttcgggttttccaactaatgcgcccttggaagcgtggtttcgaccgcggcaacgaaggttggactcgtagcgagaggcaccccggggggcaaatgtggacccgattttcaaagggtcctagcatggttatcacgtacgagtaccccagagaagtacaaagtgctttccaaggtaaaacttggagaggggggacatacaacggggaagaccatgtgcaagaggccgaagacacatgggtttcctttaactccacaaaatggaagcgggatttccataggggaagcgccattataaaaattattcccaatcgttggatcgcaattggctacaccgtttgggtggaccgttaccttctctttgcgatgggcttccccccccagggggaggcaagaagcgccctggtgccaccgtccttggggaccagagaaaacctttgccccatttttcggagggtcgcacaagaccgctgagcttgtggtggcgtaacaggcgtctgcggaagtgttgatcattgttacgtnttgagaggggagcggcgcacatgtgcgccgacacaagcgcaggttgtgcgcgaaacacaatagctgcatcatgctcaaccgaggagaggaacgcacattctcgtggcagcaacgcgcggagaacaa

SEQ ID NO: 710931 - DNA, 988 bp, Homo sapiens
gactgacctggagttgaacgtaaagaagcctatatgctacgtataaattctataaggtgtccagttatgctaatctctaggaactgtagtatctgcttgagtactatcccaaagtctattcgataagtcttcccgcagaatcatgctgactctagtttatcatgcatataccttgcacatgtaacaaaaattctcaaattactataccgcgtccctcaacagatttgacatttcacaattgcgacttgcgtgtaccatatagatagacataggcctaaatcgagtcactatcgaccgtgtagatcttagaggaatagactagataggaaagagtgagtcggattggcgcaagcagtatgaaatcattccaacgtatgtatttacgtgaaagggtcactattgggctcgactgagaaagtgaacattcccactttgcgctcgaatttccagcgcttggaaaccatactggacactagaggcgtccaggggcacgatggggcattaagcgaaacgcaccaattaccacatattctcagcaaagcctcccgtttgcgctctttgtcgcattgaaattattatcaacatcgcacgaacgtttcggtgatatttatgaatgggagagctcaatgagcgaggtagaatcgaaagcgtatagggtaaagagagtttctacaaagcgcgccaattggtaattttcctaaaatggtggggagaagttgctgtgagattctcttggaaaatagaagaagttatgtgataagatacacagttaacttattcaggaaagagtagagacacacttgggaattaacattaattttttaagaaaatcttaggtttttaattaaaatagaggttggacataaggctttaaagtaattaaattccgcagtacccgttttcctttcttattaaagactataagtccatatttagtttttttctggcgaggaaggccaatttttttttttcccctttggaaagtaac

SEQ ID NO: 710932 - DNA, 871 bp, Homo sapiens
agtcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactggcgggacccagtttggcatgctcatcgctcacctgcaagacaaatttccagattatctaacagtttcacctcctatccggcggatcttcagggtctttctataaggaatctaatgacagaggatttgattactgaggacggaactttacaggacagcgagcatatcagctgtgcttagttctgctccagggctaaaaacaccagatacttacaaaaagcttgcgaagctctatctgtgatcgtctcccgcccaagagtctaacataaaatctatgatgcattggcacgtcctcctttcaatcagagacgaccgcgggacatccctctctatcaacgcataggatgacactgactcacctgtaacaacgcgacactcccgaacacgactacgcaaccgcatccagccgccacgcgccgcgactggacaggaccaagacaacccacatgggcgacctcacgggccacaagagagtggttaccaaatcagtccactccaagcccactaaggatcaaaccactagcagttggagcgctcacgtacgcgtcagtgaaacaaccatactagcaacccggacctagacacatcaaaacaacagcagcaaccaaaacctcgaccgcaccaacagccaccgacaacgaacaacgtacacgttgcacaaccaaacagcacaaccactgtaacacacacaaccaca

SEQ ID NO: 710933 - DNA, 566 bp, Homo sapiens
atgctttcctagcttacaaaaagttctatattgggttaaaaatcaatcaactttctgatatttccccttcgtgcaatggtatggtcataagaaaacagagctgaaaatggaaatctgcagtagttacagttgtcttgaatttctttcagtggccacatcatttccacagttttccaccatccgggaggaagcctggacatgtgcagcctatcgggcaaccggcacagacagtgtgctggcaaggagcttcagacacgccaagtggatggattaggatttgaactgcatatgaaacaggagacgggttctcatgtgagatcaaagatcatccaaagctgttcaagctctaagcgattctcaaatgttaccatttataaaaggtaaatagacctgttgaaggccaagttcagggcagatgtagagatcagtgtagtaaagggtatacatgaatgctggacttttagaatcctgggggcataaatagtgagaagctcgatgatagaaatacatgcacgagatgaatcaatcagcagaaagtgcatgctaaaaaaataaatgatataaaa

SEQ ID NO: 710934 - DNA, 262 bp, Homo sapiens
  misc_feature (192)..(192): n is a, c, g, or t
  misc_feature (209)..(209): n is a, c, g, or t
  misc_feature (226)..(226): n is a, c, g, or t
ctacaggaacagctatacaggaaacagctatacaggaacagctataccaggaaacagctataccaggaaacagctataccaggaaacagctataccaggaaacagcttataccaggaaacagctataccaggaaacagctataccaggaaacagctataccaggaaacagctcttaccaggaaacagctatnaccaggaaacagctatnaccaggaaacagctatnaccaggaaacagctattaccaggaaacagctgtgac

SEQ ID NO: 710935 - DNA, 911 bp, Homo sapiens
tcggaaaagtactcctcaagtggggtaacaacacgtcgccttgaacagcgtcggggtgatccacaccccgtggcccttttataagggggtgagaccactgtgttaaactgcgtagctatttcaggtgtagcaccccctgctatttatgctctagtttatgcccccggatgattatttgtaggaactaaacaaacaaaccatttaggggggggcttcgcctatactaagtgtgtagaacgaagaccttacagtgttaacgctccggagatactgtgggaccaatttctctcccctttattaatggggggcaaagacatggcccaaaaattagaagagctgttgataatcataatcttacaggaaaaatacaatgtggggaaaaacaatactatatttgcgagcattttaatatagcctatgggtgacacaaccacaacaggtcatgctaatcctcaccattgggaggtcttatatactccgcacggatgcaggtagccacgccaccccacgacaaccccgtgacacactgttttgtcccgtgaaacaacctcccgtagggagtgtctagaagaaccagggctccctaacaatatatctttttccagaccaggttctactttcccacgattccctcgtagacagcctccggccacaccccccaagtagagcaaaacctcataaatagtataccggaattatctggggccaaaaaacttgggtttccagcagattcaataaaagagcaaagcagttatctaaagaaaccaaaaacatatgctggagcacaagaacaccacacaaaaggtgttagattataaccgctttgagagagagaataaaaaaggacgcaaccccgtttaaaccttgggaaaatgtgaaaatcattttaaaaaaaccaacttaccaaaaca

SEQ ID NO: 710936 - DNA, 129 bp, Homo sapiens
  misc_feature (64)..(64): n is a, c, g, or t
  misc_feature (86)..(86): n is a, c, g, or t
gatctatgtggtgaaaatgcacaggagcttggtagactgcggggaaagagagagctcctttcgncatgttttaccagtcgtggtgntataaccccgttaggttgtattcctttaatttcccagcccttt

SEQ ID NO: 710937 - DNA, 696 bp, Homo sapiens
cggtgctgggctgagcgcagggagctgcttggcagtgccgaggagtcccaggacctccagatgccctgctggagaggaggcatgactgaaggcagcatggccccgtccaggcagtgcgaatgcatgggatgatgtcaagactgctacacggagctggatgaaggctgtcattgtcctggtggaacagcttctacaagatatagtgtctaagttccaggctggtcaagagcaagatcagcaagagcgatgcttcctgcgagatgctccaagtaaagagctagagccacaatgctgtcggacacagggaaccggacggctgcggatacatgctcatccagaatcctggatgtcaatcatgactgtggcgtcatcagacttcgatgagtacttggaccttgaatagagcgtggatcactcggccccatcgccaaactcatgcatgatgcaggatactggcgagagcagcagctagaagacccctgtggagccaacatccttccagggcaattgggctctgagtggccccaggccactgggatgcactgccaccaaggggcataccccgtcactcaatgcgatccgtgaccattcccaagggatcccatttcacccctactaattcacctgccaagaaacctatccgtctgtacacacttggcttgtaacctgggaaggtgcgcattaggtggaggtggc

SEQ ID NO: 710938 - DNA, 374 bp, Homo sapiens
ctgacctcctgtctcctttggaaagcaagtatcgatgcatatgagctatatgtgagtaacctatagggatactcgaattatagctgctatacatgagtggccattaattgattcgacattcttataacatcaatgctgtgctatgtatgtagagcgcatattactgatactgcgttacatttgattgacaatctctatgacgattacaacagatgaagatgtatgtatctgccaagatcgctgtgagctgtgattggtatgtgtaacccactagtgaggtgcaaatgtgattctgtgctttgatgccatcatgattggtggctaatggaggagctgaatatattgagacttagagcttttggagacttcggtcg

SEQ ID NO: 710939 - DNA, 611 bp, Homo sapiens
  misc_feature (4)..(4): n is a, c, g, or t
  misc_feature (93)..(93): n is a, c, g, or t
  misc_feature (142)..(142): n is a, c, g, or t
  misc_feature (157)..(157): n is a, c, g, or t
  misc_feature (285)..(285): n is a, c, g, or t
  misc_feature (296)..(296): n is a, c, g, or t
  misc_feature (316)..(316): n is a, c, g, or t
  misc_feature (319)..(319): n is a, c, g, or t
  misc_feature (336)..(336): n is a, c, g, or t
  misc_feature (356)..(356): n is a, c, g, or t
  misc_feature (363)..(363): n is a, c, g, or t
  misc_feature (376)..(377): n is a, c, g, or t
  misc_feature (380)..(380): n is a, c, g, or t
  misc_feature (383)..(383): n is a, c, g, or t
  misc_feature (476)..(476): n is a, c, g, or t
  misc_feature (517)..(517): n is a, c, g, or t
  misc_feature (521)..(521): n is a, c, g, or t
  misc_feature (523)..(523): n is a, c, g, or t
  misc_feature (534)..(534): n is a, c, g, or t
cttnaaacaaagtacataagcaaaaataaataatttacaccaacccactaacctaattttcagagtaaagccatttccaattacagtactgtnatcccgggcaccagcctgtggttaaactttgatgattcattatttttanaaaacagtaataaanattgaatactaagcaaaatctttaacaaaaccactggatttaactttttaattttaaataaccaaattttataattttgtacataattcaatgtaatgccaatataattagcatttcagccttgacgngctggtttttnacagggatgggggactatanatnattcagacagtctgcgnaccatgagatacaaataagnatgggcnagcatatagtagnncanaanccgcagacactctactaactggggaaatatctgaaggctttacacctttattatccataatggctttggattacgattgtgtgacatataganctttgatattttagatacagctttatttttttttcacgggnagtnanaatccatcatnagactccataagacttttactagtcttgcatgtagactctaggagtttgtgatctgataaagagtacatgaaattta

SEQ ID NO: 710940 - DNA, 379 bp, Homo sapiens
gccctgtgagttagaacatacaatggacatatagattacacatcaagaaatataaaaatagaatggtggaaaatcgagacagatatcataacaaaaacaacgaagcacacacttattatactaatttattcatcactcaaccaaacaacatcctataaatacaatccacaacgaaaacacaaatcaacagcttacaaatacacaaaaaactcatacatcacgactcacacttaaaaaaataacaaaacacaaaaacatacaccacctcaccaccaaacaacatacaattaaacaccacaaaatctcattcaaaataactctcacaatatctacaaacacaacaaactaaatatttacataactcaactacaaactaaac

SEQ ID NO: 710941 - DNA, 227 bp, Homo sapiens
ccccccacgccctcagtccagctcaattttaaaactctccacacttcacaaatacataagtgcagttgtacagagggtcaccgttctcactacaatatcaattgcaactcaacatgtgactccagtcgccaaggagcttaattatgatctagacactcatacgtctactgggaggatcaaggcagctgaaaagaaggaagcgcgtaatgcagacagccacacaaaaa

SEQ ID NO: 710942 - DNA, 427 bp, Homo sapiens
atacctagggtcttagggagaggatctccctctactctcacttgattcaacgtgtggttgaattgtctggagcactgggacattttttctcttttccttatgggagccacagtgcaatgcaatctcgccatttaactttcaggtcgatatccctttcctgatcagacatctttgtgccccctttgggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgacttcaagatccaaggtaacgattgccttcagatctgattgtttgggctcaaggacttatcccctacaatattctccctaagacccta

SEQ ID NO: 710943 - DNA, 536 bp, Homo sapiens
  misc_feature (279)..(279): n is a, c, g, or t
  misc_feature (363)..(363): n is a, c, g, or t
tgggttaatctagaggatccctggcccggctctctaccttgacctcagtgatccacccacctcggcctcccaaggtgcggggatcacgggcgtgagccgccggccagccgaaaccatcaattttaactccagagaaagggctgaggtcagatgctcgaggctggctcgggccgactccggctgcaggaaattggataacccaaccttaggtaaaaaggagtcccggccgtgtatctctgagggtggagacacccagccagttcaggagccagtcccaangctcactcgggagtgttgccaagttctctgaaaccagggaggggggggaggtgttgtggtgattggggtctgaagaccccctgnccggggcccttgggtgagagaaggatttctgagaattggatgatctccggcccgagcaggtggttttggctcagcgtgctctaagttcggacaggcctgtacatgtccaggcgtcggtgcatgcctcttcctttcatttatccaaccagcccatataacgcccggatatggac

SEQ ID NO: 710944 - DNA, 610 bp, Homo sapiens
  misc_feature (5)..(5): n is a, c, g, or t
  misc_feature (40)..(40): n is a, c, g, or t
  misc_feature (78)..(78): n is a, c, g, or t
  misc_feature (125)..(125): n is a, c, g, or t
  misc_feature (470)..(472): n is a, c, g, or t
  misc_feature (504)..(505): n is a, c, g, or t
  misc_feature (567)..(567): n is a, c, g, or t
  misc_feature (603)..(603): n is a, c, g, or t
tctgnatgacacgggctcaagacacagtctggataagacntaacgtcctaacctcaattgtattaaatagcattgggnaatagctaaaccttttaaaaaaatttattggattttcctccctgctnaaaaatttcaccagaaaaccttcatataaaaattcagccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggaacgctgcagctctctccagccctgttggcatcctcagtgcctgcaggcctctcgctgcctgttgggctgtctggggggtggccatttagggatcgtggggacgggcctttctttcttcttggggtggaccccgtccccacgaagaaagaaaggcnnntccacaggcccggctctgggccacgtgccccnnaagcaggtgtgtccagagtcagctgagggctctccccacaccacccagcaggcgctggtgcnccttctgcctcatgggaccagtccagcttccagtcngctcttg

SEQ ID NO: 710945 - DNA, 512 bp, Homo sapiens
  misc_feature (27)..(27): n is a, c, g, or t
  misc_feature (276)..(276): n is a, c, g, or t
  misc_feature (284)..(284): n is a, c, g, or t
  misc_feature (338)..(338): n is a, c, g, or t
  misc_feature (379)..(379): n is a, c, g, or t
  misc_feature (397)..(397): n is a, c, g, or t
  misc_feature (405)..(405): n is a, c, g, or t
  misc_feature (506)..(506): n is a, c, g, or t
tcatgacagcaccatcttctcttgccngcgcctgggcctcctagtgtgctgcttacgtgatgcccacgtgccacagagttattgcccgaagtgccagtgggctgtgcaggggatgggctcttccttccagatggtctgcagcctctgggaccacgcagccaccatcccctttctttcttcttcggatgcaatttcaggagcaaagctgatctgaggggcaaggactttaaatccacagaagtgtaatgtgccatgttggagtggccacaggaagtntcgagaanccccatgactcctgtcttcgtgtacatctcgggccggggcctccccgtgggttnacagaaaggagcgctcagtttaccctggagcaaaccggaantcggagaaaccttgggantgtcaaanggcaaaagcccgtggcacacgcaccctaatcacactccagcccttcaggatggccggcacgctgaaccagtacagcgggaatgtgggcggcaaaacaaaanaaaatg

SEQ ID NO: 710946 - DNA, 193 bp, Homo sapiens
gctatcctagcacatactacgataagtagtacactagggctccaactcgagagtaataggtctataccagatcagggtctatcacgaagatctgcatacccacctactaagacggagcaccaagtgcagggtggactctatctaggatatagtagtcagacagggtgcgtccatctaccagctatataccagc

SEQ ID NO: 710947 - DNA, 279 bp, Homo sapiens
cccccccccccccccttttttccggggggggggggggggttccaaaccgtttgtttcccttgccccctttaattttgggggaaaaaacggggttttttaccccccctccgctcccccctccaaaggaagagggaattttttggggccccccctgggttttttttttggggggggcccgttttaggtttttgttttttaaacccggcccttttttgggggcccccctccccccaaatttttcccccgatttttggccccccctaaaaaggtttattggga

SEQ ID NO: 710948 - DNA, 182 bp, Homo sapiens
ggtcctgcgttcagaggatcccttcagcacattagtagagatagtttatggctatataacacaagtaaagtggtgttgggaaagttcctccattcatttgatttcctttagaaaagcgaattccaaggttgtgcacatttatccagtgaccacattacaagagattcaagtgaacatagata

SEQ ID NO: 710949 - DNA, 897 bp, Homo sapiens
  misc_feature (102)..(102): n is a, c, g, or t
  misc_feature (135)..(135): n is a, c, g, or t
  misc_feature (153)..(154): n is a, c, g, or t
  misc_feature (171)..(171): n is a, c, g, or t
  misc_feature (192)..(194): n is a, c, g, or t
  misc_feature (196)..(197): n is a, c, g, or t
  misc_feature (205)..(205): n is a, c, g, or t
  misc_feature (216)..(216): n is a, c, g, or t
  misc_feature (238)..(239): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (260)..(260): n is a, c, g, or t
  misc_feature (263)..(263): n is a, c, g, or t
  misc_feature (269)..(269): n is a, c, g, or t
  misc_feature (276)..(277): n is a, c, g, or t
  misc_feature (280)..(280): n is a, c, g, or t
  misc_feature (293)..(293): n is a, c, g, or t
  misc_feature (298)..(298): n is a, c, g, or t
  misc_feature (300)..(300): n is a, c, g, or t
  misc_feature (312)..(312): n is a, c, g, or t
  misc_feature (323)..(323): n is a, c, g, or t
  misc_feature (337)..(337): n is a, c, g, or t
  misc_feature (349)..(349): n is a, c, g, or t
  misc_feature (355)..(355): n is a, c, g, or t
  misc_feature (398)..(399): n is a, c, g, or t
  misc_feature (403)..(404): n is a, c, g, or t
  misc_feature (411)..(412): n is a, c, g, or t
  misc_feature (414)..(414): n is a, c, g, or t
  misc_feature (418)..(418): n is a, c, g, or t
  misc_feature (420)..(420): n is a, c, g, or t
  misc_feature (422)..(422): n is a, c, g, or t
  misc_feature (424)..(424): n is a, c, g, or t
  misc_feature (426)..(426): n is a, c, g, or t
  misc_feature (437)..(437): n is a, c, g, or t
  misc_feature (469)..(469): n is a, c, g, or t
  misc_feature (484)..(484): n is a, c, g, or t
  misc_feature (505)..(505): n is a, c, g, or t
  misc_feature (523)..(523): n is a, c, g, or t
  misc_feature (528)..(528): n is a, c, g, or t
  misc_feature (535)..(535): n is a, c, g, or t
  misc_feature (541)..(541): n is a, c, g, or t
  misc_feature (546)..(546): n is a, c, g, or t
  misc_feature (549)..(549): n is a, c, g, or t
  misc_feature (554)..(554): n is a, c, g, or t
  misc_feature (563)..(563): n is a, c, g, or t
  misc_feature (566)..(567): n is a, c, g, or t
  misc_feature (569)..(569): n is a, c, g, or t
  misc_feature (580)..(580): n is a, c, g, or t
  misc_feature (584)..(584): n is a, c, g, or t
  misc_feature (615)..(615): n is a, c, g, or t
  misc_feature (714)..(714): n is a, c, g, or t
  misc_feature (726)..(726): n is a, c, g, or t
  misc_feature (864)..(864): n is a, c, g, or t
tatattttatatgattttttatatttgtattaacatatggatagctttaaaattcacacaagaacaaaatgactataaaaatactcagaaatacagaatttnattggatatgattgcttattcaaataggtgatnatgtgaagatttaaattnnctatgattatttttaanaaaacagttattaatatattnnntnnctaagttnttgcttttttnttttactggttaatttataaannaatgganatntttacnatgtngtntctgtnttataannttnacaaaggcaacanatttngnacagttagtttntgttttttttnagcattttttaatncaaactttattnacttantattcttctttcttttattttttggctcatgttccataatttnngggnntcttttnngntttntntngngngtttttttttngtctcattttgttgatctttttggtgattttnttgtttttttttttnccattagttttttttctagtngttcttttcttctttttnttgtnctctttntacagngttcnttnttttnggtgtgttnttnntncagggctcttntttnttattatatggaatattggagtattataaanttgatgattactactcattcttaggaaccaagagcattatgagatttagttaaaaaaacttcacattcattgaaagtgaaatcaaatactgtacttttngtaatgtccaanacttcataactttctctccccttatataagtttagtaaagatgtattattttatatggactgaaatatctacagaaccttctcaaatgggatctggaaatttcattttaaaagactgtttttccacaacatgcgtttngtttaaaagtggggaaaaaaaactctgcagaag

SEQ ID NO: 710950 - DNA, 138 bp, Homo sapiens
taccacatttgaacagtatggagcttgcagatagaatatgacgatggtcagactgaggtccagagaggggaaggtactgacccaaagtcacacaaaaacgtggacttgaatgacgtcctggcctagtcctccggccta

SEQ ID NO: 710951 - DNA, 105 bp, Homo sapiens
ccaccctctacaacacggaagtcctgtttgtcacacctcagttacctcagggaaagtaagtgccgcccagtacccagggcttggagggaagcttggcatgagagc

SEQ ID NO: 710952 - DNA, 406 bp, Homo sapiens
tgggaccacagtctcaacaggcaaagttgttaacatcggatcattgacgtaatagggacatacagggttactatagacgtcttttatatgatgatagtgaatccctacatactgaattcccaaatgcatgtattttatttttgaatttgttttgtcttgagacatggtcttgctgtgttgtccagggtggagtacagtgacgcgatcctggctcactgagacttccacctcctgggttcaagcgaatctcccacctcaacctcccagagtgctgggactgcagacatgtgacaccatgcctggcttatttttgtatttttttggtagagatggggtttcagccatgttgcccaggctggtcttgaactcctgacctcaagtgatccacctgccacgatctcccaga

SEQ ID NO: 710953 - DNA, 170 bp, Homo sapiens
  misc_feature (118)..(118): n is a, c, g, or t
ctgcggaggtcgacctctagacggactccccccaacgacggaacggacgcaacgacctacgacactgactggacgtggactgttaacacggtctacgcctgactgacgacgtgttacnggtaccgttcacgtacctgtgctggtgtgacacttctacaacactttttact

SEQ ID NO: 710954 - DNA, 827 bp, Homo sapiens
  misc_feature (17)..(17): n is a, c, g, or t
  misc_feature (71)..(71): n is a, c, g, or t
  misc_feature (77)..(77): n is a, c, g, or t
  misc_feature (79)..(79): n is a, c, g, or t
  misc_feature (89)..(89): n is a, c, g, or t
  misc_feature (143)..(143): n is a, c, g, or t
  misc_feature (151)..(151): n is a, c, g, or t
  misc_feature (153)..(153): n is a, c, g, or t
  misc_feature (166)..(166): n is a, c, g, or t
  misc_feature (186)..(186): n is a, c, g, or t
  misc_feature (282)..(282): n is a, c, g, or t
  misc_feature (420)..(420): n is a, c, g, or t
  misc_feature (462)..(462): n is a, c, g, or t
  misc_feature (797)..(797): n is a, c, g, or t
tctgttttttttggttnttgtgtttacttagatgagacagacaaaggccctgcccccaaggtaacttacantctagnantaaaacagancatataaaagtgtattttcaatgacgtgtaacatagagttaagaaggaaatgcnaggggccntnggaacactgtgcngaaatatttaacttagtctngggggacagggaaggcttccccaaaggagaagtgtggatacctctgacagggcgagatttagcatggcctctcttggtgctatgtgttccttcatnatcggcttcacttccggcctcatctgccattttatagctcttgctttcaaatgtggagtctcctctgttgtaactcgtgctactagttatatttgttttctgtaacttgtaagatttatccatcgggtagggaattcngctatcccagggtgatgagaactggattcctttgtatttgtnaagatgccagattctgagcccctagactcagtctcactgacaaactctcctaacataggtgagaagaaacctgggaatgtttttccagttgaggcagtgtcgaagaaggcagcttcatcagggttgcctatggcggaacccatccaggagtacctatgccagacaatgtgcctaaatccattgcctcgggacagtcagaaccatcttcggaggtcaccacttctttggtaacttctttgtgaccatcaggaccaataacagtcttagtaacggttttagagcatgaacgacgcgtggtggttgtgctaccagaggtgaccttctctttaccagtnctgagctctttatctcctttagaagtgacc

SEQ ID NO: 710955 - DNA, 960 bp, Homo sapiens
tccctcggggttataacgcggtttcctcgcatcccgcccccttggggcggtctccccctcttcgctcggggcaaattattctcctcccgggtggttccaaattgttgccgcgcgtttcttttatctctgtggccgtggccccgtgtgttatcccccccgtcgggttacgtggcgttcctcgccctgtttccacgggcggcgaagttttccctttgtcgagttagcaacccacgaggtgtcgtgtcccgccaatcctgtctaccccagggagagcacgacaaccaggcgcgcccaaagggaggaacatatcttggggggcccccacaagaggcttccccccctctggggtagccattactggccgggcgccccacattcctcgtttccccgcggcccctccttctctaggcggttgtcccccccctcccgtgtgttcttccgggatgcgggccccaagcttttccggtgtttcccccacaggatccgcaccccgggtacccccgtgcttggagctctggggcgcgtccaccccttctcaggagagcgaatgctggcgggcgagacccccccccataggggtgggcaccccccctgatctgtctctttgactgctgtgtcttctctgtacaaatgctccactggagcacaccacgttgttcagccaggagtagtccaccaccccagtgtcggttttctgtttgcccagtcgactccacgccgcggtggcgtctttcacttccccctgaggaaaggggttccttcctcccttcccaccgtgccactacaaaaagtactgccttcaatcaagtgtggcggtccccagccgggcacgcaccgtggtggtacatacaagtgcgtgtgctccctgggggtcgacacgcgtactgcgcatcgtacggtgttgtcagagccaatccattcaaaacaaattgggccggcaataaaaaaacaaacaaaaca

SEQ ID NO: 710956 - DNA, 557 bp, Homo sapiens
ctgtaatggcctggccaggaggaatgactaccaactgggaggagaggggtcccagagggaggaggagaggagaggcccaagccttggctgctgtcagcactcaaaggcttaacccaaagagggcaggcctggggaacaagtagggatctgcacagcatgcaggctctatgccagacctgcagggagaggaggagcccagatccacatcgctggaggagaggatgcttctggaacaccccctctgcctctctggattacttatggtacaaaagctacctcctttgcagtcatttccatcctccccagaaccaagaagcacagtctcctgaccccacacatctttggggacctggcacaggatttctttcccctttttgcagcctccatgtaattcaaagcaatttcacctttttttctctctctctcagacagaatcttgctctgtcgcccaggctagagtgcagtggcgcgatcttggctcactgcaaccttcgcttctgggttcaagtgcttctcctccctcagcctcctgagtagctgggattacatgcatgcgc

SEQ ID NO: 710957 - DNA, 427 bp, Homo sapiens
aaaaccagacgcaagcggggattttttccaaagggaggccggccacctaagggcagaacccaacggtaaccctcaagacgggagttcagggaagacgagaaaaaggagcaggaaggaacaacgggcgggcaacagaagacccggggggaacggatgaacccaccaatcgaaagcagcaccgaaaggcagagaaacacccagaacccaagacaaaagactcccgggcgaacccacccaaaaaagcaatccccgccccaccagcgacacggaagcctaaacgggcccaaaacgggcgcttaaaccacaggaccggcacctcccatggagaagggacacacgacagaaaacgaacctggggggaccccgggggacacaaccgccgaaggccaaacgcaactcccctggcggacccaccactacgccgccc

SEQ ID NO: 710958 - DNA, 428 bp, Homo sapiens
  misc_feature (313)..(313): n is a, c, g, or t
  misc_feature (322)..(322): n is a, c, g, or t
  misc_feature (327)..(327): n is a, c, g, or t
  misc_feature (357)..(357): n is a, c, g, or t
  misc_feature (396)..(396): n is a, c, g, or t
  misc_feature (399)..(399): n is a, c, g, or t
ttagaggatcccagtcccttctctaaatttcttcctgagtattattcagcatccgctatgtgttggtatcacgtcaggcattagatatacgggaatctggaaatctgaaaatccaaggtctcagcttcaccgaccttagcaagaagacacagatgataaacacataaggaaatacataagaacgcttcaaacaagtgaaaaggtgctgtgataatggttaaacagggtgacaagacgggtaatgactggtgtggggtaggtaattaactgatcccagcattgagcaatgggaataaactagacagatattcanggatgcagngaaangcattccaggcagaggaatagtgtgtgcanatgccctgaggcaggaatgagctcgccctggtggctganacntattgatgagtgaactttacacgaagggc

SEQ ID NO: 710959 - DNA, 1715 bp, Homo sapiens
  misc_feature (1)..(1): n is a, c, g, or t
ngtttgtgtcttgtactggtgtgttttgcagcagtcaggctctagtgaggtggtggatggtcaggtagtgcagctcaggttgtggctactcggtgtatggtcgatttcttgtagttcggtttaccccgtgggcgtgcacttgtcgtctctgtgtgttgtgtcgcacttttttcttttttttttcgtcctcttagcgagctccttgtttttccttagtatagacgttgcggggtggagggtgtgagttagtcagcttgtgcgccgcttccgggtgagtccgggtgggtggtagtcgtctagcgatagctgttttggtgtgagttatgatttggtcgtcctcgtgcctaccacctgcctgggtgtgtgcgtgcgctgctgtctatctagagtctcctcttattcgacggagatgtattttgcgggcgcgcctcttgttgtgtttggcgcttttgtctgggagggagctctcgaccccttggggatgtttgactggggcaccttgggggtttatgacccagaaggggtggtgtctcgttggggggcgccccaccccggctgtatgatgttgccccgcgttgttctgatcgtgtggaatgcgtgatcagtttcgttttgggcggcgagtttcttcgtgtgagagaggaggacttctctcttgattttgggggtgaggtgcacatgcaccacgcttctttgggtgttgcccccccccgtgtggtctcaatttgtggcctcccccgtggtaccacccggctctcccgtatcgcgtgttgttttaatccgcccctctttttttgaaaggggcctctacagaaaaaatatggtggtgatgttttgggcacccgcgggcgctcacgcgtggggcggtctcaccccgcccgtttagtattctctcccgcgcgcgacgtgtttttgtgggagagggcccctcatcatgtgcgcggtcggtagtttcacacctcgtgatgtgtttcgcgcgaggatattttgttgtgaaacccgcgcgccgcgtgccccacccacctcgggagtggtatacaccccccggtgtctctctctcgctcgttttatatatgttcctcacatgtttggtccccgcgcggtggcgtggggcgacaaaaagccccagttaatattccccacggtcgacacttacagggagaggctctgaaggccccagagaagagatctcacattctcgaatcactccgcggaggagcaacagaggagtgtgctcacacgagcgagagtcctcaagatgctccacccacattttgcgcctctcaccccctgcggcgcacacacacagagagccgataatctctccacatgttcctacaataagagaacacacacctcttctcttggttcacctgcaacgcactatgtctccacagttgccaccccacacacagtggtgtcttgacccatattatgttatatagtgctttaaccaccttgtttgattataggggaaaagaaattttcccggaaagtaaaatatcacagccacttcactcatcactcgtgtctaataaagctgtggctctgtgtcgctcacaggccaagtatattccccgtcgacccttaaggaaggctgatggttgggaggattaccttgtgataccccccctttgagacccccctgggccacctagtgagacccccgtctctaaaaaaattaaaatagaaataagtagtgcttattgtttacc

SEQ ID NO: 710960 - DNA, 134 bp, Homo sapiens
tctgtgtctgcgccacgcgtctcctcgggcgagcgcagcctgccggcttcgatggcggtcattgcctgccccagccgtcggttccggcgttggctgatgtggtggttgcaacggcaggctgttgcgttaaagcg

SEQ ID NO: 710961 - DNA, 929 bp, Homo sapiens
gagtctcggttagcttcacttcagcgggaacctgcccactaaggaggccgattctttccggctcgagcaggtccggacccgcccctctggcgtctagcagtctcggaggcctgcccgtatagttcagggccggacagcgagcggggagactgtgcccagtaagggttgtggagtcatcagcaggttcacatttgggaggaacctttacaggttgggctccagcagctgtgtgtggccacccaccacgtagtttcaaggcacctatgcagtttacctcaatatcaaattcttgtgacctccactgctgcatatggggctctcatttacaacttcaaggactaccaccgcaattttcacccacagaatatttaccacaatcaccaggtggttttactgtgaaccaaaaccaagtgttatcaaagagggttgtgaaaccctgtgtgaccttatacttcaatgttaagtgtagtagcaccctccgtgtgatgaacatatggtcatctggagggtctaatacaatgaggtggacccttgagctggcagcatcacacgcagaaagtacttttccttctcccaggcccacttcaaggtccaagtgctgtgggaaccaatacccttggatggagactggggaccatgactccgtcttctacctgggcaagctgaccaactgtgacaatgggttcagcaacagcttgggcccagcattgggctttatccctgtccccaggccgcggactacaacttctggtggcctaataggcacagttacgcgtgaccagcgcggcttctttttcggcgcgttgcatgcggtatcggtgggatctccccaatttgggagttgatgcctttggccctgggaggatgggaaagctctgcacacgtactgccaccgtcgatctcaaggcaagcaagttgagcacatctcg

SEQ ID NO: 710962 - DNA, 114 bp, Homo sapiens
aagatcatgtacactacactccagcctgggcgacagactgagcatctgtctcttaaaaaaaaaacagtgtaaaatacagcttcacacttaaaattcacaaagccagttccccta

SEQ ID NO: 710963 - DNA, 482 bp, Homo sapiens
tagaggtcctctcacgtgccatggtgagaatggaaaatggtacagctgctgtggcatatagtctggcagtcctcaaatagttaccatatgacccagcaatcacacttctaggtatacactgaagcgaaatggaaacatatgtctacacaaaaacctatataaaatgtttaaagcaggccgggagcagtggctcacgcctgtaatcccagcactttaggaggccaaggcgggcagatcacctgaggtcatgagttcgagaccagcctggccaacatggtgaaaccccgtctctactaaaaatacaaaaattagccaggcatggtggcgggtgcctgtaatcccagctatccaggaggctgaggcatgagaattgtttgaacccaggagccagaggttgcagtgagccgagatcgtaccaccgcactccagactgggtgacagagtgagactgtctcagaaaaaacacacaatgggacgtggat

SEQ ID NO: 710964 - DNA, 784 bp, Homo sapiens
  misc_feature (645)..(645): n is a, c, g, or t
tgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttcctttttttttttttttttgggataactcagtttcagataaaccatctgggttacgggtggcttaattgggaccaaattttattatagcttaatagtggacacgtgacacatttgggggggtatccatttagacatatcagagcagtgtattctcgggatcatttttataaagtgacctcttctaaaacataacgtgtcacttacctgaaatgctggcatcctaaatatcccaaaattattttggagcaatcaccagggcctaaagccaactgacttaagggtaatcatttcagctaagattaatatttaaagcctaagaatgtatagagctagtttacaataatggatctcagattttaacaagggtatataggaccctgctatggtcatcctctgaattcaagaacggagggtttctatcataatttagccccaccttggtattttaaaatccttcagaaatacttttatgacacaattgcgacggnactttagccacacacagtggaatttcagaccttgatattgggtggtccccagttcacaaggtgatgaagactgtctgggaagccagttaatccaaaattggacatcctggctgccgggggtgacactgagtgagacaca

SEQ ID NO: 710965 - DNA, 168 bp, Homo sapiens
ataataatctgtgatgatctttgtatttctgtggtatcagttgtaatgtcacctttttcatttctgattgtgctcatgtgaatcttcttttgttcttagggaaacttgctagctatcaatttattgatcctttcaaggaccacctcttgattcattgctcctctgggg

SEQ ID NO: 710966 - DNA, 991 bp, Homo sapiens
ccgtaatcagaggggtgtacacctgccactctacaagctgacgtggttgtctcgaagcacaatacaataacatcagatcagatcgcatcctcacgtcacatgaagaatcttctgccattctatcattgccttgcgctagtataggccatctatgtctatgtcgtacgtcatcctccgtacacaatggatagagtacgctgtaggcccactgtagtctcaggatgtgtgacgtacctttggatcgtatttgcctgttcgatcgatacaccatggggaagtggcgcaaggcaatgccaagatgagtacgacatcacgcgataggctacgtatataataactccagagacacgcatcgtctagacccatcgtacgtggagatcgccgcgtatcgaccaataagacgatgatttcatttctctatgagaagaaggccaaagactaggcgtcggtaccatagatgacgacgtggaagcctggctctaccttgggaatgtctcactagttcagcaactcgctatacaagaggtgtggtggtcatgggaccaatacccgatagatgtgtaagtttggcaacgaatattgggtgccccgaaaagcacataccatgtggcccttgaaggaataagcaataactgcagtatcggttccaccatcccagaggtcgttatggaactgacatttaaactatctgtcattaccgtgttctcataaagatcactcgataagataaagtgcgtcctggtagaggatgttcccctttgtgcctttgtgatagatctgctgcgtgagaagtagtgcgttcaaaggaaggactacaagatgttgggaggagaagaaggaaccgaggaaattctgggaattttaaagcaccaggtagtgtgaagatttggtaccccggatttccatggtgggggtttccattggaaatgatttggcaagttgaactaaagaaaggcgagattaatggggtggttcagggagagaaaactca

SEQ ID NO: 710967 - DNA, 1723 bp, Homo sapiens
  misc_feature (340)..(340): n is a, c, g, or t
  misc_feature (344)..(344): n is a, c, g, or t
  misc_feature (468)..(468): n is a, c, g, or t
  misc_feature (947)..(947): n is a, c, g, or t
  misc_feature (1413)..(1413): n is a, c, g, or t
gcaaccctctatgaagtgctcgtaatctcgccttaagcatcgagaattatctaccacattaccggagtgctccacacagtactatactaaaactataatatacttcactatcatccaccatgatacacagtaggtaattcctctagtgctgtatgtgcgacgcatgctagtggacattcgacaagactagtaattcatgtagtaaaaacaccccttgcatactccaaacacaggtaccacttcagttccatctatgcaatctgtaatccgatgcgcataagatacaacacgacatgcattcctaaccctttcttccatactgattgtccccatgctcctncagnctgttcccggacgatacacgctactactttgagcgtagatcaggcatgcgcgggcgatgacctccataaggcaatccgttcctttctggaagcacccgaactgggtaggcgtaggtgtatgcangcccccccactcttgtcaatgacctcaaagcaaactttgattatttttgggaactttgtttctcctgcgatccaagccgcgtgtataatgttctactaaatgacttttcctcaagtcctcgtaacgccatggtcatctgcaggggacatttccatcccttctctcattcactcttggtgacacactctcaacgtcaatgtgcccgtggcacatacaacataggccatatcacaatgtcacgggacgagtttccactaacgcgataaatgcgctcaatgcaaaccttagtgcaatagtgcgattaatagagtgggtggctccttcatcgtggttccttaaattccgctcgatggaaagacctctttcccaagtacgtgaatatgcacgggcgttcaagtgaagaatacagcaactgatcagaaacaaggcaacgaacgaccagtttattttccagggggacccagaataatctcattaanatacggtttcggactttaactctctagactggggccgtttcaaaattgtcatcacagggtgagggacataccggctcaaaagaggcctctcaaagacaaggggagtctcccaggcgacttgttctccctcgaagtcggtgggccttcgcccacgcgtgggatcccttggggggggcctcctaagaaggagctttctgagaaaggtggtacctttttgggtcagcctgtgtggtggttacctccttgggggtgtatcggccccccttgagaaagggaggcgcataaaggacacccctgggtaaagggcgcatctcgcgtgacctagcacatggaaagagcgcgtgaattatacccacgggttggcggcgacacataagcccccttatttagtttcctttaatacaacgtacgggcggcgctgcaagctttggcacgctccttaatcgagaggagacacaacattatncatcacaggagtagccctttttaataaggcggggcgccaccaagaagcccaaagcggatttctcccacagacccctttgcgaaccacaaatagcacggaggggaagagagaggcgggcgtccacccaacagcgcgcgggcaagcaggaagggcggcgccgaccaccatacaaagagggggcggcggaagatagcccacagccgagaatagcttagccacccccaaggacagagaagcagacagctcgctcgcgtgaacagcacagagagaaacgccacacactctcggaccggccacgatcagcaccacg

SEQ ID NO: 710968 - DNA, 172 bp, Homo sapiens
tacatgtggtactgccaaatggagccagagcctggccaggcactgagaagtttcccacatgacccccatccctgcagtccagcccgggcatggcactgctggccgggaggcggggcccgggacggggccttacaaaactggctgatagtgaggaagccaggagagcagggct

SEQ ID NO: 710969 - DNA, 358 bp, Homo sapiens
gtcagcagtgtttcctggggcgggggaactgggaggggccccaggcctggcacccagcttgcgactgaaggtggcctcgtattgcttagaaacgtatgtttcagtttaaataccagacagtaaaaatggaagctcgaggaccacccggactttgccaatcaattccaggattgacaggcttaattaattaaaaatcgaaattattttacttctcggattaaaattcccagttaaaccatttacctttctttgcattatatataatatacatttattacgggcctggctgcgggcgcggggccgaaggcagccgaagggtcagagacaacttggatgacttcaacgttgcccgagaagc

SEQ ID NO: 710970 - DNA, 533 bp, Homo sapiens
  misc_feature (193)..(193): n is a, c, g, or t
tccccaagatgagccgtacttaaaatgaacacttaagtaaataagtacgtggacagccttaggataagctgacattatagatgcagctaggtaggcaacaaaccatagtgccaaatggaaaaagtatatttgccaacttaaatttaaaaaactaagttaattttttataattaaatacagaaaatatactganttgctacaatacataagatgtgatgtattaacacttcactataaagaatgcataccagaacatttataaacagtgagtgagttttattaagaatagtttactacaataaacgctggctaaatagaagtgcattttgtgaagcactatgggtggtatatgtttggccacatactcttgttaccttgaggtagattacacatgtgtaccaaattcggcattcattttcagttgctgctggtatcatgtgttttaagaaatgtgtacagtatgaaaaacttgaaaatattcatgaatgagaaatgtcttaggaaaaaaatagctattttcatgccattatgta

SEQ ID NO: 710971 - DNA, 661 bp, Homo sapiens
atttatcacaaactgcgtggctataaaacagcagagatttaacgtctcacagctctggaagtccagagcacccaaaattagggtgtcgactagggtcatttgccctctgaaacgtctagagaagagtccttccttgcctctgccgtagtactggtggtggctgacaatccttgtattccttgccctggtgcatgtgtacctccgaattctctgtctccatctttacatggtcctctcccctgtgtgagagtgttgattctacaagtctctttctccttataaggcaaccagtcattggatttagggtccactctaatccaacatgacttcatcataaattgattacacctgcaaggaccttacagtggtcccctcttatctgcagttttgctttccacagttacccatggtatagtacaataaaatatttggagaaaagagagagaatattcacataactttggttatagtatattgttataattgttcaattttattattagttttaatctcttattgtgactaatttacaaattaagctttatcataggtatgtgtgttcaggaaaaaaacatagtatatatagagtttggcacgatctgtagttcaggcatccccttataagggcagactactgtttccaattaggtccttcccggtc

SEQ ID NO: 710972 - DNA, 222 bp, Homo sapiens
tggtcccacaccatgctggaggaagtgaccatctgcattgccactcttgcccccaagggcccaggctgtggcctgacacatagaaggtgcccacataggtctctgtgcggtgagatagacagcaacgataactgcctaactgatagggaatgggggtccctgctcatagaacgggggccaggcagctggaattcaggggagtgcatcatcctcaggagctga

SEQ ID NO: 710973 - DNA, 762 bp, Homo sapiens
  misc_feature (97)..(97): n is a, c, g, or t
  misc_feature (512)..(512): n is a, c, g, or t
ccttcctagtgggtctgcgcctgctcatcttgggccagtagagctgttcccttatacctcgcggcggtcctttctccggagggcctttcttgtcctntccgcggtttggctattctcttacatggggttttgtccgcccactcgttccagcacttgttccctcaagggggcttttttttcccagcccccgttgtgtgttctttataccgtctgcccttttgtctggcccacctctgaggtggtgtcccccccctacttcgggtttgttccacccacagagatgggtgtgcccccgaatccccgtcgcttcactcttccggctgggtttccttgtctcaggcacttctcgccggtgtctacaaatcctcaattgggccccccccacagggcatttcccaaaggtgtgtcgccctaccgagggccaccactgctgcgccttgggcctctcgcctatctcccgggtgtcacaccccccacattgtgtgtccgccacctctcttgtctgacggccnccacaccacaacggcttccttgacccccccttagccacacttctctgccgggacgcccctgacaccaagtggtgttgccctcctggggggatcattgggcttcctcccagagcattttccgcccgaacgctttgtatttcttcggaggacacacgttacgacggatgtagcagccgctatgttcctgtctggcgtccggcgcgggcagtgagtcggacaccacttcgccttcaacccccccaacataaca

SEQ ID NO: 710974 - DNA, 382 bp, Homo sapiens
cccagctactttggaggctgaggcagtaggatcatttgaacctgtgaggcggaggttgcagtgagcggagatcagataaaactaaatggataaaaagaaaaaactaagccagaaaggaaaatcggaaggaaggaaggaaaaaattatacagataaacctaaatggataaaaagaaaaaactaaacaaaagttacctctgagacctgtggttacagagaagatagttaatgtgggggaagggtaaaaccaagtaactattaaaccatatggtataatgtaaacaaattggtccatttcgtaggctggtatcatcagcttcctgagaaacctttactataatggattgtataactactttaaggacaatttcttttgttgctgc

SEQ ID NO: 710975 - DNA, 188 bp, Homo sapiens
tctacctctagatttcatctgtcgtcccaccccacttcttccagccccacttcttccttcaccacacatgcacagttcttgtgccttccctgccagcccagatagatagacagatgggaaaggcaggcgcggccttcgattgtcatgtagttctttgatagtgaaatggggcagcacaagtcatttaa

SEQ ID NO: 710976 - DNA, 113 bp, Homo sapiens
cggcacgaggagccagcagagccagccgcagagcagccagcccaactacagcaaggcctgggaagactattacaaaaaacagagtcacgccgccagcgctgctcctcaggccg

SEQ ID NO: 710977 - DNA, 436 bp, Homo sapiens
  misc_feature (80)..(80): n is a, c, g, or t
  misc_feature (356)..(356): n is a, c, g, or t
  misc_feature (360)..(360): n is a, c, g, or t
  misc_feature (385)..(385): n is a, c, g, or t
  misc_feature (388)..(388): n is a, c, g, or t
  misc_feature (394)..(394): n is a, c, g, or t
  misc_feature (404)..(404): n is a, c, g, or t
  misc_feature (418)..(418): n is a, c, g, or t
  misc_feature (429)..(429): n is a, c, g, or t
agtttgaaagcaattctgcattttcttaacattgtaactggtgttgagttgaaggcaggcccctgggagccctttgtggnaattcccttcactctggaggctgcctcgagcctggacaggcacttacacttggtcagtgattgcacagaaccggttgcaacagattctgtgcacctccctgtggcgcgtagatgttagcaggcacttggtcactatttgctgagtgagtctgttaccttaggcgtgtatttaccgtggacctgcctgggggatcattgctcattcactcattttgaacaagccaatattacatgtccaggggtacgctctatagtgtgaaacacaaaaggtaaatngatnagttccccttcttcaaagggatttnctnaagggnagttaggccntctttttgatggcnttttttccttnttcattt

SEQ ID NO: 710978 - DNA, 490 bp, Homo sapiens
  misc_feature (50)..(50): n is a, c, g, or t
tcatgccataacctccggtcgttcattggggttgatggcgcggtgctatngacgatgtacgaggtatttccaagctgatcgcgcacaactcggcgtctctgttctgcatggcggatagctatttccgcttcgcttcgggcaacaaatccgacgagtccacttccgcaacggtcaaggcattggtcgacgggctgaagggcaatggctcattaccagggatgctgcgcacgctgggtacctccaacgcgttccaattcaagacgcagagggattgatcatggatatcttgaaaagtcgtcgtcgctttctggccggcctggctgcggtaggtgtgttcggcccgctcacccagtgtggcctggcgcgcatgtgccttggccgggcaaaaccagcaggccaagttaaaagtggttttctttgtgggtacctgatggcctggcagtcgactctgtaaccggctattccagtgatggtcgagggaggttattgg

SEQ ID NO: 710979 - DNA, 128 bp, Homo sapiens
cacgaggctcacatgcaaaagacaaactagtctacgtgcacacaaatggaccgaagaaaaagaaagtcacactgcacataaaatggcccaagagtgtggaggtataacggtatgccattaagataatg

SEQ ID NO: 710980 - DNA, 179 bp, Homo sapiens
  misc_feature (27)..(27): n is a, c, g, or t
  misc_feature (41)..(41): n is a, c, g, or t
  misc_feature (80)..(80): n is a, c, g, or t
agcctctcctctggccgccgcggacgnagaggccgagatgnagatgagattgccaaggctcaggtcgctcggcctggtgngacacgatctttgggaagatcatccgcaagaacataccagccaaaatcatttttgaggatgaccggtgccttgctttccatgacatttcccctcaagca

SEQ ID NO: 710981 - DNA, 261 bp, Homo sapiens
ctcgcacagaaggtgataagttactatcaaatgccagtgagagtcttcttctagacatcaacctgggcccaagtgattctcagtcacaaacattgcccttctttggtttacatttactatgtgctttaaggtgtgcatccagatatgcggtcttacattcctttggaaatacacagttcgtatagttactgtacactctgtatgtacaataaactgcatatcaacttccccacaaaagcagactttttagggtctcgttca

SEQ ID NO: 710982 - DNA, 199 bp, Homo sapiens
ggattactgtgtgcccccaaaaccctgtgtgacatagctcaaaagggacggcagagaagccagtgggcacatagaccttcatccgctcatgcttctgggtcatccagccctgtcccaggttctaccttgtagaacgcgctgggacggagatagataggtgcctgtatgtccacgtagacgcatgacgtatggtcatgca

SEQ ID NO: 710983 - DNA, 425 bp, Homo sapiens
  misc_feature (21)..(21): n is a, c, g, or t
  misc_feature (32)..(32): n is a, c, g, or t
gataaaaaattgtttttaagnggtttctaccngtaatctcactttggaaggctgacgcaggaggatcgcttgagcccaggagtttgagaccagcttgggcaacaaacaaagggagatcccatctctacaaaaaattaaaaattgctgggcacggcggtttacacctgtaatcccagcactttgggaggccaaggtgggaggatcgcttgagtccaggagatcaagatcagtttaggcaatatagtgagaccctgtctctacaaaaaaatttaaaaattagccaggtgtgttggtgtgtgcctgtagtcccagctacttgggaggctgaggtgggaggatcacttgagcctgagaggtcaaggttgcagtgagccatgatcatgccacttcaccccagcctgggtaacagagcgagaccctgtctc

SEQ ID NO: 710984 - DNA, 107 bp, Homo sapiens
gcggccgcctactactactactactactgctcgaattcaagcttctaacgatgtacggggacatgctgtacagacaccaccattaaagcattttcatagcgaaaaaa

SEQ ID NO: 710985 - DNA, 946 bp, Homo sapiens
ggactcgcgtggtttgtggactcccggacgtaggtagttgttgggccgcgttctgaggacttgttctctttacttttccactctaggccatgatgccgagtatcagacctggaggagttcagccgcgctgcctggagcaagcttgacctcgtgttgacctctatgaaggcacgtgtggttctcaacaatataaggcagttcgtgatgggcacttgtgtgtgaaagtaacatgatgattagtttgtcgtgtatacagaacagagcaagctcatgatgtagcacgacagattgagaagttccacagtcaacataatgcgagttatagtagccaatggaagccctggaatgttaccatggaaagctgagtgaagtggttttgaaactgaggacgttggtcgtgtacttagggaagtaaatatctttgtgaattagagaacgtgtgggggaccgaagagtacttaatgtagataagtgggctgtcagaaggttagaggtcatttgtagattctttatacttactttagagatgtagggatgcacatgtttagcttagaaaggcttaattactttcggcaccttgccacaacgaattgccttctgtttttagcacactgggcgcagtatttggctgataaggtgaacaccatggtagttggtcttcgccaaattaggatcagaatttggaaagtgagcatattaggaggaccatattcttagaagtcagtgaattcggttacaagaaatttacggtagcgtttgtcgatccggttttttggctaaagttatggtggggaacaaaattaaacatgtgaggcgatacacggcacagttgtggtacatggggcacaaatagagcggttcatgagatgtcaaagttattctacggacaaggtatgagaacaaagagattggtggataaattgtctttacattatattcttattgg

SEQ ID NO: 710986 - DNA, 89 bp, Homo sapiens
tagtttgtattttaattatgggaataattgctttttcacagtcactgatgtacaattaaaaacctgatggaacctggaaaaaaaaaaaa

SEQ ID NO: 710987 - DNA, 349 bp, Homo sapiens
  misc_feature (3)..(3): n is a, c, g, or t
ccngtgcgagtttggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacggaattaaaagagcagccggcggacgtgctgtagaggctgaaggagagctgtgttgctacgcttgtactttgcaacggcttcgtacacaacacagcttctcctttgacttaagctatccggatgaaaccaacttcacactgcaactccaacttaaagctttaactgaacacagtg

SEQ ID NO: 710988 - DNA, 123 bp, Homo sapiens
  misc_feature (32)..(32): n is a, c, g, or t
ggggccgggcagctgggcggcaggccacttcncttgacagagcttccagctgtttctccatcagcaccggggctgggagccctggcttttacctggacaaataaagagatgcctccagagctg

SEQ ID NO: 710989 - DNA, 510 bp, Homo sapiens
atctccaatgcaaacaatgttgcgagatggcaccatcaacagatacagattcatcagatagtctggcctccatgaatgtattcgtatcattatgatacaactgctttcctaatagtcactgcatgtggtagaataacagatgtagaatgcatctgcttacacctgtatatcccagttacatgtgtaatcgtgatcatccctttagcctgggagttcaagtccagcatgggtaagatagtagcaggactccttttgttgttgttgttgttgttgtttttgagatggagtctcgctgtgaggcccaggctggagtgcaatggcgcgatctcgactcattgcaacctccacctcccaggttcgagcaattctcccaccccagcctcccaagtagctagaactacaggcgtatgccaccaagcccagctatatttaattgtattttcagtagagacagggtttcaccatactgaccaggctcatctcgaactcttgactttaagtgatctgcct

SEQ ID NO: 710990 - DNA, 994 bp, Homo sapiens
gtcgctcccccctttgtgtctcgtttcttgtgcaagcggcgtttcccccacgggtcttattcggatcttttagcttgggcttacaacaggtgcttttggtatgaccacttttccgaaatttgcctatatttagggttccctcctggaaaaagtcccctcttgtggaccagagttcgcccttccgcttattgggtacccaggtaccccaggattctgcccgctttcaagactctgccccatgccccagagcccccggcctcacagctcctggattgcctagatttcctggatgggccttctggggatttccccagcatctctctcccattctggacccctccccaggaggtgccctggtacacctgcttgaccttcccctgtgtacctccacccccagctcccatccccgatttccaagtgtttgagcctgagggagtaccgctggatctgtctttcattcgaccccctggaaaccctgctttgctgttaatcaccatccctgccacccacttttcacgagggtgatgtcacccctttcagctgccaggcttctgtgccccacgggtttccacgctgcacagcttcacggccccccgtgggaacccacgttcccgctcggggtggccttcctattcaccccacgcttcttcacggatcctcacatcctaccaaggcccccctgcggctaaaagctgcgcctcacctacgaccacactttcaccccggtcggttcacggagaatctttgaaggtgaacacaacttgcctgtggaaatcgctggcacgtaatctgttctccacctcaccacgcctgaaattttcctgtgtccccaaacccccgggggccccacgcacgctttgaacctatcaccctcgagagggctacccacccacaggtggcgcttctcggctttgcactgccaaaactggggaccagcccccttttccccaccaattaagccccaattataccctgagaaatgaggaaagcccca

SEQ ID NO: 710991 - DNA, 137 bp, Homo sapiens
tcaatcgagctcggtacctgacttcagtgcaggagtttttttactggacacagagtctgtccaagcccactcttcaacagctgagatttgtgtgcgtgtatgtatgtgtgtgtgtgtagacgttgtccggggttgtt

SEQ ID NO: 710992 - DNA, 512 bp, Homo sapiens
cacggccgtcagtggcaccaggctgagctggctgtcagcactttctggcccaatgaatatcaggtgctgtttgaggccctcatctccccagaccgcaggggctacatgggcctagttgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaa

SEQ ID NO: 710993 - DNA, 186 bp, Homo sapiens
acatcatatacaacaaccgaacttctagaaaagtgaaaagagaggcattggagtaaggtagatgaaagccctcccaccacccatgcgtgctgaccaagggcatccttcctatctactcagtagtaagatcctcatgatggccaaaaaaaagcatactataacctaaagcatccccatggctcaatc

SEQ ID NO: 710994 - DNA, 181 bp, Homo sapiens
  misc_feature (8)..(8): n is a, c, g, or t
  misc_feature (84)..(84): n is a, c, g, or t
  misc_feature (96)..(96): n is a, c, g, or t
  misc_feature (108)..(108): n is a, c, g, or t
tcccggcnagtcgccactctccttatggactctgttctgtttgtacatggctgacggaaatctctttggtacaaccgaataaanctggtggcagtnttgcgctggggnctcagcctgctgggaaggaccagggaaccactcagcaaggagaccctcgttgccctgcccccaccatgcaccc

SEQ ID NO: 710995 - DNA, 511 bp, Homo sapiens
aagaaactgtaacctttcctgctaagattatgcacaaggcaagaatgtgccctctaatcattgcttttcagcatcattctgttctagctgatgcagtatgacaacaacaatggaagatgcagaggtatatagcattgcaatacaggacagaagtaaactgtcattgttcacagatgacaagattatgcagagaaatattcacaagaatcaggaaaattacttctggcaagttgtagaacctactatcactttgctcgttattgccatgcagtgaacccagtggaaatttgaaattaaaaacacaataccatttacgttagcaacccccagaatgaacatttataggtataaatctaacataatatatatacgaagatctatgtaaagaaactataaaatgatgaaagaaaacagaagaacgtaaataaatatagaagtattctatgttcgatggataggaagacacagcatcatcagaatgtcagttcttcccaacttgatctatagattc

SEQ ID NO: 710996 - DNA, 193 bp, Homo sapiens
ttccagggcttgattgcaggccaactgtcaggtgttggtatagcagctgtttcagtttaaataggccttattttacttaataatggtgccaaacttgcaacgagctagctgactgctggcgcattaagactatgctaacagagcaagccactaacatttccttctcttttagctgaaacaggctgaaaacttg

SEQ ID NO: 710997 - DNA, 332 bp, Homo sapiens
tccaaatgttttgtttctgtgtgtgtgcacgtgcctgctcacaaatgtatctgtatgttgtggaggcaattggctcaacagtcattcagggactcagctgagggacagatcagctgactggttccagatttctccggcgtccccctcccccgtgttttgtaggaagataagaacacacagaaattcttctatgaggaagtttatcgcccaggactgaaaatggcacacaacatctacttacattccatacccatgaacacttagtctgatggccacacttaactataaaaaggctgagaaatggagaagacatgatcagactaaaggggaac

SEQ ID NO: 710998 - DNA, 688 bp, Homo sapiens
gggaaagtaaataaactttaaaattcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctgggggcccctttggcccaagccgtttttagcttgggcaagttttttcctggggcccaaatttgggctcatttggcccattcccccttttggggggcggtttacaattaaatggcccgggttttaaaacggggggattgggaaaacccgggggttccccaatttaaacgccttggaaaaaatcccctttttgccaggtggggtaatagccaaagggccccacccggtgggcctttccaaacgttggcccccccgaatggcaaatggaaatttgaagggctaaattttgggaaaaattccggttaaaattttggtaaaccgggttttttttaacccaaatggcccaatatgggaaaatcccttttaaattaaaagaattccccccgaatgggtttgggggtgttcccttttggcaccagggcccccttttaaaggacggggccctcaacgtcaaagggggaaaaaccggttttagggggatggccccattggggcccattcccctaaggtttttggggtcggggggccccgccttattgggccccttgggg

SEQ ID NO: 710999 - DNA, 508 bp, Homo sapiens
ttagtacaatatctgtgtgtatggtggaactttccttaacgtgttagtaacatttagctatttgtctgtaaatagcttacatatcttcacagaaaaatattatgaaataccttcagtacaaatgttttataatatttgccattcctattaatatatgaaacttgaaccctcagattgtgaattgtacacatataacataaactgttaggataattactccagataaaaatattttttcccaaaaaagcacctctctttgcatagtgatctgtctcattattacagaactgacactgtctttacagattctttccacactagaataaaatggtacctttcctagttttctgttatttcagaaaatgaggaaatgaatcctggatgaaaccggccttcacatttagctcaattcttcctctgcagaggtgacacttgatagtacactttctgacttgactcacaactaacagtctgtataatagcagtgacacctaccaatttcactggc

SEQ ID NO: 711000 - DNA, 100 bp, Homo sapiens
gatttgctggtgcagtacaactaggcttaatagggactcgaattcgagctcgaattcgagctcgaattcgagagaaaattgaaaagaaaggagaaaaaaa

SEQ ID NO: 711001 - DNA, 525 bp, Homo sapiens
  misc_feature (517)..(518): n is a, c, g, or t
actgtggtacattcttactgtggaatattacttagcaataaaaagaaagaaactattgatggacacaacttggatggatttcaagggcatttttatgccaagtgaagaaaactaatctcaaaagtcacatactatgtgattccatttgtacgacattctcaatatgaggaaattttagagatgaagaacagattagtggttgccaagggctaggtatagatgggagaggcagagggatgagtagaacttttaataaaggggtagaatgagggtaattcttgtggtgatagaatagttctgtaccttgattgcgactgttgcatgactccatgtgtggtaaagtggcatggaattatacatatgttgtatcaatatcaatttcctgattgtgatattatgctatagttatgtaagaggtaacattgaggtataactgagtgaagagtacagaggatttctctgtattatctttgcaacttcgtgtgactgtataatgatttcaaaattaaaaagattnnaacattt

SEQ ID NO: 711002 - DNA, 259 bp, Homo sapiens
cctagttttagaagtttcaatagcagattagtggttgccaagggctaggtatagatgggagaggcagagggatgagtagaacttttaataaaggggtagaatgagggtaattcttgtggtgatagaatagttctgtaccttgattgcgactgttgcatgactccatgtgtggtaaagtggcatggaattatacatatgttgtatcaatatcaatttcctgattgtgatattatgctattgaacttctaactaggggccg

SEQ ID NO: 711003 - DNA, 634 bp, Homo sapiens
agcggtgcattccagcctgggcgacagagtgagactccgtctcaaaaaaaaaaaaaaacaaaagaagtttctagaatctacggggcttgatgaacacaaaccacagcagaccctgaggaacccagtggtggcagtgactcgggctcctctgctctctaaagctcctttgagaaaacatgggaggggccgggcgtggtggttcacgcctgtcatcccagcacttggggaggctggggcaggaggatcgcttgagcccaggagttcgaaaaccagcctgggcaacatagttgagactgtatcgctacataaaatataaaaaaaagttagctgggcatggtacttgtgcctgtggtcccagctactcaggaggcttgagagcaggaggatggctgagcccaggagtgggatgtggcaggtgagccaagatcgcacccattggccctccactcggggccacggagcaatacccggtctcagaaagcataccaacaaaaagcagaaacgcgtgaaggggtcggttacgggaaaaaccgcctgtcagaacacgtgggagtactcctaccccagatcaggggacctgggaaatgagggtgggctcccgggaggctttctccaagctgttgccaccagaccg

SEQ ID NO: 711004 - DNA, 101 bp, Homo sapiens
cgcctggcgctggctccagaccccagaggcatacatgcagcagcgagtgttccgatcactggcctacatgcggccactgagcatatgggccatgcagctag

SEQ ID NO: 711005 - DNA, 1257 bp, Homo sapiens
  misc_feature (1257)..(1257): n is a, c, g, or t
tggctataaatccggccaaaatattttaaattacgtacaaagatctgacttgtgttcacccagggacccattttcacccattgtgctcgtgttgggccgccagtcttgtggtctctctcttcagcaatggggtgagggcggatacccttttcctcggggaagagaaactccagtggttgtgtggcccttgccaattaacaaaaagtgtgtggaaagttcgagtgtggcaaagctgtgtgccagtgggcattcttctcagggtgaaccagcgttcaaaagactccaggggtgcctctctcgtgtggggtgactcacaccaatttctctcctaggtatagcacctccagttcaccatacaacagggtttaccagtgtgtctcagaacctttgatgtgaaatctcagataattcttgtgcacagtctttataaaatctcaattcgtgaagggggtaatcattctcacccttttgaatgagcgggggactcgggagaaacgcggatgtgggtgcggggccaactacagtggagtctccaccgagaagtgagaggggaatttcccttatgtggtgtggcacccccacaaagagaaatctgttttctctcaacttgtgtggccacacaaactttgtggcgtaacttgggggcccctcctctcagggggggtggggtaaaacatgaccgaagtgttcacagagccaaaagaggcggaaacccctttgggtgggtgttcacattaaagatagttccaaagccaagcgggcaaaagaatttttcttacctaccccgcggagttcttgggcgccaacaaaagtgctcgtcgaatattgaaacactatttccacaattggaaaatttccccgaaggaaaggaggggtgatagagcggcttataaattatactccagaggttttgcgggggacaccttcttgttgggccacaatgcacgaaaatttcttctacaactgaggaaacccccggttgtggcatatggggcgaatacatctccttacttcgtgatacaaagcttactacacattagcctcccctgtggtgacgacgggcggcaataaatcctgagaaagggttactgaggtatctacccctcagaagggagaaacacatatctcgtattcacgaaaggggggggcggaaagcaacacactcttctcttcctcccaacatctcttggttggcggggggacacccccagggtgttgctgatcttgaggacaccagaatgagatactgtcacatan

SEQ ID NO: 711006 - DNA, 812 bp, Homo sapiens
tatgattggggggcacaatatctattactgcaacggccaaaatctgggtttggtactgcggcccgtagatacagtgggactgatttggaataaaaatgaaagctttaaggggttcccctaacaaaactattttttcttaaaatactttggaaagggctataagcagttgattttcaccctgggagagcatcacacgcggttgaggtctcagtgatggttgaccctcccaagcccctccgggttcttaaagttatcggggtgcgtgcagcttcctctcaatcttcttggcacgctcatttctttttctctgacccatgagaagggaaacacttacggatgatacattttaaaatggtggtgaatttatccatttattaggcatggtgcgggataatttaacaaagaacttttggtgctgggaatatggctggcggggagcctatgggtggtaaatggtagggtaatttcggtgaaaataaccacttgaaattggtaaattggacccgttgtttgttgtcagattgggtgtctagttcaaattgggtggggaagcccttttcactcttctttttctaatgtggaaacatttatcttgtgagcaaataatttaattctcgtgagatttatccacatttctgcgcattgagagggttattaaggacgggaaatcctggaaaaaattctcttcaaggttctcaacttctggggtgagggcagcgtacgtggggtttgtttaatatacaccccctgtggtggaagagatttggtttcggaaaaaaaccttgatatttttacgcaaatattctttaagt

SEQ ID NO: 711007 - DNA, 836 bp, Homo sapiens
  misc_feature (356)..(356): n is a, c, g, or t
taaaaaatactattttatttttcctccccttttaaaaaaaagggctgtcctatcactgtttccttccttcctacctttggaaccaaaataccgaatggttttaacttttatggaagaactaccaccaacctattaaaaacatctggtagtggtgttcacagaaagcagatgtttggaggaaaaacactattaagcctttatatatttcctaatttcctattaaaaggagcagccaccctcttgaagatataatcaacctggtattagtatattattcatctcttatcatctgggcaaatatatattattgttccacaagggaaaatgttcagtgcgtattgtgtacactggtattnttatatataatcttttatacccaaagccctattttatattgtttcccctccacctccatatgggcaaagaaaatatcaaaactataatatctctggcaaaaaaaaaatattattgtcctcttatatttattttatttcgccctagattcaaacagtgttgggcgctatattatatctctgggcaacccctggggcgctttttttggtgcaccaatgtgtggccacgccatctttaaagccgggctcttcccagagtgtggggatctccaggtgttgctccccccccgtctgtgtgatctctcgtggaactcccccgcgtgaaaattaggaaaatcctccatcatttcccattatttttgtggttgcgcccaaggcactataactcccccctgggcacccctgtgatatgcacctggcgacccccttttccttgttggggatcccccctagaattcctcccctaatttagagaaaggaccc

SEQ ID NO: 711008 - DNA, 866 bp, Homo sapiens
  misc_feature (609)..(609): n is a, c, g, or t
  misc_feature (644)..(644): n is a, c, g, or t
  misc_feature (657)..(657): n is a, c, g, or t
  misc_feature (747)..(747): n is a, c, g, or t
agcgggtgagtggatctgccaagtacagccgagagaaaggaagcagcgcccgttgggaattggttgtgagaatcccagccaatgtggagaagcctggggcttgccctggactctctgtctcctcccatcggcgagtgaacagagagccaggaccaaaagtcgtccgtatatgtaagctaactctcctcagtccttggcagtcatataggaagagtctacaagtatcacaaatgcgtagagaactccatgtggattcacgtagactgatgagtctagcgtcattgcatgcaaggccacacttggatacgctggtgcgactagcgtgcaaggccatttctaagattaaggaagggaccctgcagagatgaacatctggaccatgaaaaggaatggcaatagtctctatactagtatccttactacttagtatggtgtgaattcgatccaacggaattgctcgttcatcgaaatctcaaccaatatcccacatagtctgtagagtacaataagagtatctcagagagcgagtagttgaccatgctgtataatcgagccaattgagaggacaaaatacagaaggccagatcgtgctaggaactaccttatctnaaatggcggaacggcagataacgattgacgtttcnttccactaatatnggatgatcgattggttggaccgggtcgtgtgttggagttatccagtcttgtgggtggtttgcgcgtatgtatgccattcctaaagcgttnatctccgcgatatcgtaagagaagcaaggctagttagagatttggtctactgtgtgaggaacacgcacatctgttggagataatggttgctcatacagagatatcttcatttcgaatga

SEQ ID NO: 711009 - DNA, 1236 bp, Homo sapiens
cttgaaccaggcagaggttgcagtgagccaagattgcgccactgcaccccagcctgggcaatagagcgagactccacctcaaaaaaaaaaaaaaaatcagttctaactctattttcctcagtgtggcttctagaatattctccagctcacaaccagctaggctgcatttctgttgcacaactgcagtcaaaagcaggagccggcagacagagagtattttcagctttgccagttctggcatctgtcacaagtaacccactaccgcacgccaaccccatccacactgcaccgcccacctgacgtggctcacacgctgtccccaccaacaaacgcctggttcaaggcccctctcgaggcacccagcagcctatgcagcccaatgtggcgtcggggatgtgatgtcacagacagggatatgctgaggacgcgtcaggcaggcactggagcagctcacctgtggcccctgcgaagacgtcgccctgggccggactctctgatatgacagcagtggcctctaccgtggacgctcggtcaaaggtcagtgcccccgaggtcgtgatctgtcccgagggggtcacggtgactggaaaggcagaagcacatttcacgcggccaggcagtggcgcccacggcacacaggtcccgtgccacccacgggcgccaatccttgtgggggcctgggctgaagggcgggcagtggtaactgtaccctcccatgtgaaggacacgggggaaatcccagaccttggagaagacctcacaggagaaaaccaggatggccaggatggcaacttgccactaccaattgttcgctgtttaaactgtgaaccatggaaatgtgctgcccagccagaaaacaaacataaaataaaactttcagtgatttttaagtacttcgtggttcgaattaagaaaaaatctttaatccaagctgaaggtaaaaagcagccgtgtcccacagcaaggctgccctgtgtcccacagcaaggctgcctctccagctcaaaaaaaaatcctggcgacagatcttgagactctgctgctgtgggactcttcctgcacccaccacccagggcctcaggaaggagctgacagggtgttttagaaagaccttactctataaatgcaaaaacccagacttagttaacaaaagcctattacaaagacattttctcctattgctacctctccccatttaaatcctgtctgtacaaaaaaataaaaacattagctggt

SEQ ID NO: 711010 - DNA, 312 bp, Homo sapiens
gtgtcggtacctgctatccttagtctaatgcaactaaagtgaattagagctgggcactgtggctcacgcctgcaatcccagtcattcaggaagctgaggcaggagaatcacccgaacccaggaggtggaagttgcagtgagccgagatcacgccactgcactccagcctgggcaacaagagcaaaactctgtaccccccccccccccaaaaaacaggacaagaacaaagaaatttattgtggcctattacaaaaaagaccaccaggcggggcacccaaacaagacctttgtattacaaattcaaaaacaaca

SEQ ID NO: 711011 - DNA, 4272 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 711012 - DNA, 129 bp, Homo sapiens
ctgccaagatgcttggagaagcactgagcaagaaccctggctacatcaaacttcgcaagagtcgagcagcccagaatatctccaagacgatcgccacatcacagaatcgtatctatctcacagcctgca

SEQ ID NO: 711013 - DNA, 3928 bp, Homo sapiens
tttttttgcgcacaaaattgtttccctttctgaaacaaagcaaccttatttacaaaaaccaaaaccaccttaacaacaatagctgtcacttttctttaggaaaagcttcatttgtaaatgactctccacagctcccttttccagaaaggtggggcaggggccttgtgagccaaggtgggtcttgcgcactgggcacaggcaccagggtggcctggggttactcggcacaggtcgtgtcttcccatttgttccaaggttacctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 711014 - DNA, 1782 bp, Homo sapiens
ggcctggatggctgtgtgcgcatgcgcgagcgcctagctgcgcgcagccacccactgctgaccccagtctgagtgtgctgtgggtcctgtgtgtgccctgtgctgctgggtgtgcctgcctgctgtgcccctctgggcttgctgtgggtgagtgtgtgtgcttcctgccccatgttgtctatttgctccttgcagccctttactgctagtggacttgctgctgacacctgcgcccccggacccgggtgtgcccggcttgtagtgccatgtgcctgggtagctgggcgcacggtgtccctgcggatggtgccctataaggggacttgccatgtgcaaataactagaaaggttctctcttcaccttgcaacggcatgcggacacgtgacagcgatgcactggttgtgcccatggactcccgtaactaatcacggcgcaatccagcgacttcactactgggacgtatgaaaggcccacgtatatgaatcccatgatttataaattccggaccttcgagcggtcaataaggtacgtcgatttcgcccgagcgtatatcgtccatagaaggaaaacgccattttccttctaattccctttgcaaggaaataaaagcagcgggagtggaacctacaggtatatcttaagccagagagacaccgccacaaggcaagacgagcgtagggaccaggccacatggcacatgacaccgagtgcaaattcggctccatggccgccagtgctcacaccaacacccaaactcaccacaacgcccgttttgcagcacgcatcccttggcgcgcacccacccgtgatccctccccttggccagacatggcacacagcagaatacgtgttgcgcagcatctgggcccccaccccggttcccaccgcgctggctacacgtcggcttgcccgcctttcggcacccacacataggacttagcaccttcgcctttctcccattccgttagcgcgcatcgcacgagcttacacgcgtcgccttatggagcccactcctttgatgagagttcaacccaatgcggagtaccgtcagacgaacagagcagacaccccgattatgctaggtcagtacatacacgatttagccacttggaacgcagcacgcagacgagatctcgccacagcgacaatgaacgctacattaccgtggacttctcccaaacgagaggtagtcgtccatccccctctcccagtggccgacattgagcacctcgattacgataacattattaccacagtatgacatcgacacacacacccatgtctgaacgacgggtcagacagagaacgatcgcgcttgagcacacaacagaagccagaccgtccgaacgcggcccacacgacaggctggcatcaatctgcccgacgagcacacagcaccactaagccatggtgcgagcacatacacagcactgaagttgcgcacgacacaccagggaggaaaaccacacggcagaaaacaccaggacaaacgaagcaccaagatcatccccaacagataggaaagggaacaaccagaccacaccagatacacagatagcaacatacacacccatcgaggggcaccccaactaaccgcagcgcacagccaacaaaacagaacagagcaacccgcgcagcagagacagacaacaacactaaccgtgctgaaagagaatcgtacacgcaaaaccacgtacactagacagacaggacagaggagacatcagtatacagcagcagagcgagagagcgataccaaatacaacagcgcgcgaccaacg

SEQ ID NO: 711015 - DNA, 4227 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 711016 - DNA, 718 bp, Homo sapiens
atatcaggtcatgagataactaaataatactcacctggtatgactaccatcgctatggggtcatcgtatactctcaccctacttgaagcgctcatgatcataccatgagctcccattgttttaccctctctagtaatagttcaaaaagtccttcgcatgtcgccatagagattctcttttgcaactatgcattgcatgtgccacccgcatagcaggataccttcagcctcttatcctggttaaagcctttgggactgtcaagtgggattggccaattttaaattgctaaagggaaactatagtctgtgtatccccgtgggataggtcacatatgactcctagaacacaatgaatatctctctggtgctgacttgccttgtgcatgcccagagtgctacagtttgcagtgattattggacttaacctgtttccttgactaagtgtggctccgcaagagcaaggccaggtccagaacagtaatggcacgatacgtagatcatacgatccatgtgggtgtagaaggagaagtaactacatgactatttgccaagtactgtgctaagagttttagctgttcaataaatatttgtcacataaatgagctgttcagtaaagctgggtgtttggtgacatggaaaacaagtaggtattggacatttttttctgtcttagaaaatctattagcataatttctacgcaactattctggataaatctc

SEQ ID NO: 711017 - DNA, 229 bp, Homo sapiens
cgtacgatcagtggcacaagatcgaactgaaaacaaacattattcatgctacaggttataattttcctggacaacaccaaaaacacagtactcaaacggcatgtatacttttgtaatatttttttattttgggtctctaaaaaccgattttttaattatttccccaaaattcaaattaaaaaccaaccttattccatgctacggttttatatttctctgtgcaccaaca

SEQ ID NO: 711018 - DNA, 3669 bp, Homo sapiens
cgtccagcaaaactgcaccaggcgaagacgcgatcctcctcgtcgctcaagtgcctccgaagctcctgtccctctttctcgccttaccgttctctgctcgtttgcgttcatctcgtgaccgatgcttccacgttttagctgcctgtgccagattacattctcagtcaccactcgcgttctgcagtcagccatgacacgcggaggtcccttgtggatcgggtggaccccagccaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 711019 - DNA, 4020 bp, Homo sapiens
tttttttgcgcacaaaattgtttccctttctgaaacaaagcaaccttatttacaaaaaccaaaaccaccttaacaacaatagctgtcacttttctttaggaaaagcttcatttgtaaatgactctccacagctcccttttccagaaaggtggggcaggggccttgtgagccaaggtgggtcttgcgcactgggcacaggcaccagggtggcctggggttactcggcacaggtcgtgtcttcccatttgttccaaggttacctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactgggaggcagaagttgtggtgagccgagatggtgccagtggactcaagcctgggtgacagagtgagactccatcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 711020 - DNA, 259 bp, Homo sapiens
  misc_feature (3)..(3): n is a, c, g, or t
tantgaataccagcggccaaagagagtgcgcattacgtatgattacgttgattttctgaggccactgaatagtcttgtattatagatgggcaacagagtgaggctccatctcaaaaaaaaatatatatatatacacacatacattatattccacctatctctagtatacggaataacataaatttcaaaaattatactagtaatgccaagaacgaccaattttaagatcggaagtgtaggcccggcgctgtgtataccg

SEQ ID NO: 711021 - DNA, 4296 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 711022 - DNA, 779 bp, Homo sapiens
tgcgcgggggccccgggaacggcggggtggcggcgcggcagagcaaggacgcggggatccactcgcacagcagcgcactcggtgcccgcgcaggtcgcgatgctgcccggtttgcactgtcctagtggcgcctgacggtcgggcgctgaggtacccactgatggtaatgctggctagtggttgaacccaagatatgccatgttctgtggcagactgaacatgcactatgaattgtccagaattgggaagtgggattcagatccatcagggaccaaaacctgctatttgataccaagggaaggccatcctgcagttatttgccaaagaagtctaccctgaattgcaggatcacccaatgtggtagaagccaaaccaacagttgaccatccagaactgcgtggcaaggggggcccgcaagccagtgcaagaacccaattccccaacttttgggtgaatttccccttaaccgggtggcttaaggtgggtgaggttggtaagttgatgcccttctcgttcctggacaaagtgcaaattctttacaccaggagcaggatggatggttttgggaaaattcattcttcatgggaacacgcgtcgccaaaaagagaacttgcagtgaagaaagagtaccaatttgcatggataacgggcttgtgctggcccttggggaatgaccaagttcccgagggggaagagttggtgtgttggccaatggttgagaaaaagtgaacatgtggaatctggtgttgcggagaggatgatgggatgcggtgggggag

SEQ ID NO: 711023 - DNA, 4352 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgggacagttgtgcggggcaggcgcgcggggtaggcgcgcgggaaccggacgaggcgagaggccggcgggcgcacttgcctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 711024 - DNA, 4486 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctcttggggcaggtatgtggggcaggtgtcggggcaggtaggcagccgatcacgtggggcaggtggggaaggctgggaaacgtcgagcaggtgtgcgaggcaggtatttgtggcaggtgggggcaggctggtcaccatgggacagttgtgcggggcaggcgcgcggggtaggcgcgcgggaaccggacgaggcgagaggccggcgggcgcacttgcctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 711025 - DNA, 5054 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctgaaaaaaaaagaaaaaaaaaagaaagacaaaaacacaacgaacgaaacacagaaagacaccacgaagacaagacaagcaaccagcggcaaacacacgtaggggggggggagcggcgccgccgcagagcgaggggcgcagacagcgaaagaggggggggggcgacgcgaccgcagagagagaaccaaccgagcggaaacaccgtgagctaccaacgagacaacgcgcgggacagaagaagcggcggcaggggtcaccgcccagagcaagaaacacccccggcgggaataaaaagacagcggtgaaaaaacaaaaacaccagagagcgggaagatcgacggaggagacaagacagaggcgcacgaataaagaaaacaaagcgaagccagcacagagaagagagagacaaagacaacacaacacacgacaccccccaccacgcagggggtagaacaaacgaccaaacgacaacaacacgacagcacacacaagccggcaaaaggagaaaaaggcgagggaaggaagaagccgaacagcacaaccaggggagagcgcacacgcacacgggaaaagcacagaagacaaacagacaggcggacggaggacggacgcagggcgcagcgcgaggggcaggcaggcagcgacagggcagggaaagcacgagacagagagacagagaggacggtgggggggggacggagaagtagaaggaaggaaacgagaaagcaccacaggggagaagagagagagggacaggcggc

SEQ ID NO: 711026 - DNA, 338 bp, Homo sapiens
  misc_feature (16)..(16): n is a, c, g, or t
  misc_feature (25)..(25): n is a, c, g, or t
  misc_feature (40)..(40): n is a, c, g, or t
  misc_feature (87)..(87): n is a, c, g, or t
  misc_feature (96)..(96): n is a, c, g, or t
  misc_feature (104)..(104): n is a, c, g, or t
  misc_feature (226)..(226): n is a, c, g, or t
tggcccactgcaagcnccgcctccnaggttcacgctattntcccgcctcgggagctgggacaacaggtgcccgccaccacgctcggntaatttttngtattttnagtacagacggagtttcaccgtgttagccaggatggtctcgatctcctgacctcgtgatgcacctgctttgacctcccaaagtgctgggattacaggcgtgagcacttgcgcccggccaatnaattttttaagtttaagttcatttttgtccccgctggatgaaagttagagctgctttcctcccaggcagccctgggagtaggggcacagacttgtgcctcggtttcccaagc

SEQ ID NO: 711027 - DNA, 253 bp, Homo sapiens
tttgccgttctgggatattggcccctttcccttcatgagttaggatttttggggtttcccccccccagtttgttgcggtttgctccggtattttatttgcccctttttttttgaaattcttatttttctcctgtggtttcctgttaccctggtcctgtctgccgggtggatttttttgtgtttgtttttttttatcttttatggtgttttccctaccttccaggggttgttttattaagtgggaaaaaattta

SEQ ID NO: 711028 - DNA, 1244 bp, Homo sapiens
ggcagatgcccatgctcatgctggaccacctgaagaactgtgctcccagcaagctgagagattgcccagctcaatgaaccagctggatggagtcacgatgttcacctgtgctgtgcagcctgtgaaatgcacggaaatgcaattggatgtgtggatgatctgaatgacctgcaccttgcagactctgatgactatctgccaacatgccaagtgacatgctgctgcgatggaggcacgccttgatgcctgcacttcatgctgtgactgacacgaacttgatgactccacgaaccctgtgcttgtgcacggacatgatcacgtgaacgacacttgaagctgaaactctgacttgaacgaatgcacaatggcttgcctcgtgtgctcatgtgcttccccggcgaccttggctcaagactaaaattgactctccaatgctcatgcctacgaagcaacgccacaccacatgacgacagcaatggacgcctggcaagtgatgcacagcctacaccaatgcccctacccaaggatgcccatgcgtgccgacgtttcccgttgtgcatgcaatcgtcccattgtgttggaccacatgctccccttgggttgagccacgtgccacgaggaatggcatacaccgcatacctgggggcacgcctgtcgacgaaccaaccgccactgggcaagctcttctgcaccccgtggacccccaccaggttgaacacatctggccttgtcgccgtccaggccctttgggccttaagacctcgtccgtccacctgggccaccatccacttgcgaagacacgtcctgtcaccctgacgggagtgccgcgcgaatcctaccaggccacattggccccgcccttagcaaaccccgcgcgcagcaaacggggaacccacgaacaccaactgccgggcctaccaggcacgcgccacggactcccggctcaccccgcccaacgtgaagggacgacccgcccacgcgcccccgccccacggccaacgccacccgaccctcaacgcccgaacccccgccagaaaaacacacccacacccggcccgcactggacgccccagcacagcccccggcaggactccacaacccagacgccctgcccgcctggacccaaccacgccggcaaccacacgccccaacaccgagcaccacagcaaggcaccaccccccaccccacacaccaaggaagccaccaccccccacccgaccaccccccccacacacaccacacc

SEQ ID NO: 711029 - DNA, 140 bp, Homo sapiens
aacctacaccacagctcacagcaacactggatcttaacccactgagcaaggccaggatcgaacccaaaacctcatggttcctagtcggatttgttaaccagagccacgacgggaactccgttcacttaatgccgctagcg

SEQ ID NO: 711030 - DNA, 940 bp, Homo sapiens
gattagtcagcagatgatataccatcctgcgcatctcgttgaaagcacactcggttgcatcaagttgatggtgggttccgagactgtttctctttccggctgaggacgcgcagaatgtaatctttgcgatgagctagctggtgatcatgacgggaggtgtggcgcaatcttactttggcccagagaactggcgaattacatggagatagaaccagtgatcatgcttacctgaagtcctacagcaacgttctgagtactgctccagtcgatgctttgaaagatgcgtaagtcttttctctcttttaattcactgggtactatactctgcacgcaggtcttctaagcctagggtcgtacgtgtcactgacttcacgtcgtgaccaggagcgggattgaatcacacccctatcggttttcgatttagtaaaaagttttgcacccatgactcaaatgccttaccattgttgcctggttggcggacccggttcacctaacaagccattcctcttcctttgaactcggacactcttgactaaatattacgggcccaggactgcgtatgaaatgactggggacaaaaagcttgttgcgagtgggcccatggatcgaacatcagggaaatcattcagcgccatcctgttgtaaaaaaactctcagccagggaatggtacaagcccgcgtcgggaataattatgccactcaagtagcacaagaatacccgagggcactctacccgtgatcgtacggacgcacgccacacggactggtacaacatacgcgtggacctaggtgtaaaccttgagaaggtgggggccccagcgagggagaccacggcacaacaagaacgagcgcgccacagcaaactacctggagccgaagatcaggacagcaaggagaagaaaacacacacgtgaaggggaaacaaaattagccgcgcaca

SEQ ID NO: 711031 - DNA, 166 bp, Homo sapiens
gtgccctgtgctattcagtcacgcgtggctggtcgtcgatcagcggaccggtcgatagctctgcacctgctgcttggtcatccctactttgacattgttgaccatcggctcattgacttgctgggtgcgcgatcataggtggtgcaaccggcaagaatggaatata

SEQ ID NO: 711032 - DNA, 432 bp, Homo sapiens
tactcgatcatacgtgcacggtcacgctgctccggcggcacttgtcccgcaggatcgcgataaacaccaggttgtcgatacccagcaccagttccagcacaatcaaggtcgcaaggccgagccaggccgtaggatccgctaaccattccatttataaattctctgtctttaaagtgtttagaacgccgggcacggcaaagtgcggtcatgcgaccgggacaaggttagttgacggaatacggggtgcttcagcgggaacagcgacagcggttgtcttggggaaagacgactgggaggctccgagagggtgttcatgcaagtcctgaaatgacaaaaggacttgaatcctacattcgaaatacaaatttcccacaacgcaaaactattacaaaacctgtaaaccccccatcagaagcacagcaactcttgtgg

SEQ ID NO: 711033 - DNA, 698 bp, Homo sapiens
  misc_feature (390)..(390): n is a, c, g, or t
agttgcagcagaggagactgcatgacttcggttgaggaaacgggtatgtcatgtctcagggagtaggtttgtgcagttacagcgttttctgtgggtattgcaataattaatcacatctggacgctgcaaatcagatcgtcgaccacagagatcggcacggtccacgaagaaaacattggcaatgggaccaccaggtctgctctgaccatccttgatactggagcaggacattacagacacgactggcaacggtgggtgtctaggtgcccagcactattccatgcatgctttcatctcgacgatgtgatgttcagacattgtgtgagcgtcaacagcgctacgatttgcccttggcccgtagcgtctcctggtgacgcatcgagcatttanggattataccaaggcgtgtgatcgcaaagctatcccagcaagatgagatcgaaggcctagcctattcgagggccatatctggaatctgaacgttgcttatatctgaggagttgggttcagaagtacagttagttctgctcttggtccactgtgaacttgcgacgatatagaggcaagctcaggcgcctcttcgtgtagttgatgatcttaggttgattctctgaagttgtgcaggcgttgatgtgggtatgtcacctatgtcggggccttgtttagtggtctgacattactgattttgggctctcgat

SEQ ID NO: 711034 - DNA, 339 bp, Homo sapiens
ccccttttttctttttaaaaggccaggttttggccggccgggagggaaaattgggccccgcttacggtttccccaaagaaccatggccgaaatggggtttggtatataaaattttagggcccaccatatggttttctggttttacggaggggccccctggacttaaaaccaaattggcccccccttagggggtttcccaaaccgaaggggttgaaaaatttcccttttaactctttttgaaaaagggttttaaatttttttaggtttggttttgttcccccttttgggtggggttttttggttttgttttccgggggatttataaatttggccgctgga

SEQ ID NO: 711035 - DNA, 1802 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgctgccgccgccgccagggcccggactcggacgcgtggtatagcctagagtcctggggagcttctgtccacctgtcctgcagaggagtcgtttccagcccggctggtgagtgctggccaggtggggcagagcaggcggggcggcgaaagtccagacctggctgtgctgtctggaaacgtggcccaggcgctcagctgctgtctgcaccccacgccctccctggcttccccatgctcacagcttgcccactgctgcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711036 - DNA, 1766 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctggcccataggctcctgccagcctgtgacgtgcggccccgggaatgctgtggggagcgggcaggctggcatgagctcaccggaggtacccgctagggcttcctcccccggccgccagcaggggccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711037 - DNA, 452 bp, Homo sapiens
  misc_feature (19)..(19): n is a, c, g, or t
  misc_feature (22)..(22): n is a, c, g, or t
ccgggtgctgtgtcacccntcnaccctacagcgacggaatgcccagctgttcatcaccgtcaatttgccgcagatggggtcggacatggtcagttgttttgtgtttgagggcggatgaaagcattgcatcggttctgcggcgcgttgctatgtccgatagtccgtccgggtcaccgataaactcgcgctttgtattggcagcgaaggcccccacagcggcgtatataccgttaccacctctgcctggctcaacccaacttacatcaatccaaaccttttttggcttcaccatcacggagaagtagtttccattcatcccttccgtacgaaaggtataaacctccgtatcggaatagattttctcaacctcaaagccgataaatttggtgccgaggctcacttccggcattaactcagtcaggtatttggtgctactggtctggtagagaaac

SEQ ID NO: 711038 - DNA, 1970 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctggtcaggagggcgcagggccacggggtgggggtggtgcagatgggcccaaggaggttgtcgctgcaggctttgaacctgtgccttgctgtgctcacctgggggggggtcacggtccttccacacctgcctagtcctgtgggtccccacgttcctgctggaccagctgagggaagacaccagctccgcaagaaagcttcagggagggtggccgcccctcagcccccacctggagcctggggagccggggtggggactctgctctgaggtgcactaggtctaggcactaggcctcagaacaagggtgcccttgtgctgccccccccagtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711039 - DNA, 443 bp, Homo sapiens
tccctagttaatcgaccgtgatggccatctgtctatcgaccgtggacgttgcctgcacatcggtctctggactagttgatcaagccgttttgtgtttgagggcggatgaaagcattgcatcggttctgcggcgcgttgctatgtccgatagtccgtccgggtcaccgataaactcgcgctttgtattggcagcgaaggcccccacagcggcgtatataccgttaccacctctgcctggctcaacccaacttacatcaatccaaaccttttttggcttcaccatcacggagaagtagtttccattcatcccttccgtacgaaaggtataaacctccgtatcggaatagattttctcaacctcaaagccgataaatttggtgccgaggctcacttccggcattaactcagtcaggtatttggtgctactggtctggtagagaaac

SEQ ID NO: 711040 - DNA, 1911 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgctgccgccgccgccagggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctggtcaggagggcgcagggccacggggtgggggtggtgcagatgggcccaaggaggttgtcgctgcaggctttgaacctgtgccttgctgtgctcacctgggggggggtcacggtccttccacacctgcctagtcctgtgggtccccacgttcctgctggaccagctgagggaagacaccagctccgcaagaaagcttcagggagggtggccgcccctcagcccccacctggagcctggggagccggggtggggactctgctctgaggtgcactaggtctaggcactaggcctcagaacaagggtgcccttgtgctgccccccccagtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711041 - DNA, 423 bp, Homo sapiens
ctgtcctatcatagattctatcagtgtaggtgtatcctctatagtctagctagatggcctgcaatcttgtctcttgaccggccgtttaacaacttccttcactttcagcagcccgttgctatgtccgatagtccgtccgggtcaccgataaactcgcgctttgtattggcagcgaaggcccccacagcggcgtatataccgttaccacctctgcctggctcaacccaacttacatcaatccaaaccttttttggcttcaccatcacggagaagtagtttccattcatcccttccgtacgaaaggtataaacctccgtatcggaatagattttctcaacctcaaagccgataaatttggtgccgaggctcacttccggcattaactcagtcaggtatttggtgctactggtctggtagagaaac

SEQ ID NO: 711042 - DNA, 1022 bp, Homo sapiens
ataaccatgcacactacctataaccaacctaagcctgatttgcctaattccccccatccttatcaacctcggtaatcctaataaaaaaaactcatacccccattatgtcaaatccattgtcgaatcccgaccggttcatttatcgagtctcgttcccacactaactagatattgcatgtgccgtagacgcaaggaaagttgaatgtactactctgcaaactgaccaccgttgatgccatctaatccaagagcgaatgctcagctcgtcgccttaaggcgtatacaaagctaggacctacattcgtccaataagttattcatgccctgataagcagttgtgtcggttgacgatgggtccagtcatagaagtgctcacgtgtgagtatgataaccgtacagaccgcaaaggattgaatcaggtggcgttcaacatgtatctaactcaatactattcgctaaatgtaccagtacgtaagtcttagctataacgcggttaaacaaacgctatttccaagcgtgctagcaattcggtctgaggaggggcgtagagaaattagtatcgcttctttgtctcactcagcttgactggatagctgcccgagtagaatgccagacagcagtcagatcatatcaaggcaaatccgtagtacacatccggtgtcggtggatactcggttgttcattcgcatcgactcgttagcattgtagtttatcctaacactcgcgagagtcaatgagatcccagaacaaaatagccttgtaaaaacagctaagtccaagcctgcaaccgacgagctaataaggcctcctccgtatggagggagcaaggcaatatcaagaccaattatgtgctccagcccttgaatcccctcagggcattaaaatggcgcatacccaggtatccaggcctactcccatacagggcctaatagttggtggcagggatcttttttaatcaatcgggtcaccccctatggagaaaataggcaatatccagaatctaagagcaggttagggtaacc

SEQ ID NO: 711043 - DNA, 1461 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711044 - DNA, 2366 bp, Homo sapiens
  misc_feature (75)..(75): n is a, c, g, or t
  misc_feature (1262)..(1262): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctggtcaggagggcgcagggccacggggtgggggtggtgcagatgggcccaaggaggttgtcgctgcaggctttgaacctgtgccttgctgtgctcacctgggggggggtcacggtccttccacacctgcctagtcctgtgggtccccacgttcctgctggaccagctgagggaagacaccagctccgcaagaaagcttcagggagggtggccgcccctcagcccccacctggagcctggggagccggggtggggactctgctctgaggtgcactaggtctaggcactaggcctcagaacaagggtgcccttgtgctgccccccccagtacttcatcctgctcctcatcatctttctgctggagatcatcgctggtatcctcgcctacgcctactaccagcaggtgaggggcctgggcaggccattcagagacacagacatgcacaggcggggcggacacacacacatgcacacgcgtggtagccccaaccccaccccatggtcccagagctaaccaatgtgccactcggcctggagatggggtctaggtctctgcaggggcacatggggtcaggcaggtgtccagggatccagaagctctctctgcctctgccgcacttcattgtcaccctggtgacggtcctggcaccacccaactcccctcatgccgaggtctgacctcagcccttccctgtggctctgagctgggccccgggcctccccaccggcatcctggggctctgcnagcccaccttggaaggtcttagactgaggctgaagtttcctgcaccccaacccactgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711045 - DNA, 190 bp, Homo sapiens
tatacgacttgagctttaccgtacgtgtagacggcctgtgaccccttgtgctcttgtgctcttgtgcccttgccgcgttggccctctggcaagagtggtgatcgtggtgagactggtcctgctggtcccgccggtactgtcgtgcctgttggctgcccgtggccccgccggaccccaatggcccccgtgt

SEQ ID NO: 711046 - DNA, 243 bp, Homo sapiens
caagtggcaaagagcagatcttgcttgcagaaggataacagagtcggcgtcgctagacatgagtgtgcgggctctgttgcggaacgatgaggcgtacgacaagcgaaccttggaagcgaacccgtgtgcccatgtgcagaaagagatcaccgcgctggcacccagcaccatgaagatcaagatcatcgccccgcggaacggcaatatactcgggtgttggatcgagcggctccatccgtggcc

SEQ ID NO: 711047 - DNA, 2307 bp, Homo sapiens
  misc_feature (75)..(75): n is a, c, g, or t
  misc_feature (1203)..(1203): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgctgccgccgccgccagggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctggtcaggagggcgcagggccacggggtgggggtggtgcagatgggcccaaggaggttgtcgctgcaggctttgaacctgtgccttgctgtgctcacctgggggggggtcacggtccttccacacctgcctagtcctgtgggtccccacgttcctgctggaccagctgagggaagacaccagctccgcaagaaagcttcagggagggtggccgcccctcagcccccacctggagcctggggagccggggtggggactctgctctgaggtgcactaggtctaggcactaggcctcagaacaagggtgcccttgtgctgccccccccagtacttcatcctgctcctcatcatctttctgctggagatcatcgctggtatcctcgcctacgcctactaccagcaggtgaggggcctgggcaggccattcagagacacagacatgcacaggcggggcggacacacacacatgcacacgcgtggtagccccaaccccaccccatggtcccagagctaaccaatgtgccactcggcctggagatggggtctaggtctctgcaggggcacatggggtcaggcaggtgtccagggatccagaagctctctctgcctctgccgcacttcattgtcaccctggtgacggtcctggcaccacccaactcccctcatgccgaggtctgacctcagcccttccctgtggctctgagctgggccccgggcctccccaccggcatcctggggctctgcnagcccaccttggaaggtcttagactgaggctgaagtttcctgcaccccaacccactgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711048 - DNA, 2471 bp, Homo sapiens
  misc_feature (75)..(75): n is a, c, g, or t
  misc_feature (1627)..(1627): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagaaaaaaaaaaaaaaaaaaaaaaaaaaaaaaaaaaaaaaaaaaaaaaaaaaaaaaaaaaanaaaaaaaaaaaaaaaaaaaaaaaaaaaacaaaaaagaaaaaaaaaaaaaaaaaaacaaagcggggcggcggcggccaccattaaattctttttctcccacggggcgacgcccgcccccccgccccccacactcatgtgcacgcacagaggcgcgcgcccccacgacgacagacggggcactcgtctaaaaacaaaccgacgagccgcggcgcgccgcccgggacaagacacaacagacagcgagcagcgcgagcaggacgaaaaacgacgccacgcgcggaagccgcgcgcatgacgaccacgagacgccagcaccaaccaaacccgccggatcaacggagcaccacacaaagcaacgaggcacacggcacaccaccccacaaaacatagacccaagagcggagcgcgaggagctaaaaaacagcaaaacaacgcacccgggcgagtcacaacataagaagaatacaagcaagccacaaacaaagaatagcagaactaggtgatcgtgagcagtgaaaaccacaagcacagcgcgacgaccaagcgcggacaagcacccgtcagcgacgcaaacatatactaccaccccgcggcgcagcaggaacaaagacagaaaacgacaagcaagccacaaaggaacagagagcatagcacgcacgagcaacaagaccacacaagaaccccgcacaacaagacaaggagagacgagatgcaggccgcaagcaccacccatcagtaccacccgacgcgagcagcgacgacgcgaacgagcgcccgagcaccagcgacgtaccgcagccacacacagcagcccagagccaccagacacccaccgacacacgcc

SEQ ID NO: 711049 - DNA, 123 bp, Homo sapiens
tcctgggttcaagcaattctctggcctcagcctcccgagtagctgtgattacaggggcctgccaccccacctcatgcctggcccccctccaggcatgctggcctcccaataaagctggacaag

SEQ ID NO: 711050 - DNA, 1458 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcagggggccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711051 - DNA, 1610 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711052 - DNA, 1613 bp, Homo sapiens
  misc_feature (1241)..(1241): n is a, c, g, or t
gcacttgtgtgcattgtttcaacaagcattgctgtccgtctccgctattacatggtcgtcctgtctccattcctcgtgctgcggcagttgccagccgtacgcgacatctgcggagactggtggaagaagcatatccacttaacgtgtatgatgtcctgtgccacaggactagcgataccacttgcagcgggactctcactggagattatcagatgtgttttggccaattgaacgtgcgacaattcggtggcgagcgaatcgctacggctagggtcccaggtggattgcgccaaacgctaggaatccggcagacgcgaagggttgcgttggggaaggggcttgattcaacgctagatttgtaaccaagatgcgccaatctcgcgactcgcgatcgcggttgtcgatcgcgttaacactaatcggtgggaggaacctaagcgagtacgccatgaccaaacgcgttgtggaccgcgggcatttcagtcgagtgtctagtttaccagtaaccaacattggtccatgtcccgacctaaggaggtgaggccgaataccagtgattgactttgcactattcgggcatgggcgacaaagtgccccgttgtgttctgttgacatatccctgaagagaatattcgcgcgtgagttacaaagcacctaaagttgaggaagacagttcgttagaattggcccgcgctattcctaaaggcgtattacgccgtaatcctagtggggcgcaccgagggacaaacatccctgttgtgtataaagggagaaaacacttataagggacgcaaacatgccgttctactagcggtaacgttgatcctggtgccctacgaagcgacattccaatggggggggggcccaatgcagatgttacaagccacaaaacctttggaggatggttcacccaaacttaagcggatgcgccaacccaattaactaaccacatttgcacacggggggtggactgtcacccccttgttaaaggcgcaccacttagtgggcgattcctgtcggcaaaaattcttatcacgtttggggattatccgccccgtttgggtgggcacagttttgggcttttcgggtgcactacatgccagggggggcacacacaagtggcggggaacagcggggcacaacagcggaacggcaacacggacccactcgtgttgtggtacacactcggctagggcacggcacactattgcacccaaaagggaggggcatcgatatatagncccggagagcacacgatatgcgacaacccccctatcgcgcaatgtgatataccaaccacggttaggtggacagaaccacgcgcaggtacgagcgggaaacccccaatcagacagagtgtgtacccatatcagagtctggggtgcagaacaaattgggagtcagctatcttagacggttaccgaatcgcccgctatgtagaggttatccaaaccaccgttggtggtcgggaaacgtatcgcccagacaagagtaataggagctaaaaatgttacacgtccccctgtgtgcacgttttgcccagacgaaattttcgatcttggagagacatcgttaatgctcccagttatttaccaggagggcatgggtctatg

SEQ ID NO: 711053 - DNA, 287 bp, Homo sapiens
tagcatcgtttactagccctattgattctggtgtggctaacgtttgagaaccactgtgaagattttaaattgggaagtcgctctattccccagtttagaatcaattattatcatttttttgagatggggtctcactctgtcgcccaggctggagtgcagtggtgcgatggctcactgcaacctccacctcccaggtccaagcgactctcccgcctcagcctcccgagtagctgggaccacaggcgagcgccagcacgccaagctaattttattttcagtagagatgg

SEQ ID NO: 711054 - DNA, 356 bp, Homo sapiens
gcggatgagggcagtcaggtacaatcatgatgatacgggcaacagtccttccatacactttaaatccagtctcttgaggacagagaagcctggtacttttctttaatcaaaaagatacacagaatcagcagggtgagaaacaattgcacaaaagactccagctatgtaacctgctacaaatgttacaccagctgctctggctttgaacattcactggcgggcttaggaaccacaaacttgtacagtgcttcaacagtacgttcaaagcaggcgaacttcatcatggtgtatggtatctgtctcatccagagaggagcaacccccttgtagaatgcttttagcccctcatccgctta

SEQ ID NO: 711055 - DNA, 532 bp, Homo sapiens
catgtaaaagacagctatatcaccgtagaaacacagtgttgaatagagtatatagcaacactagctcccacatgctaaagttacttgtattattgggtacttaatatatattaaatacagacctcgaagcaaatgaatttcaaaaatctatccattcaggaagaatatgtgtaacaattcaagcctgatcctggcgttcgaatgtaaaaaaatgaatcagttaagggtaagtagacataattagaatcatattttagtcagaactgtaaagggtggatcagaaggacataagattactggaagagagatcacaagtggtaacagacatcatctgggtcagattatcccaaagtggggtgtgtgtagcccaggcaagatgaaccactggaaagagttataaaatcagtattgagatacaattcacataccataaaaacacccctgcatgtctaacagtgctgaactcgtatatgagtattcaaaaattttactagctccttaggcacagagacaaaatttaaagctttcttct

SEQ ID NO: 711056 - DNA, 693 bp, Homo sapiens
cacaaagtgcacagtggagaatcgagaatcgatagggttacttttgggagcagtggcttataccattcacctctgttatatgggtgattatttcacagataactgacgaccttcataaccaaatagcgcgtacacacacaatttccacatttgacaccctgatacgaacacataggatgtacactaaacacttgcgaaggatgtgactactgtttaccggcacttgaaaacccgtagacacactctcaacttgcgacgagaccaacgacactgggctcatccagactggcctttaggacctcaagcactacggagatgccaagttgagacagcaagggaacgcccatataataccccgatggcacgcgcgacagttgatcgccttagggatacaacaacccaaagacgcagggcaatcattagatcatattaatacttttccaaagaacatgtgcttactaggtaggagccccataaggcgatattcgcagactatgtgtccatattatgggcgccggaacaagagcggtcaggtggactattccttgagctatgtcacccagttactacacccgctgtggggcaaaaattattcattggctaagcgagcaaccgaacttacacttgggagatggcacccctcattaaaaaggcacattaaccagttcaaggccacctactgcagggacaaac

SEQ ID NO: 711057 - DNA, 115 bp, Homo sapiens
aaagaatcaggctttatttttgttattttaatacaggtattgattgagacatctgttagtctcataattcagtattggccaacacacagaaattaaaagagaaacaaaatgaggg

SEQ ID NO: 711058 - DNA, 1088 bp, Homo sapiens
aatcccacccactcaggagactgaggcaggagaatcacttaaaccggcggaggcggcaggttgcacatccagcctgggcaacggcagactccagactcccaaaacaacacaacaaagatgaacaaaggacacataccacgcagcatcacaaaccataatcatctataaccactcctcgtacacccaaaaaaatccaaccgtgacaccagccaacaaaagggaccaatccagaacagcacccagggcacagatacaaggagccaactgggggcgcacaaaaccaatatcagaccaaacacactacacgccctaacaaggcgccccagaccgcacacacaccgcgccacaaaaccaaaggccggcacgagcccgagcgcacgcgggcacaagacaagcgggagcagataccatgtgccccccaaggtaaacatccaccccaaaacgaaccgctactacaagcaagaacgaaggcgccagcaccagaccggagaagaacggaaacacacacaaccactgcgacagtgacacacaggccacaccaaccacacacagacaccccacaaacccaagggccaccacaaacccaacacggccagcaaacaccacccagcgcaggagcacaacgccattaccaccacaacacaataacacaaaccacaccaattactaccccatcgatcgcgacccgactgagggaggagacgcgggtgacaacacagaccgccaaacaaccccccggaggcagaccacacaaaaacgcggaacgtagcccagccacaagacacacgggacagcaacacgcggcaaaaagcagaacacgaaacgagaaggtcagagacacacccccggaggtacacgcgccacgagcggaaagcaccataccaagcaactagacagtgaacgacagccatgagccagccaaaccacaaagaagacgtagagccgggcgaccacaacgacaggagaccaagcaacaaacaaagccgacagaaccccatcgagaacaagcaacagacacaaaaaacagcaacaaaaaacacaaagcgacgcaacacaaggggtactagacgcagaaggacacagaacgc

SEQ ID NO: 711059 - DNA, 240 bp, Homo sapiens
aatatactagattataacacaaggatacctggaagcaaacctaccatccctgttactgatatcccaaacacaggccagcagccgaagagaagaaagaaccataccagtaactggtgggtaacaaacagaactgtcttggactcgagatgtttccggatagcactattgcagatgtggttgcccacatcggcatctaaagcactgagggagtcgtccaggatgtagatgctcctgtcacta

SEQ ID NO: 711060 - DNA, 1097 bp, Homo sapiens
  misc_feature (43)..(43): n is a, c, g, or t
  misc_feature (421)..(421): n is a, c, g, or t
  misc_feature (488)..(488): n is a, c, g, or t
  misc_feature (495)..(495): n is a, c, g, or t
  misc_feature (541)..(541): n is a, c, g, or t
  misc_feature (581)..(581): n is a, c, g, or t
  misc_feature (761)..(761): n is a, c, g, or t
  misc_feature (808)..(808): n is a, c, g, or t
  misc_feature (826)..(826): n is a, c, g, or t
  misc_feature (839)..(839): n is a, c, g, or t
  misc_feature (844)..(844): n is a, c, g, or t
  misc_feature (848)..(848): n is a, c, g, or t
  misc_feature (850)..(850): n is a, c, g, or t
  misc_feature (859)..(859): n is a, c, g, or t
  misc_feature (862)..(862): n is a, c, g, or t
  misc_feature (866)..(866): n is a, c, g, or t
  misc_feature (872)..(873): n is a, c, g, or t
  misc_feature (875)..(875): n is a, c, g, or t
  misc_feature (880)..(880): n is a, c, g, or t
  misc_feature (895)..(895): n is a, c, g, or t
  misc_feature (899)..(899): n is a, c, g, or t
  misc_feature (932)..(932): n is a, c, g, or t
  misc_feature (958)..(958): n is a, c, g, or t
  misc_feature (962)..(962): n is a, c, g, or t
  misc_feature (982)..(983): n is a, c, g, or t
  misc_feature (985)..(985): n is a, c, g, or t
  misc_feature (991)..(991): n is a, c, g, or t
  misc_feature (997)..(997): n is a, c, g, or t
  misc_feature (999)..(999): n is a, c, g, or t
  misc_feature (1055)..(1055): n is a, c, g, or t
aattcgcggccgcgtcgactacggctgcgataagacgacaaanggggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaangaaaagccgcagaattagatcgtcgggaacgagaaatgcaaaacctcagtcaacatggtagaaaaantattggncacctcttcctagcaattttcctgtcggaccttgtttctatcaggnattttctgtagacattcctgtagaattccaaaagacagtnaagcttatgtactacttgtggatgttccatgcgtcacactgtttcttaatatcttcggatgcttggcttggttttgtgtggattctgcaagagcggttgattttggattgagtatccagtggttcttgcttttaactccttgttcatatatctgttggaacagaccactttatggagctntcaggagtgacaattcatttagattctttgtattcttcttcgtctanatttgtcagtttgctgtncatgttctccaanctgcnggantncataactgnggnaatngtggtnngntttcntcccttactggtcanaacnaaaaaatacctattgggataatgatgatactcntagcagccctattcccagcatcagcngtgntatccctcgtttagtaccannangtacanggactntntcgcccccaggtgctcgtattgaggaggccccccggagtttgcaccggtgtgctgncccacaacctaacagcccgcgccgccctgcgcttccctgcag

SEQ ID NO: 711061 - DNA, 156 bp, Homo sapiens
gtaaccaagtgtatcactgttcccggtactaggccagagtgtcttcaagagtttcttcaagtccccgtacgaggcctaatattagaaggggagcaacactgcgcttatagtgcgacaccatgttcatatcaggcctttaaaaaggatgtcttacca

SEQ ID NO: 711062 - DNA, 663 bp, Homo sapiens
agctctcccgggagcaggaatcaccctgcgcgggagcgccgaaatcgtgcgcgagttcttctcattcggcatcaacgagcattttaatatcagcgtggcatatactccatctgaaccctttacgtcgagtgcagaatatacggactcacctgtgctgtgtaactacgtgatctgtgagctcataaaatacctaaataatgtggtggaaccaagtgaaagatggggttatacaagtgttcagtccagaaactggtgtagttatctcaaatattgaacagtggtgaggtcctggaaaaggatgggcagttgggatcattgagtggtgacaagactgcaaaagatgacagtgcacccagagaaaagtctcagaaagctatccaggatgaaatcggtcagtgatcagacagatcacagctacggtgacatttctgccactggtgggaaagtctctgtgtcatttgggatctgctgattttatacagacaaagattgggtgtgtacctgaaaactgggaagagtcgggaccacagtttattaccaattcttgaggaagtccgccttcgtaccatttactactacaaatccacaagagtaatagcctggtgtgctacaaaatctgtcatgactggggatgacatgaggaaatactgtcatggcattcga

SEQ ID NO: 711063 - DNA, 419 bp, Homo sapiens
  misc_feature (125)..(125): n is a, c, g, or t
  misc_feature (129)..(129): n is a, c, g, or t
  misc_feature (139)..(139): n is a, c, g, or t
  misc_feature (155)..(155): n is a, c, g, or t
  misc_feature (182)..(182): n is a, c, g, or t
  misc_feature (246)..(246): n is a, c, g, or t
  misc_feature (271)..(271): n is a, c, g, or t
gcacgcctggtttgtggggggggggggggtcagggaacattattctgaagaagagaaactaccagtcagacctccagataaatgaagtgaccagaggagatgggagggggggagtgcttctgtcnttancccggtgcantgctgtgtgtatctanttccagctacttgagaggctgaggcangaggattgcttgagtccaaaaagtggcagttgcagtgagtggagatcgcgccactgctctccancctgggtggcagagggggggggctntctcaaaaaataaacaaaaacaaaatgcttctgtgagttaacaatctttattagagggggtttagtctttctttctcagctcgatgttaaggtgggtgacaaatggaaataaacgtctttattatcctttttttctgaaaaaaaaaaa

SEQ ID NO: 711064 - DNA, 888 bp, Homo sapiens
  misc_feature (368)..(368): n is a, c, g, or t
  misc_feature (506)..(506): n is a, c, g, or t
gatatacaatgctgcaaagagtcacagggactctaatatcgaacatgaagcgtggactacagagtagcgcttcctctgagccgagattcagagagtagctgcagagaccccctaggtgtatttacttggtgtgaagccttcgatagcacaaggacgtggctccagacgtgcccagtcctcaacgtgataggtgctgtgacacgatcttctagatcaaactgggcttctcgcgttgcttcctaccataaatggagagtggagaatatcgatgctgaggacggaagcatatgcatgctacaggcacgcgacactcagtagaggtgagatctacggatgctcggcagtctggtatcgtgattctgtggacngcggattcagaacgatgatatgccttatgcggaggaattcccgaatcgtgaggaccagtgataggctcgcccaccagaaacagaacgcctagacgttacatgtagggtagggtgggacgtgcaagcgtaagcttactntacaatcaccgcagcatagtagggcgttctaagcctctctagaaagccctggaacttgatcggagtctggaccctgatggctttggtgtagaccttggagtaaaaatttgacctccctgaggaacccatctagccagaggactagttatcaacaacagcctagtgcagctgcaatgcgtcacatcagcagcaagtccttgccaccccgccaggcttccgccctgtgtgccagttgtgaccgagtaccgctggatggccacaccatctcagacctgagccggagcagcggggcgagctgattcccatctcccccagcactgaagtcgggggctctggcattgggacaccgcctctgtgctcaagcggagaggaagagcgtgtg

SEQ ID NO: 711065 - DNA, 838 bp, Homo sapiens
tggaaaaacccagctgactttattggctctgggggcagggggctcagagacctcttggtgggggcgggctccgtttcctcttcaccatcacaggcttctggctgcccaggatggccgctggccctgcggattggctgccatgcccaggtcggggcggtacttgtctcttgcggatcatgtgtctgatgctgctagagcgtggccgcgagcattcttgttggatggtgggtcccgcactataggaggtgggcaggtcttccgtcgggccggtatctccgtcttatatgacccaccagcgaccctctttgccgtcggtctgccggttccacgcccacgagtcttgcggtgaatcagcccgtttgtaccgggaaggaattggcggggccttcaagttaattggggctcagtggctgtaaggtctggcttaatccctctttgatcaggaaactgggaccatgttccggaaggacctatcctattggccaaatgcggcaagacattggcggggggtctccctccggagggccaagccctgcaagtttcagcaccttgccccacccaaaagtgggatctcaggtggagccaccttgttgggttcccccaaaacttggcccccattcttggctatgttttagccgatgtcttaagggttgagcctcgggatccgggggtctgggccagtggccatagtgaagcctgggaatgagtgtaactgaagcatctgggctgcagcacagggaagggccaagcccctttgtagcccaagtaatccgtgccagcccttgctctggggcattgccggaaggggtggaatcctataggaatcgctatcaagcca

SEQ ID NO: 711066 - DNA, 342 bp, Homo sapiens
gacattaatcaattatacctgtatactgaagccgccctaacactcctaaatgaggccggatatagtggctcacgcctgtaatcccagcactttaggaggctgaggcggatggatcacctgaggtcaggagttcaagaccagcctggctaacacggtgaaacccgtctctactaaaaatacaaaaaattagccggatgtggtggcgggtgcatgtaatctcagctactcgggaggctgaggcaggagaattgcttgaacccaggagggtggaggttgcagtgagccgagatcacgccattgcactccagcctgggtgacagagcgagactctgtctgggggaa

SEQ ID NO: 711067 - DNA, 319 bp, Homo sapiens
  misc_feature (113)..(113): n is a, c, g, or t
tgtgtgtttgggaattgcttggggttgggggtcgtggggacaagggacacttttggaaacaaaggtggccctcggtgccgtcctgcgcaaactctcccgtcccacgaaggccncggggtgggggctggggggggtgcccccgaccgttccgcttttccggccaggtgcttttttgtcaatttttatggaatgcaaaaggaggtttttgttttattttgtttttttgtaaagcttaaaaaaaaaatttcctttttatacttgagcctccatacttaaaaaaaaaaaaaaaaagaaatcaataaaaagaaactggggggca

SEQ ID NO: 711068 - DNA, 879 bp, Homo sapiens
gaaccgttaatgtgtacgctgcgggaaattcagaccctgggaacatatggctcgattgagcaggactgtgctggagcgctgcacgccaggtcgaacagtaagaatgaaggaatgtcagccggtgcatcgggcggttcgtgaccagctggacagtgcgggcatggtagtcgaagagtcacggaagattatcagtcagagtgacggaggtatgcagccctcctggtgtctcaggtggtagccactttacaccatctgatggtggcagcttcattgtggctgcaatgttcgctgacatgtgtcggtgcctatgacgatacgtaagcgcagtcgtgatgtggggcaggagtatgggcctggttacgccaattcacgcagtgagcttttcggctacacctgggtagatccgcgaggggtctcagggagagcattcgatatagctaggtggcgaaaagaccagttggaagatggtcatggctacgaatgggtatctcaccaggtgatgtgctctgcttgagctctcgaggggaagtaacctagtgatggggatcggggggacgcttgagacctaatcggtcctgtcgagaggattgttgatctcagagtaattgatttttggcgaaactcacgataaatagtgccaagaactctgatcataggtatgactttgtgacagaagactaggtgaggaaccaatgatatggggtacctcgggcagctattggaatcgttgtactaaggagaatagggaaatgtaggggtgaatgagaggtaaggaaaaaagctggtggaagtaattgattgcgtaaagggaatgaatagcatataaccagggattggctgtagtgggaggtcggggaccattgagcgaggggttgtggg

SEQ ID NO: 711069 - DNA, 300 bp, Homo sapiens
ggcgttctgtgaagtgttgacgactttgagcctggaggaggacccgtatgctcctgccaccccagaggccacctctgcattttatcctgggcattttcacagtgctcctctgcaccctaagcaaggagtggcatgttcagtgtgcaaatggcatctttagaccccacaacggtgaaaaccccgactgtccacgtagggcccaggtccgctgagcaccgagcatcaaaagccgtttgcatagccaggtgtcagtcatttcagatgaaaaagacgggaagatcggagacagctcccccgggt

SEQ ID NO: 711070 - DNA, 607 bp, Homo sapiens
ctgcatctcacacaagtgggacatggcctgctgctggtcagggtgagaactctgcctttaagttagaatcaaatcaaatcaaatcaaattgaattctttaccccagtggggtagagagcaccgccaaatactaagctacaggaatgtggcccagaaagcaaattaggttttatttctgcctcctgcctttgccccgctgtttctggaagagaccccatagacagtgccgtgaagggcagcctacggagtctgtggcaggcagggactcgcaggtgagcctggtagtgggtcggcgggttctcatccatggcgctcagcccgtctgaggtcatctgccctcttcttcattggattctggaagcctccccaccagcctgcgagatgcagctgaacagggacttgttttgtttactgctgcatcccagggctctacacttgagcctgacatagagtagggctttaataatctttattgagggccgggcacaatggctcactcctgaatcccagcactttaggaggccccggccagacagatcacgaggtcaagagatcaagaccatcctggccaacgtggtgaaacccagtttctatttaaaaaaaaaaa

SEQ ID NO: 711071 - DNA, 1136 bp, Homo sapiens
catatgaacagaaagcagctaagctaacaggagaaatatgcaaacaggcatattgctgcatatcgtgccaagggcaacaagtgcaagccaggaacagaagtggccctgtgcaggcgcaacaggctcaacagaagaagaacggaaccgaggcaagcatgcaggcaggcaggcaggcaggcaagccaagcaaagcatgcaacagccatgcaggcaggcaagcaggcatgcacacgcatgcacagcacatcaacatgggctcatccgttttcaatgcatggcagttgtaggcaatagatagtagtagtggtagcatctagggcaaaattcatatttatggctacagaaatggtgcacatttcaaggtgccaggctccaaatcacatcaagcctttcccacgtcatccaacacacacataggtgaacgatggcaatctctatagactggtacattcaacgccctaggcaattcaacaaggcaattatccgttcctttgggttcaacgcaaggcaacacaacagttcaccttcttaccctaagcacaagccaacaacacagttgcgccccacaggtgcgtgtattactgggattaacgtgcgccggaattcgtatacacaacaacagggagaacctttgggggcaggcgcccgtatcacgcataccacaggttaaaccgacacggttcttaacggacacttcagtaataaaccaaaggtccattagtccgtggggaaagttggattgagggaagacagtgggtttaaaccctttaaaagactataaagttatataacagtggggatatagaagatgagagaaaaaaattgcaatccaaaatggagtggcttaatttgggtatacaggacaaccgcacggggtcaccacaacccttatgggtcacgcgcgcaaccacttctaaggcgaatcagttccacaaccttacggttcaaacaaatctcgcagggaggcggatcaaacgagacaacacgcggaacctgggctccggccacattacttaccgcgtttaccatctactccaccccgacaccaacacaccgtcagccgcgtaaacgttacacaacctcacagcttgagcaattagttacacaccacccacaagaccacccaccgacaacac

SEQ ID NO: 711072 - DNA, 649 bp, Homo sapiens
gccaccttttcatggatgggaatgtagcgttctgcagcaggctatggttgtgtcctgaacagcagaggctgcccaggaggctggtcagggtggtcagtgagatcaccttgccccataatttccatgcttcctttgtgtgcaggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtaggtaggggctcagtgccgcaggactgaggcctgtgaatctaagagggttgagcatgaaggacatgcgcagccttaaaagggggcacaggccaggtgtggtggctcactcctgttgccccagcactttgggaggctgaggcaggcggatcacgaggtcaagagatcgagaccagcctggcctacacggtaaacatcatctctactaaaaatacaaaaattagctgggcatggtggcgcgcgcctgcatctcagctactcaagaggctgaggcaggagaatcacttgaacccgggaggtggaggttgcagtgagccaagatcgagccattgcactccagcctggtgacagagcacgactgtctcag

SEQ ID NO: 711073 - DNA, 2934 bp, Homo sapiens
  misc_feature (1012)..(1012): n is a, c, g, or t
  misc_feature (2930)..(2930): n is a, c, g, or t
ccccctttgtcaacaacaacccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggnaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaaaaaaangtct

SEQ ID NO: 711074 - DNA, 2911 bp, Homo sapiens
  misc_feature (1012)..(1012): n is a, c, g, or t
  misc_feature (2907)..(2907): n is a, c, g, or t
ccccctttgtcaacaacaacccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggnaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaaaaaaangtct

SEQ ID NO: 711075 - DNA, 1206 bp, Homo sapiens
  misc_feature (75)..(75): n is a, c, g, or t
  misc_feature (1126)..(1126): n is a, c, g, or t
  misc_feature (1131)..(1131): n is a, c, g, or t
  misc_feature (1206)..(1206): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctggctcctgatgacaccacctgtgctcacataactctgggacccaactcgaagcnttcantgctttgtggccgccatggcccaggaggcgagggggcgcgcggcgcacctagggcggttgtggggcccgcaattn

SEQ ID NO: 711076 - DNA, 2459 bp, Homo sapiens
  misc_feature (1012)..(1012): n is a, c, g, or t
  misc_feature (2455)..(2455): n is a, c, g, or t
ccccctttgtcaacaacaacccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggnaccaagtctgtctttgggcagatgtgtgctaagatgagctcgtttggtcccgacagcctcctccttcctcaccgtgtctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaaaaaaangtct

SEQ ID NO: 711077 - DNA, 1217 bp, Homo sapiens
  misc_feature (75)..(75): n is a, c, g, or t
  misc_feature (1081)..(1081): n is a, c, g, or t
  misc_feature (1083)..(1085): n is a, c, g, or t
  misc_feature (1089)..(1090): n is a, c, g, or t
  misc_feature (1111)..(1111): n is a, c, g, or t
  misc_feature (1117)..(1117): n is a, c, g, or t
  misc_feature (1122)..(1123): n is a, c, g, or t
  misc_feature (1133)..(1133): n is a, c, g, or t
  misc_feature (1144)..(1144): n is a, c, g, or t
  misc_feature (1151)..(1151): n is a, c, g, or t
  misc_feature (1156)..(1156): n is a, c, g, or t
  misc_feature (1159)..(1160): n is a, c, g, or t
  misc_feature (1168)..(1169): n is a, c, g, or t
  misc_feature (1182)..(1182): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggtcctgntnnnaccnncctgtgcatccatactctggngaccanctcanngcagttcagngctttggtgcncatgccnagggnggnnggggctgnnggaaatggggggntggggcccgaatccttcggtgatagtgaggtgtag

SEQ ID NO: 711078 - DNA, 702 bp, Homo sapiens
  misc_feature (702)..(702): n is a, c, g, or t
ggcaaatcagtgatgcagcgaaatcgtcagcatcagttaaatccactgtcatcacaaagaaaagggctggaccaattgatgatatggaaaaattacttgaggcagtggaagaacgttacacccacggcacctagaaagttcacaatgtaaagatcactggtgaggcagcacgtgctggtaatgaaggtgcctatagcttttaaggaacagctgcataggataattcaatggctcaaagatctttgcaataaggagctgattgcactggagcgcaagaaacgaggtaaagcgcgtggaggcagtggacagaagttacacgttagaagaaatggacgtctagattgactgagagattcgccacacgttgacgaggcgcagatacaggaatgctcttgcttgctaccagagacaatattttgtgaaaagaagaaacaagctgtacggtcaagaacttggtatcttcctgaagaacaacactatgcttgctaaaccagtcaactagtgttgatgtcccaatgccttctaccacctattctcgatgttcatcagaagagagagaaattgaggaccctgttgcatccccatcatccagcaattaattctatttcagtgcttcaaacatttttcaggacactgtgctttcagctgtgtaaattaatgatgccctccaaatccttggttatggaatattgggtcatccan

SEQ ID NO: 711079 - DNA, 2539 bp, Homo sapiens
  misc_feature (1012)..(1012): n is a, c, g, or t
ccccctttgtcaacaacaacccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggnaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaa

SEQ ID NO: 711080 - DNA, 1412 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 711081 - DNA, 909 bp, Homo sapiens
ccgtggggcccagtatttgggccgccccccggaatatcttgtgggcgcaggtgttaacatttttgagagagtggcccccggccagatttctttgggggcacgcccacaaaagggttcccccactcttgcggaaaaacgtgcttgtgccttggtgcccgaggtttctaactgccttattggggcaatttcagccgggagccataacccctctggcctttgctttcgggtaaaattcccctgctgactgacgtgcggtggtccgcccacagacccacgcttgcggcgccgagtttctgtcttacgaccacgtcagccttgcccaccacggacccgtgcccggggtccaacccacaggatctccgcttttgcaaagcaaccaagacatcgctgaggttgcccgaacttctcaaaatcctcccgcgccaaactcttaacacgacggaatttgattgtactacatcacgcatcatacagacctttcttgttaaaaacaccccctgatacacttctgtgcaaaaaatatctataacaagtacttctctccgcgtcttttgcggctgtccccccccgttaatagcatacacccccttgggtgcccttattctttgccttaataaaggccaatccaaagaatccttctataactatggaagcagccttgtttcttcacatagaatttacatgaggcgtacatagaaaaattctcttcgctttctataattctgattgtccataatttcccactgatccctcattggtgtttaatataggcaaccccaccctcataactatacccctgaccccacctttatgcgtaagatacacttttccacccaaaatccccactcccaagatgggatccccagagggcattttccccaaaaaattccaaaacaacaccacataaca

SEQ ID NO: 711082 - DNA, 2529 bp, Homo sapiens
  misc_feature (1012)..(1012): n is a, c, g, or t
  misc_feature (2522)..(2522): n is a, c, g, or t
ccccctttgtcaacaacaacccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggnaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccatgaatgcctttcttgnggggtgc

SEQ ID NO: 711083 - DNA, 1179 bp, Homo sapiens
  misc_feature (75)..(75): n is a, c, g, or t
  misc_feature (1081)..(1081): n is a, c, g, or t
  misc_feature (1116)..(1118): n is a, c, g, or t
  misc_feature (1134)..(1134): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcatactgaacctgcttgggcttgctggtgtggcccaatatgggtggaccctgttccgggtgggtcccgtgaacccccgtggctnccatactctgggccccccagggtcagccttgcgcnnncccgggggggcggccncgggtggcccccccccaccgggcccgacccggcccggtgctcccc

SEQ ID NO: 711084 - DNA, 2885 bp, Homo sapiens
  misc_feature (1012)..(1012): n is a, c, g, or t
ccccctttgtcaacaacaacccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggnaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaaaaaaaaaaaaaaaacaaaacacaaaacaaaacccaaaaaaaaaaacaaaaaaacaagaaccaacaacaaaccacaaaagaagagggggcgcaccaaaaatcacccgcgcggggcgcacacaacaaacaccacacaaggagtaaacgagcgacgcccaaaacaagaaacaaacagaacgaaggccatataaaaggcaggccgggaccaaaacacccgaggcaaccacgacgacaacccccccggggggaggaaaaaaggggacacacacccagagaaacaacccacgagagacacaagcagacatacgagaaagcgagcagcgggaaaacacaccgcaactagaagc

SEQ ID NO: 711085 - DNA, 1300 bp, Homo sapiens
  misc_feature (75)..(75): n is a, c, g, or t
  misc_feature (1202)..(1202): n is a, c, g, or t
  misc_feature (1237)..(1239): n is a, c, g, or t
  misc_feature (1255)..(1255): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctggcccataggctcctgccagcctgtgacgtgcggccccgggaatgctgtggggagcgggcaggctggcatgagctcaccggaggtacccgctagggcttcctcccccggccgccagcaggggccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcatactgaacctgcttgggcttgctggtgtggcccaatatgggtggaccctgttccgggtgggtcccgtgaacccccgtggctnccatactctgggccccccagggtcagccttgcgcnnncccgggggggcggccncgggtggcccccccccaccgggcccgacccggcccggtgctcccc

SEQ ID NO: 711086 - DNA, 254 bp, Homo sapiens
actctagcaggatcctgaaggtggtcgtaggtagggtatgtagtgagatattttgttgttgaagcttagggtgtagatctggtctggtcaatggcacttaggcacagtgatcagttggtagactcttgctcagttgtggctcccctatatttccttacagtagcagctgtgcttcttctcagtgccccgaaagcatgggctcctttcccacttaagtgttggctatagatcatggcttggcacttccaggatgc

SEQ ID NO: 711087 - DNA, 942 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggggcccggactcggacgcgtggtatagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctgctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtagggggctgccgtccgactttggggggggttgtggggcttcccgacatactctttgctcgtggcagaatccggtggaagggccttctct

SEQ ID NO: 711088 - DNA, 203 bp, Homo sapiens
atcccattcaatcgcggtgaagccatcaaccagtccagatttagtgtaattcctaagggcccataggatttctggaatcataaagtcaccagctgcatttagaccctaacaggagagtcagcctgtcctttgaagctttgaagctaggacatgatttctcctctctagctatgaaaatcctagatcgctcaccgcaatctaat

SEQ ID NO: 711089 - DNA, 676 bp, Homo sapiens
  misc_feature (374)..(374): n is a, c, g, or t
ggccctggggttttggagtttccccccctgcgggggttgtggccaatttttgctcccgagggtcccccatttttgaaatttttggtttcccgccaaggtctgtgccttagtggccacttgtattggccccccccccccaaagcccttcctcgccgctgaggggtttttttttaggtgaacacgggcccggtttttccttccccggttctttaggttttccccccaagcctgtggccaggggttgggtttttggcccccccaagcagagggttcgggttcccgtttttgttttccaaccccaaaaaaagaaccctgtgtgggcccccgggttttcccccccggggggggaatttcccgccccccccaggggtggntttttcctttttaagggcattgtcccccttcggggcccccagggggcccgggggtttgggggtttttttccccccccggccccccaattttggggggttttttccccccctaaaaaggtggggccgggcccctttttttttttcccccccctccggggcccgtttttttgttttttagggggggggggttttttttccccgggaaccctttccttggtcccccccccccccgtcccccccgtttcccagtttagggcccaagggttttcagggggtttcccttaagggttttttgggcccca

SEQ ID NO: 711090 - DNA, 819 bp, Homo sapiens
gaaatttccatttatattttgtaggtgtgacaagaagtaagggggtgaatgattaaacagattgtcggggataatagattgactttatgagtaggattctgggctgaagaagtgggtataggaacatagcatgaaggagaagaagcctaaatttgaaagtgtttaactactaaggaactaactcatttatttttactatacatgagaatgaaggggtgtcaacatgggtgggtgaatatttagaaatgtggtactggaatatgtttaaagataggtgatgtgaacagattgttaattgaaaaatagccaatagtttgagacgagcaccagacgaaatacgaatacttgggtcagacctactttagcgttcctcttgtacaacaatatcaatcttcagaaaattcgtgagattagcatagcgtgaagatatgtcatagaaacactcagggtgctgcagcctttaaactcggcaatggcccgcatcaggtgaaaccagcatggtgtcctgacgaaaaagccgctgcatgacgctgggggagagaagaacagcgattcaaggatacaagccgataataaacgtaggcggcagagcaaacaaagtaaatcccacacgacccattggctggaccggacggaaactagaaacgcatcgcacctaaaacttaaagaaacctggacggaaacggggagctatatacttcaccaccaaatccacctttaccttaggagtaatcgccaaacgaacttgtttaatagaacccacggtgggcgaataaaaaatagtatataccccctccatggagcgtaactattttaaac

SEQ ID NO: 711091 - DNA, 126 bp, Homo sapiens
gccattgccctcctcacaacccgcactctttccctccgccaaagaccggtggttgaggcgtcacggcaagcgcgaagcgcgaagcacagcggaaacgggagcgccatggccgggagcgcgaggtcg

SEQ ID NO: 711092 - DNA, 140 bp, Homo sapiens
ctgtgaacctaaatgatgctctgcaacaataaagcctactacaaaaaaagttgaaacgatgccatgtaaagcagaatgctgtccaatacgcacaatctcttctccctaatagctactgttcttggccagagctacttgaa

SEQ ID NO: 711093 - DNA, 285 bp, Homo sapiens
  misc_feature (140)..(140): n is a, c, g, or t
  misc_feature (182)..(182): n is a, c, g, or t
aatagctgtataattacgctgttatgatgattaaggcccagtgatgatgcggtgaaaagctgtcttagctcaagaaaagtagggagacaaatgtagcaagcagaaagcaacacagatttgggcagactttgccagaatgnaagtctaacacttagattagcattctcttggccaagtaaganactgcagttgttgtgggtattaccctacaattaccatatgtattttttattagattaaactcagcattaaatatgcttgtataattacgctgttaatgatgca

SEQ ID NO: 711094 - DNA, 397 bp, Homo sapiens
  misc_feature (40)..(40): n is a, c, g, or t
  misc_feature (42)..(42): n is a, c, g, or t
  misc_feature (45)..(45): n is a, c, g, or t
  misc_feature (118)..(118): n is a, c, g, or t
  misc_feature (323)..(323): n is a, c, g, or t
  misc_feature (344)..(344): n is a, c, g, or t
  misc_feature (370)..(370): n is a, c, g, or t
  misc_feature (383)..(383): n is a, c, g, or t
  misc_feature (395)..(395): n is a, c, g, or t
tgtaaaaaaatattttttctatctgcctgctgaggagatncnacncttgaggtcaggatttcaagatcagcctggccaacatggtgaaacctgtctctactaaaaatacaaaaaattngccgggcgcggtggctcacacctgtaatcccagcactttgggaggctgaggcgggcagatcacgaggtcaggagatcgagaccatcctgggctaacacagtgaaaccccatctctacttaaaaatacaaaaaaaattagccgggcgtgggtgggcaggtgctgccagccccagctacttcggggaggcttgaggccaagaggatnggcgttgaacccggggaggcnggaagtttgccagttgaagccccagntttgcggccattncatttccagccntg

SEQ ID NO: 711095 - DNA, 405 bp, Homo sapiens
  misc_feature (349)..(349): n is a, c, g, or t
  misc_feature (369)..(369): n is a, c, g, or t
  misc_feature (379)..(379): n is a, c, g, or t
  misc_feature (384)..(384): n is a, c, g, or t
tcggctgcatgcactgagctatggcgttcgtgaccaggcaattcttgcgctccatgtcctcctcttcctctgcgtcggcggccgcaagaagatcctgatcaagcatgtgaccgtcatcggcggcgggctgatgggcgccggcatcgcgcaggtagctgcagcaactggccatacagtagtattggtggaccaaacggaagacatcctggcaaaatccaagaagggaattgaggagagtctaaagaggatggcaaagaagaagttcacagaaaaccctaaggctggagatgagtttgtggagaagaccctgagctgcctttcaaccagcaccgatgcggcatccgtggtncacagcaagacctggtggtngaggccattntgganaacctgaagctgaagaacgag

SEQ ID NO: 711096 - DNA, 174 bp, Homo sapiens
cggcgcaccgacgctgcttctgttacctccacgtggtccccggcctgatgccgcactgtcacgagggtcctttccgtcttcacagtggcgcagctcttggacaccggtttatggggggcggcggcggccacccgctttctggttccggttaacaaccgacgagcacaccctggg

SEQ ID NO: 711097 - DNA, 175 bp, Homo sapiens
aggtgactctagaggagccccttaatagctacccgcaatgtcttattgtgatgagtctcgactgtcaaactcttcttcagaggatcacccgggaaaacgaccgaggaccgaagattggctactgtacaggcagtcgagagaagtttattcatgcaaccaggaaaataagactggt

SEQ ID NO: 711098 - DNA, 336 bp, Homo sapiens
aatgactaaaccaacaattctcaaggactttactaaaaatttttgtagcataaactgtggcctctatcttaaacttctcgtaagacaacgtttctctccactgtgatgaccgtttacatgctcagcactcctgaatgcatgactatgtccaactcccacgaccatttgtaaatgcatcaaaatggcggcaaatgccgttacctggaccaaatagctgcagtttttgtggcaaatggcaaatgtgatatagaatatgactggcaaagagggatttctgagcgctgcccagaattaattcagcaaacgctgaacattactacctgccacatatagcat

SEQ ID NO: 711099 - DNA, 327 bp, Homo sapiens
tggatcccctcctttggccgttaattcgacggacaaatggtccccgtgcactgggccagctctgtgagggctattacccttccagcccgagggacgatcatggggtgccttcagccactcagaaatgctgatgactaaagcaatactgcaaagcacactcggcagcagcatcaggagggagatgaatcacagaaaatgagaggggactatgggaagttgcaaaggctcctccatcaatagatcggaaaagtcaaaacacaggaggacatccagtagccagagtctttgatcactatcttcatggtgggtcttaatgcttcacattga

SEQ ID NO: 711100 - DNA, 107 bp, Homo sapiens
cgtatgtatccgacatggttcacattcatcaagactaaagcatccctcgggagagaccctggctaccgacattcatgtgaagatgtctagtgaattccgtactcccc

SEQ ID NO: 711101 - DNA, 111 bp, Homo sapiens
cacgaggaggaaggccattttgctgcagatgatgtgaaggccatgcttcactagctgaaccaaaagtgggaggtactgaaagccaaagcttctcatcgtcggtaggacctg

SEQ ID NO: 711102 - DNA, 427 bp, Homo sapiens
tcccctctctctgctccatctgacctctcagccgtgttcacttcctgtggtttttcaaacatgatgggtatgcttccatctgagagccgtttgcaaagcctggcctggcgtggttactctctcacgttaagactttgcccaaacgttactttctcagtggggtctaccctaagctctttattgataatcccctctccaccccatgcgtatttaccattctccctttatcttgttccatttttttaacggcatttatcacctaacataccatataatttacttatttattaagttgtttgtctcgtgacactagagtttaaccttcacaaaggcagtgatttgtttgctttgctcgctaatctatcccaaccatcagaatgtgccaggccataggtaagcccttaataagcattgttaaaagaaggga

SEQ ID NO: 711103 - DNA, 242 bp, Homo sapiens
gttctgaatattctttggaaattttgagaatccaagtttttttctcatatgtgtgattattaaagggaaaaatgtggatagtactgggattggaatcacataggttttaattcatattaaggtttaaatgatgagtctaattatttgatcaccttttgggtatcatctagttcttaatatactccttttgtttttgttttgttttgttttgttttgtttttgagatggagtttttcctcgtg

SEQ ID NO: 711104 - DNA, 842 bp, Homo sapiens
ctctgctcctatggttataccagagactggggcagaagctgaccccatattctggaggaagatccgagtttgtgactgtccatccactcccctctataagtcactgtccccagactttgctccagatctgtcacttgcagcctggagctcagcctcaccagtataggtgaggcagagatggctgcagggccaacactggcagaacctggtgagttccttacggaagggtgaccagggacgtctgaagatgctcagtagcaccccacatactctagaggcacgacataccagctactctgaggacctgactcaatctcctcgagctggaagcaggtgttttcccagagacttggcccttgcatgacctcgctcactagggcccaacttacccacacatgctcttggaagagacaccccataccggtagcagcacccaagctgagggggctcccctttatagaccttcactggcccagccacttcactgtacataccagcaggagtacctatggcttggactgccttgctccacagtacggcgggaggcagaccatgacttgtcactgacgatgccctagacaaggccaaatgggtacatcacatgcccacatggctcttctgcccaaagcctccaacgtgtgtcaaggcgagtctcccagccgtgccagggaccgggatcttcggattgcaccccggtcgcatcacttaaaccctggcaatgggccatatgccctccgacactgtggtcactgagattgaggtctgtacactgttgcccaacacggattctgttgccctgtcgcagtctcagcaactctgtcaaggtcccagtgatcagagtc

SEQ ID NO: 711105 - DNA, 171 bp, Homo sapiens
cactgaacatgaccagtccttgaatatcgctagtatggtaaaatgcgagctaccgtttacccttgctaaggctgcctactgcagggtactactaccctttataccttacatacccagtacccccaccaacgatgaatagctgtgctgggtgatgcagggtcttgcctacca

SEQ ID NO: 711106 - DNA, 393 bp, Homo sapiens
cccagacccgcgagcgaggtgagatgccggtggccgtggggtccctacggacagtgctccagcgcaagctgcgttcgaccgtgatcaaaagtgggctatcggtgaatgggttgcgccggtggagtcactggcgggaccggggcgcgtcttcggtcaccttttcctgtctcaggtatcggaatgcggggtcgagagctgatgggcggcgattgggaagaaccagtggatgcagcagtggcaggcaccgtttggcatcattctatggaccattgggcatgggcatccgatgctaaccatggttgccaagtacatctgtcccttcccatcaatcccagcccatgtactaatagaagagcaaagtctttgagtacatagaaacacagagagaataaa

SEQ ID NO: 711107 - DNA, 136 bp, Homo sapiens
tcggggtcttgtctctctctgagctgctggtatcttacacccaccctcttttccagtccctagatacactgagctccggtgttgggacggacgcactcggcctgcgatgctctagcggacgcgtggcagaggcccg

SEQ ID NO: 711108 - DNA, 151 bp, Homo sapiens
ctaccacacccagctaattttttgattctggtggagatgaggtctcagtatgttcccaggctagggtgaactcctgagctcaagaaatcctcctgcctgagtctctgaaagtgctgggattacaggcgtgagccaccacacatggcctatg

SEQ ID NO: 711109 - DNA, 534 bp, Homo sapiens
aggatcccgtagagatcctaaccagacaatgtcattatcatggttaagtctgagtatggcagggcataaaaacatttgagaaaccacttctacatcacataccccctttatcccaccaatacttacatacttccagcgttcttgcagaaactggcagaaccagctcattcctcctggtatgggacacctcagagacttgaagatggggatatgatgaacattctgtttgccagttgtttgtggtgatgaacacaggaatataccggatgcgccaatctcaacacgatttctcctccaccctaaactccctctttcagagcagcccttggagatgctcttcctaagccctcattaagtccatctgtgaatttagctaagcctggcttgaacttgtctactatttcagcttgcataaactctcggggagggagtcccacatggaggctgcctgctgtacaactgcttgctttgatttattctaaacacaaactcctccagacttcgagggggcacctgttttactaggaggtctca

SEQ ID NO: 711110 - DNA, 279 bp, Homo sapiens
catgggagtgagggacctgggtcagccacagtgctgccctggtttgctgtgtggctttgagaccacgtcctgccctctctggtctggggttgcggggacgtggacgggtgggcacggggcgggcttgtgggccacagacaggacgcaggagggtcttcacttgaaaggcctcccgtcctcttctggctttattgatcttcatcccggtagtgggtactgcactggggagacagggcatgagctcaggccttcagtgccttaccgggtaccggagctcga

SEQ ID NO: 711111 - DNA, 498 bp, Homo sapiens
gtcgttcaactgccggccggtgccccacctgctgccggactcctcagagtagctgtccccacactctgacagcacatgctctgaatatgggcttattctgacagtacaccacatacatatgcagcctgagctcgtgtttgatgaatagctgagccagacaatcaggatctttcagacacctgttgtagctcttgcaagaaatagtactcggtgccactcatagataatgctggatattcccaaacacaatcctgtcatgtgactcgaagactctcggggaccccctgaagcagacatgtgtggccatataaccctccacaatcttgccccaagtcgtccacgtacaatattctctgtattctaccagttcactcaggacatacatactcctttccagagccttcttcttctgtacctcctcactctcaggggcttgggacaaagtctcctcttcaggtggctgcgtctaatctccagggccctccaacagtgtgaggt

SEQ ID NO: 711112 - DNA, 337 bp, Homo sapiens
gctgaaaaatgtctcttgttataatgtggtgctgcaatgcatactcacatgtctgtggtgatcctggtgtaaacaaacttactgagctagctgtccgtcgtataaaagtctagcacagccgggcatggtcgtcacgcctgtaatcccaacactttgggaggccgaggaggttggatcacctgaggtcaggagttcgagaccagcctgactaatatggtgaaaccccgtctctactaaaactacaaaaattagccagctttggtggcgggtgcctgtagtcccagctactcaggaggctgagacaggagaattgcttgaacccgggaggcagaagttg

SEQ ID NO: 711113 - DNA, 598 bp, Homo sapiens
  misc_feature (16)..(16): n is a, c, g, or t
  misc_feature (33)..(33): n is a, c, g, or t
  misc_feature (41)..(41): n is a, c, g, or t
  misc_feature (77)..(77): n is a, c, g, or t
  misc_feature (149)..(149): n is a, c, g, or t
  misc_feature (534)..(534): n is a, c, g, or t
  misc_feature (563)..(563): n is a, c, g, or t
tgccaaaattcaaccnaaatttttttcagtagntaaatggntaataaattgtggggcatgtagtcattattcagtgnttaaatcaagttatgacaaattatgagttatcaagctataagaagtcacagaggaacttaaatgaatgttantaaatgaagccagtctgaaaaggcttcatattaaatgatgccaactatatgacactgggatgtattctggaaaaggcaaaactatggagacagtaaaaagcagtgggtgggggaggggagggaggaataattggagcacagaagatttttagggcagcgaaactactctgtatgatactataattataaatacctgtcattgtacatatgtccaaccccctaaaatgtacaacaccaagagtgaaccctaatgtaaactgtggactttgagtgataatgatgtgtcagtgtagttcatcaattactgcaaatgtacttctttggtgggagatgttgaaaatggtggagactatgcatgtgtgggacaacaactatatgggaaatntctgtaccttttcaattttgctgtaaacntaaaattgctctaaaatataaagtctattaaaacc

SEQ ID NO: 711114 - DNA, 300 bp, Homo sapiens
  misc_feature (278)..(278): n is a, c, g, or t
ctctctttttttctaagacagagtctctgtcactcaggctggagtgcagtggtgtgatcttggctcactgtaacctccacctcctgggttcaagcaattcttctgcctcagctactcgggaggctgaggcaggagaatcacttgaacctgggaggcagaggttgcagtaacctgagatcataccactgcactccagcctgagcggcaacagagtgagactccgctcaaaaaaaatttgagggaagagagctaattaagacattcattatgtttagggngaaaaacaaaggccagcattct

SEQ ID NO: 711115 - DNA, 744 bp, Homo sapiens
  misc_feature (10)..(10): n is a, c, g, or t
  misc_feature (52)..(52): n is a, c, g, or t
cgtgaatgtntgtaggagagacccactcgacgacatacattgtctgggcttntagaaatttcatctaaaaacaaattcattgcttcttcaatggaagaacgtgtaggatgaaaccgattggcaatgaccgtctcttttagccatttccataaccgttcaatgggattcaaatccggcgaataaggcggtagataaatcaacaagatccgttcgttcttggaaagaaaatctcggatgagttgagaacgatggattttggcattgtcaacgaccatggcaatgacttggtctttgtaatgattcaccactaactgaagaaacgacaaaaaatcctcctgtttgcaaaaagaggagggcagcttagagatcatctaagctgtttaatatatccgcattttcttttgaagctattggataaatccccatttcgtctaatttctcccataacgaagacatggctttttcaggatctaaatagaattggcttcctcttacccgccagaaagtccagcctacacgttctaatactcgttgacgttcaatatcgtcttcccacttatcgagtccatgccattggtccccatcgcattccactgccaagcggcttctcattccttctacaacgagatcaattctttttccagctgatccgactttcacttgaggtattacacggtaacctcttgcagcaatcatacgatacacatcttcttctaattctgaatcaacagacattcagccgta

SEQ ID NO: 711116 - DNA, 1004 bp, Homo sapiens
gcaaatcccactctgcatcaactgaactgcaaatcagcgcacgttgaattaagctaatggcccattgactagaccagatgggacttaaacccacaaacacttagataaacagctaagcaccctaatcaactggcttcaatctacttctcccgccgccgtgaaaaaaggcgggagaagccccggcaggttagaaagctgcttcttcgatatttgcaattcaatatgaaaatctacctcgggagctggtaaaaagaggcctaaccccattggtctgttagatttacagtccaatgcttcacgtccagtcgcattttacctcacccccatctgatgttcgcctgaccgttgagtatactctagaaaccacaaagacgttggaacactatacggccgtattattcggcgcatgagctggagtcctaggcagcagctctaagcctccttattcgagccgagctgggccagctcaggcaaccttctaggtaacgatccacatcctacaacgttaatcgtcacagtccatgcatttgtaataatctttcttcatagttaatacccatcggataatcggaggtgtttggcaacttgactagttccctaataatcggtgtccccgaaatggcgttccccgcatataggaacatcagcttctgactgttacctccgtctctctactcctgctcgatttggtataagtgaaggccggagcatgaacggtgaccagctagcttccttagggggagctatccagcctggaagctccgtgacttaagcatctctcttacagctagaggtgtgctcacttaggccccaattttccacactttgttaaccctggtacacataaaagcccctttagaggtcataaaagattcctttccacaagggggaaaataaaagcaaccttccgcgggcgcacacacatcgtgggcgggtaatccacgccagctacatcgaaagttgttgttgtgctttctactttctattccaggtcttgttggggg

SEQ ID NO: 711117 - DNA, 110 bp, Homo sapiens
ggaagtatctgtgggcacaacgtccgcaggaagccttcaccttagtggtggcacatggtgcctgacctgccagggccctggtgtttgcctccttcgcttagttctccaga

SEQ ID NO: 711118 - DNA, 814 bp, Homo sapiens
  misc_feature (29)..(30): n is a, c, g, or t
  misc_feature (35)..(35): n is a, c, g, or t
cccggcgcgggaatgtccgggtggagctnnctgantcgcgcgctctgctccacccgacggggcctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccagaaccttaaaggcggtgtttcaaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagt

SEQ ID NO: 711119 - DNA, 763 bp, Homo sapiens
ggcttgggtcctggcctcgtcggtgccgaatccgaggacttgtctacgagcagctcgggatctgaggtccgttgatagtacctatcactcctatcgaagtgagattcacgaatgcactactctgctagcaatgacgcatcctggcttgtattccttggcactcatcaacggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagt

SEQ ID NO: 711120 - DNA, 325 bp, Homo sapiens
  misc_feature (16)..(16): n is a, c, g, or t
  misc_feature (41)..(41): n is a, c, g, or t
  misc_feature (201)..(201): n is a, c, g, or t
  misc_feature (228)..(228): n is a, c, g, or t
  misc_feature (254)..(254): n is a, c, g, or t
  misc_feature (309)..(309): n is a, c, g, or t
caaccctggaagtctngggctaacgccgccaaaagtgaaanacatgcgcttgttcccgtgggggttgaagcttaacagaagatccatcgcggctaaggcgctggtaactttcagggtcagagactctcacccaaccctccgtccggggattgctctgcggctccccccaattggttccagctgagtttggggtctggatgncgcggcagagcagatgagtgtctcgtnccttcctccagctccatctccttggntctattccgctgtctttagctgcgagccttgaccagcagcgtaagtctgggtcgnttgaggccggactgtg

SEQ ID NO: 711121 - DNA, 933 bp, Homo sapiens
  misc_feature (158)..(158): n is a, c, g, or t
gctgaaaagccatctttgcattgttcctcatccgacctccttggctcgctctgtagccgccgtcctgccgctacgcctccgtccgccgtccgctggactccgtgcagctttatcgccagagatccctgatactctcgctattcttattctaatccccntgacactcggagtcaccgtgtgctgccccaccattggtcagacgcatgccggtacacaccagtcatccgaaatcagccatgctaaggactttaaacggatgaacgaatggaaagttgtgtgaatgaaggctagtaacacaatggcaagacgacgtcccgctgcataacggggcaattgtctcatatgcatgcgtaacaatcgggcggcagccaggcatggcttgacaatctgacggtacgatctgagaaagagcgaatggaaggtgggtgatggtagcgagcgatagtatgtgaccgcaagaaagcgtgactaggctcgatgtccatgatgcacctgtcaggatgtacgcagacttccggcatcgccctgaaaatctggtggtactggtgccaaatgctggcaaccgccatgaaggaatgatgtaagcgtatcgacctgtaccgtgcgaacgtaagcgaaggaagacgactcgcatggaacgccggagggtgcgaagtgagctaacaatccggacgagcaaagcatcccttgggacttcccaaagttgccgtacccaagagaattgtgagctttcagccccaagaacgttgtggcttacgcagggagctttgcctaggccccctcctgtggggacgcattgaggtctaaattcccacagaggcaaagatacttgagcgctaccgatctttgcttagcgtttctcgcgaagataggttgattacacgggttcctaatgtcccgaccaagactgggttccgtaccaatgattcccgg

SEQ ID NO: 711122 - DNA, 136 bp, Homo sapiens
aggcgttgaatggccatacggagaaagctcgagtcatcactgaggaagagaagaatttcaaagccttcgctagtctccgtatggccattcaacgcctccgggccattcaacgcctccgggccattcaacgcctccg

SEQ ID NO: 711123 - DNA, 235 bp, Homo sapiens
aaggaggcaggctggacagggcggagcggagaaacggacttaaagtcaaaagctctaacatgagctttaaccgagcagtgtcacgcccagatatcataataaacggccagaaaggtaggcagaaatacaatcaaagcacggatcatcacttttttttttttttttaaagaaaaggggggtcccagcccagcacgggggcttacgcgggatatctcccagcagggggctcgggcgg

SEQ ID NO: 711124 - DNA, 470 bp, Homo sapiens
tacagatatgcagagatgatcaccaaataacatcccagacctcaaatatgagagggagacagtccaggggccacagagaagtgaaaaaaccagaagcagataataagagaattggactttctatttatttattttgagagagaatctcactttctatctgcagtgcccctcccagcaatctgcccaggaccacactttcccaccgacttatggtttctacaacactggaaaaagtaagatcaaggtggacaaccagcttccctaccacctggggttttctggcaggagatctatccctgcctcaactgacaggaagcatcaggaacacccaaagggagaaatatccctgaggacagccagaaacaaaggaagcagagaaggactaccatccccagtcctggaaactctgctccataaattagacaaaggagatgccatatcagagtggcagttcagcagcaccatgctgt

SEQ ID NO: 711125 - DNA, 537 bp, Homo sapiens
  misc_feature (73)..(73): n is a, c, g, or t
caataggatttcatcttgtcactagctggatgcatggcgcgatcttggctctctgcaaactctgcctcccggnatcaagcgattctcctgtctcagcctcctgagtagctgggattacagccaccatacccaactaatttttgtatttctagtagagacggggattcaccatgctggccaggctggtctcaaactccagacctcaggtgatccgcccacctcggcctcccaaagtgctgggattacaggcatgaaccaccgcgcccggcctggaaaaagtgattcttaatgcagaaacagaaaaccaaataccacacgttctcacttataagtgggagctaaacgtcaagtacacgtgggcataaagatgagaacaacagatagtgaatgcaagcggaggaagggctgaaaaactacctattaggtactatgcttactacctgggagacagattcatgtgtactccaaacctcagcattacacaatatgcccatataccaaacctgcacatgtaccccgaacctataataaaagttg

SEQ ID NO: 711126 - DNA, 437 bp, Homo sapiens
ctacaagtgagcgaccgacgagtacataatacatctctgattcttctcttggcaaagtccggctggcagaggttctaccagccaggtgtaccgagagagtgccacgagcatggaaaaactggctgtactcaaagcttgggcagaggtatatgtggtcgctataaatcttcaaaaggaagcagagtcgaaacccaaaagagcaatttaaaatactgcacgcatgatgataacgggtgtagtaccatcgatgaactgccaccagatagtttaataacactggtacaagctgaactaccaacactcagtcgcctgtggttagcaggcattccaaagattatgcactcttgaatttaccagccgaatattctagtacagctacctcccgatggtggagcaatttataaccctgaaactattgatacagatagacttcacta

SEQ ID NO: 711127 - DNA, 172 bp, Homo sapiens
gggcccccacccccccattttttcccccccaccccctccaatgctgttatcccggctgggtcctcacactcccccaacaatcccagggccctttttatccaggaattttcagttctcttcccccagggttttttaaagaaaaataaaagaattgtctttctgtctctctata

SEQ ID NO: 711128 - DNA, 210 bp, Homo sapiens
ggagacatgatagaattcgatcgcggtacccctgcgataagggccaaagtaggaggcgatttgccaagcataggagggtcatggacggggtttcccctacttctcaggctacagccttagcaccaaacctacgccaaaatccatttcattatcatattcatcggcgtaaatctaactttcttcccacaacactttcttggccttatcgag

SEQ ID NO: 711129 - DNA, 163 bp, Homo sapiens
ggaccagttctattcgtcactttctaaaacttatagtaggttactcgccttcttacttctctctgccttcgttctttcacttgcagtcccgtatattacttcttcctttagttcttcaatttgtttctgatctacacattcaaaagatgattcaaactcctca

SEQ ID NO: 711130 - DNA, 174 bp, Homo sapiens
ctgcgtatttcacaggatgtaggttgaaaaataaaacactctctaatcttcccccagacagaatctagtatacctttacaaccatccctgcaaagcttcagttgaaatatgagcaggcgattgtaggcacctttggacaggccagaggagacacctgtctctgtgcaggcagtt

SEQ ID NO: 711131 - DNA, 711 bp, Homo sapiens
  misc_feature (313)..(313): n is a, c, g, or t
  misc_feature (687)..(687): n is a, c, g, or t
cgggctcgcaccgacgaggtgcctgccggaggaagcgcgctccgaggcggaagatgaggacgacgaggactacgtgccctagtgtgcctggtgacggcgacgcgccggcaggctacttgctccagaagctgcgtgctagctgctagacatcaaggggaggctggcggcagtgtaaggagcgagcgagggagcgaggcggtgagtgagaccccggggtaggatgaggacgacattcgccgcgtaggactccttcgaggtgccagcgtcagtccttcctgggatcagctactcagcatccttgaaagaggaaggnctgacagtcgcgtcatatgaagtctgccaaggagaacgcagctcgaacggaaggaacgagaacgatcctgtgacgagtgtttgccgagggccgagtcattgatgtcaggtgaaggagatggctaaggtgcgttacgtagtgagtgagccccatcaaataccgagcgtggactccaccccggttagtgttctgagcatgtctgaagagcgagcatgagcgcgtgcggaagaaataccactatccgtggtggagggagactggtatccgcaccacccagtcaagagcttcaaggaaatgaggtttccgtgcagccatcctgatgaggcctgaagaagaaaggcgattcaccacccatgacccattcatgatcaggncatgcccacattctatctggccgg

SEQ ID NO: 711132 - DNA, 345 bp, Homo sapiens
  misc_feature (16)..(16): n is a, c, g, or t
  misc_feature (60)..(60): n is a, c, g, or t
cgcactctcgacttgnttaacctacaggacaagttctgtctttgccactgattgaactcntggctgtgcctcaaataaattaatcaacaaatatttattaattagtctgtgtaggctaagtacagtgctaagtgctatgacagatgtaaaaagttgtttcttttttttcttttctttttagagacagggtcttgctctgtcacctaggctggattgcagtgatgcaatcatggctcactgcagccttgaactcctgagctcaagtgaacctctcacttcagcctcccgagttgctgggactgcaggcatgcatcaccacacctggccaaccttgtctttttcatt

SEQ ID NO: 711133 - DNA, 486 bp, Homo sapiens
gacacgatgtatggtgatctatgaaacctccagacaccagaacacttctagcaaatcaggcgcagtatgtctacactcaggctgcagtatattcagcaaacttgattggacaaacgggcctgtgccttctctttcggtggagtgaaaaaattagagccagagaagccacatcgtaacttacagcaagcagcatgcagcatacctggctctttgcagattgcaactcggcatttaaaatgtgaatttggccatcagatgtctccattacttccagttaacgtggcatcataggcgtaacctaagtattaagtctaggataaaaactccaccagtgtctaccatctccaccatgaactctgtcaaagaagcttcatatacgtatattcccgctcttttctcttcatttccctgtcttctgcataatcatgccttcttgctaagtaattcaagcataagatcttggaataataaaatcacaatcttagg

SEQ ID NO: 711134 - DNA, 764 bp, Homo sapiens
  misc_feature (10)..(10): n is a, c, g, or t
  misc_feature (119)..(119): n is a, c, g, or t
  misc_feature (149)..(149): n is a, c, g, or t
  misc_feature (163)..(163): n is a, c, g, or t
  misc_feature (170)..(170): n is a, c, g, or t
  misc_feature (172)..(172): n is a, c, g, or t
  misc_feature (174)..(174): n is a, c, g, or t
  misc_feature (196)..(196): n is a, c, g, or t
  misc_feature (210)..(210): n is a, c, g, or t
  misc_feature (226)..(226): n is a, c, g, or t
  misc_feature (258)..(258): n is a, c, g, or t
  misc_feature (288)..(288): n is a, c, g, or t
  misc_feature (293)..(293): n is a, c, g, or t
tccaattaancccccaaaatttggggaaaagggaggtagaaaaaacccaggtaacttgaccaactttgaattaatccccccgagaggattaatatgagaatccagatccttttcaaaanctccatttcctaaggtaccggcattgaganctgcatatgtttcnctgatanangngttttcacatttgcgaatggtnccattctctctccngtactttttccagacnctttttgagggatgatgtttcgtgaagtatcngtatttttacctttttccttccttatcacntgacncaaaaagtagattaagagatgggtttgacaaggttcttcccttttacaaactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaattgctgaggtttagctgtccagttctttttgcccctttgggaattcggcctggtttcattttactgccctagcccagagactttacttttaagaagtattaaaattctaaaattcta

SEQ ID NO: 711135 - DNA, 104 bp, Homo sapiens
gactagaggatccaagagagcactgaagagaaccgctgaagagactcaccgaagagattcattgaagagagcctccgaagagcctccgaagagcctccgaagag

SEQ ID NO: 711136 - DNA, 577 bp, Homo sapiens
  misc_feature (68)..(68): n is a, c, g, or t
  misc_feature (73)..(73): n is a, c, g, or t
  misc_feature (113)..(113): n is a, c, g, or t
  misc_feature (121)..(121): n is a, c, g, or t
  misc_feature (129)..(129): n is a, c, g, or t
  misc_feature (131)..(133): n is a, c, g, or t
  misc_feature (143)..(143): n is a, c, g, or t
  misc_feature (150)..(150): n is a, c, g, or t
  misc_feature (180)..(180): n is a, c, g, or t
  misc_feature (183)..(183): n is a, c, g, or t
  misc_feature (201)..(201): n is a, c, g, or t
  misc_feature (203)..(203): n is a, c, g, or t
  misc_feature (215)..(215): n is a, c, g, or t
  misc_feature (219)..(219): n is a, c, g, or t
  misc_feature (229)..(229): n is a, c, g, or t
  misc_feature (266)..(266): n is a, c, g, or t
  misc_feature (284)..(284): n is a, c, g, or t
  misc_feature (303)..(303): n is a, c, g, or t
  misc_feature (306)..(306): n is a, c, g, or t
  misc_feature (337)..(337): n is a, c, g, or t
  misc_feature (342)..(342): n is a, c, g, or t
  misc_feature (355)..(356): n is a, c, g, or t
  misc_feature (359)..(359): n is a, c, g, or t
  misc_feature (362)..(363): n is a, c, g, or t
  misc_feature (374)..(374): n is a, c, g, or t
  misc_feature (388)..(388): n is a, c, g, or t
  misc_feature (418)..(418): n is a, c, g, or t
  misc_feature (437)..(437): n is a, c, g, or t
  misc_feature (462)..(462): n is a, c, g, or t
  misc_feature (472)..(472): n is a, c, g, or t
  misc_feature (483)..(483): n is a, c, g, or t
  misc_feature (488)..(488): n is a, c, g, or t
  misc_feature (498)..(498): n is a, c, g, or t
  misc_feature (510)..(510): n is a, c, g, or t
  misc_feature (519)..(519): n is a, c, g, or t
  misc_feature (539)..(539): n is a, c, g, or t
  misc_feature (548)..(548): n is a, c, g, or t
cctccggaggggcctcattcccatcaatgtagaactcagctttcttggaaaaaaaaaaaaaggctccnggttnccaatggtggggtacacaaaggaactggctcccgttcggnctatttgnagtcatgncnnnaacatgatcnagggtgntaccctgggcctccgttacaaaattagggntgngtatgctcccttcccccncnacggtgtttccngganaaagggtttnttgttgaaaacccaaattttttgggggaaaaaaacanccccaggggtcggattanacccggggttgcttgttcngtntttccagccccaaaaaatgaatttatccctnaaggnaaagaccttgagnntgnttnnaattcaacggnttttattcagccanccccccccgtttaaaacaaggaaatccggnaatttttgggtgggatttntgttttttaaaaaagaactgttccnccgggtgatnaataaaatttnaaagnttcctgggtncaaaaaaaaaangcccgatgnccctttagacccccttgtgntattttaangatgccataaaaaacccttttttttggga

SEQ ID NO: 711137 - DNA, 734 bp, Homo sapiens
ataattttgtccccgagattctgggtctcgtatgctcgggaccacttcttttccccatcggccctgcgaagcgcccctgggggtttacagggcgtttcctcggaaatctccgcaatccacgcgttgtcggtgcccggcgttcttttcccggacgctgcctagaagccgcccctcgtgtcaaagagatcggggggtaaacccccgcagagctcctcgattagccccccccgcgccctccgcggaggttaaatcgtcgccctcgcgccgccctctgagggtgttccacaggcccctcgcggttgtttgccccccgacggagaagcctccctctctttggagggacctttcctcgggtaagctccacctcttctcaagaatggtggagaccggccaggcccttccaccactacgagaagggggtgggagccacccccggcactcactcgctcgccgcacaccgcgcgggtgggttccccgagaatggaggctgcgtgccgcagaaatatctgtttgctagagcatgtacactcattacgcagggcgatgaagacgagctctgctggtcccacggaagatttgtcgagagggcgccgtgactccaggatgatacgggcgtatgtgctcggaagatgactccctccgcatcctatatccggctgcttttctttagttgatcggctacgacgaccgtgggggccacaatgggaaaaaaacttttcggaaaacatagacag

SEQ ID NO: 711138 - DNA, 680 bp, Homo sapiens
  misc_feature (661)..(661): n is a, c, g, or t
ggcactgcctgcccagctgacacatgttcaacggtccgcagtaccctaaccgtgcacaaggttagcataatcacttgttccttcaatagggacctgtatgaatggctccatcgagggttcagctgctctcagtactgttaagccagtgatatattgacctgacccgtgaagtaggtcgggcatgacacgagcaagacgagaagaccctatggagctttaacttattaagtgcatactagtactctgacgatacccacaggtcctatactaccaaacctgctattaaaaatttcggttggggcgacctcaggagcagaacccaacctccagagcagtacatgctaagacttcaccagtcaaagcgaactactatactcaattgatccaataacttgacgcaacggcacaagttaccctagggataacagcgcaatccgtattctagagtccatatcaacaatagggtttacagacctcgatgttggatcaggacatccctgatcggtgcagccgcctatctattaaggttcgtttgcttacaagcgattaaagtcctacgtgatctgagctcagaccggtagtaatccaggtcggtttcatatctacattcaaattcctgcctgtacgaaaggacaagagtaataaggcctacttgcacaanttgctctcccccgtaaaga

SEQ ID NO: 711139 - DNA, 340 bp, Homo sapiens
acttattcttgggtagagtccattatgtcagtagcatgcaccataatctgactcccatcatgcgactaatcatatttcattgaccttgtctctcctacttcaagataaggacagtacattgctacattaccctagaaagtctgtgtgaggatctgccccttcagtcatgttattgcaaagtaataaaatgtcacctacagggagcctctgagcctactctagttcaaacgacttcctgagagaaaatacataagataaagggtcagcaacaacagagattaagacaattacagaaaataagcaagattcggagaggaagtataatggcacttttttcctc

SEQ ID NO: 711140 - DNA, 237 bp, Homo sapiens
actaagacgatgacggcctcaaatgttggaatcagtctcagtagtctgaagatctcaatctatttagtaaagttatctgtactgttttgtgagtaaggaggttcaatataacagaaaaagactgtgataaaaatacatggcatcatttaataatgaacataagatatctatgaatcaaatcaaatcaagtgttaaaattcctatatatgtatcaatgtataattacttcatcttata

SEQ ID NO: 711141 - DNA, 333 bp, Homo sapiens
cgccatgcacttaacccattgtgaccagcgttcgcgcaagcagatgcgccagttgtgcatacgagttctttccgctaggaccgacttctatgagccctgcttgatgagctggctgcctgagtctgcctttaccatctgatgagcggacacacacacaagcatgaaacagtggctggctaatatctggtttaaacattaaacacacacacacacacacagagagatactgttaaacacacatatgaagatgcagatgttttcctttttttaagtgtgaaaagtcatcatggggaggaccatgagtgcctaggaatgaccttgtgcttaatccat

SEQ ID NO: 711142 - DNA, 884 bp, Homo sapiens
ggcccactgcgcccccgtccccagcgcccccggtgcgacttcttgtttgcactctgccctcgtcgttcctcctccttccatttgacccaagaatcgagcaactgcagtgtgagtgatcagcgtctcggcgtaggcaggaccctagggagacccgtggtgtgcgccgccatgcgcgtcgggagtcttcggttgcgtgggggctggcttgctgtccagcctgtgtgggggccgtcccgtcccacaactccgcctgggcattcttggactcagaggccggggctctgcgtggtttgcttgggaggtggagctgcagcgtcagagcgcctgtgactgcgttccatgcggcctatgttcactactgcagtaatctctgggcgcctgggtaccagccacgtgcctgagctgttcagcgtacgtgaggtgtcccttctcgttgagatatttaaccttatggttctgctctagttctttctctctttgacagagagctgactggagtggtaaacgatggaatatgcagaaaacgctgcagactgtgggcctcgacgcttggcgagtccggaacgaaccctcggtctcccgtacatccacccgttgccctgggcccgtgttgctgtcaaacccccacggtacgagtcggtaaacccttcgtgtgagctccctcatggcagttaagcccacgcgtgcccgagaacaaccagaccgttgccaacccagggtttcaacccaagtaccacgtggccaatccgcagcgaatgaaggcgaacaacgcgagaacccctgaagcctggtcccttcatcctcgctgtggtaagcttagagaccatccctgataaacaccccttgagaacgaagagaaaggacgcccaaaggttggagccctg

SEQ ID NO: 711143 - DNA, 127 bp, Homo sapiens
tgaaactatagtgaagagtatgtaggctctttgactgtagagcgatatcgtcctttcatccatctgtccatcttacagagcactggactgatggtactaaactgccagtgcacacgactaaggtacc

SEQ ID NO: 711144 - DNA, 1168 bp, Homo sapiens
  misc_feature (172)..(172): n is a, c, g, or t
  misc_feature (225)..(225): n is a, c, g, or t
gatgccctcaggtacttggcacggagatccagtgggccaaatgcctatgtatccagacttccacatgccttcttgcgccatctctggtctctcgtggctgtcggctccgagacgacggacatacctgggtcacgtctgggcatctcagagctgcgtggcattgaatggatancagtgcacgtacgtgcgttggacgtgtgctgtgtcccgtgaattcgccgttgnctttcgtctgcaggcgggatccagggagtggagcgagtgcacgatcggtccgtggaggcgcgcggcacggagctactatccgcgcgcgcgctttcgtgcccgcgtccatagcctacgaccatcgcgaggcaacgaagcagggagaagaacggtgcccacagcactgcacacggaaccagccctgcgggctacttttaacgcctggtaacctatgagattgaagcgccatgccggagtagaacccaacgaaataacccgagtacgggtgctgcgtgggcaagccaatgagagctcctgtggagacagcgcaacctctgggcgacaaacatggacacggcgtgaggcaccccacaaagttggatgcccagggacagaacccatcgagggagggcccaagtgtacacgcgattgcaaatcgtgcaattaccaaatcgttaagttgcgcattgccttggacaagcgcggggtgttgccaaggcgcagttggctgtgtcttgccggcgcccacatatatactcacctgtcggattggcgagaagccaataagttgtgccccaccgttggcacgtgttccgtattacacgttggcttcttgcacaagtttgttaataccccaccactgtggggcgcacgcggattctccattgttggatacatcgtaggcgttggcatagttggaagccaattcgacacagttaacgcctttccgccatgggtcatatcggaacggagagctaggaaaaacgttcggtagcgaggctaccaccatttgcgccgcgccccaatgcttccttattggcgtcgcagcaatggaacattcccgtaatcagacttcagcgaattagccgagtagctctcagtacccgggttatacacgtgtggcgtgccaacacgtctttggactccgtaggaatagtccgcaacaaaattgacgtttccaccg

SEQ ID NO: 711145 - DNA, 149 bp, Homo sapiens
ctaattggttcttcgatgacgggtctctaacctgggacgcagagtgagagtcgcaccctttgtctccaacagtgaaggacacatgctcttgggattggtaaggccacgctgaacaccactggccatgtcgtcatcgaagaaccaattag

SEQ ID NO: 711146 - DNA, 128 bp, Homo sapiens
agtatgaagtgtgttgatacaagaagcacggacaatgtgtctatgtcgtaaacttaaaactggcatggtttaccttttgagtcaagagagcttgacagttaaaaaatgaaattagtcttttttctgta

SEQ ID NO: 711147 - DNA, 604 bp, Homo sapiens
aacccccgggctctggcctgggccggcgggggggtacattttcccccggggagcagcttggccccttggggcttttggggggccctatagaccaggtttggcacaaaagccggcgggggccggccggggatttcgggggattggggccccccgcgggccgccgcccttggggcgcttaaaaaaccaattttttttggacccttacaccttttttcttccgggcccggggatttaattttaaggaaaatggtttgccctggggccccctaaattaaaacccttggggggcccctatggggtataacccaacccatttggtttggtggagggaaatttttttttttgggagggggggggaacccctggtccggttttaaggttcgggtttttttaaaaaccgggggccccttaaacttttctttgggccccaggggtatgccaacccttggggccggggctcccccaatgaagggtgggtttttacggggggggggtttccccggggcttttggggggtttttgggaaaggtcccttttggttttttttggggggggtccttttttcccaataaaagggtccggggttcccctggtttttttccca

SEQ ID NO: 711148 - DNA, 367 bp, Homo sapiens
ggcaggcacttttcaaatttataataagggaaccagtgtaagggtagcagtccctccctaaagcatggggaggtaggggaggtatccattcataaaaggagtgtgggtgacgccgccctaaggattttcctttattttctctggagtaatactgtaccataggggtcttggctttaagtaataaaacatcaaagtgggtggggagggaacttggatcttccataagaatagggtggccaaattatgcggagggctctttactctcctttaagtcttggatatatatgagtgtgtataaagggaacgcatgagtggtcggccttttcctttccttcctgtggccccacccccttgaatggagcccagg

SEQ ID NO: 711149 - DNA, 537 bp, Homo sapiens
gtctatatggaggtgctaaggagtagggaaaaccagaatggggtatcacatcttgaactagggtgagaaccccttaatgaggtggccagaggcacttccaggagtctttaagacctgtttctccccacccacctaggggtatggtgggggcctcatgtttctttgccaccatgctgacagcattaacttttctgccttccagccaatcaacaatgctgacttcatagtgcctatagagattgaggggaccactcaccaggtgagctgccagccagaacacacccagcccagagggtggggggtctgccttctgcctcacctgtactggggtcctccacccatctcagggcttgggttctgtcagttgatcccttttctataactccagactcccctttttattggtatctttcactcaaggctttctcaccttaaaaaaagagtttcagccccatataccaaccagctgtctaccttgttttctctttgcaaccaagctgtttaaaagaatagttacattttatttaatactaataa

SEQ ID NO: 711150 - DNA, 125 bp, Homo sapiens
gggccagggcgtctggccttcaatgtcgtctcctccacggatgacccagactgagctgggctgagcccggctgacgaccaacggtcgcagatcacagacctacgaggtctgctatgcgactggtc

SEQ ID NO: 711151 - DNA, 368 bp, Homo sapiens
gtctgggggagatagttgcctccaggcttagacagaagcagtgggtttggatggggtgggaaaggcagtgagatggcactgaccacctccttctcttcctcagtcggatctgctccagtgtctccagtaccagttctaccagagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatagggtggtatagggtggtatggtggtatagggtgtatagcataggatctgtagagtcga

SEQ ID NO: 711152 - DNA, 815 bp, Homo sapiens
gcgctgtctctccccctcggctcgtgagatggcccttcggcctgagggagcctcgcctgccgtccccgggacactgcgcagccccggcctctcggcctctgtcggacgaaacagttgggacccctgattttcgcaggatggcccaatggaatcagctacagcagccttgactacactggtacctggagcagctccatcagctctactagtgacagcttcccaagtggagctgtggcgagtttctggccccttggattgagagtcaagattgggcatatgcgagcaggaaagaatcacatgccacttatggtgtttcataagtctcctgggagcagattgaccatgcagtatagccgcgtacctgcaagagtcgaatgtgctctatcagtcgacaatgctatcgaatgaagtcaagcagtttcttcagagcaaggtatcttgaagacagccaatggatgattgcccggattgtggcccggatgcctgtgggaacgaatcacggcctttctacatgacttgcatgccactgtcggcccagaaaatggcgggccaggccaaacagcccatcagtcagccgtggtgacggagaagcacgcagatgctggagcagcaccttcaggatgtccggaagagagtgcaggatctagaacagaaacatgaaagtggtagagaatctccagggatgactttcgatttcaactatcagaaccctcaagagtcgcggagacattgcaagatctgaattggaaaacaaccacgtcagtgaccaggcagaagatgcgcaagtggaacagatgctccttgcgctggacctg

SEQ ID NO: 711153 - DNA, 3257 bp, Homo sapiens
  misc_feature (477)..(477): n is a, c, g, or t
  misc_feature (545)..(545): n is a, c, g, or t
  misc_feature (2250)..(2250): n is a, c, g, or t
  misc_feature (2575)..(2575): n is a, c, g, or t
  misc_feature (2639)..(2639): n is a, c, g, or t
  misc_feature (2686)..(2686): n is a, c, g, or t
  misc_feature (2698)..(2698): n is a, c, g, or t
  misc_feature (2732)..(2732): n is a, c, g, or t
  misc_feature (2746)..(2747): n is a, c, g, or t
  misc_feature (2767)..(2767): n is a, c, g, or t
  misc_feature (2778)..(2779): n is a, c, g, or t
  misc_feature (2792)..(2792): n is a, c, g, or t
  misc_feature (2798)..(2798): n is a, c, g, or t
  misc_feature (2810)..(2810): n is a, c, g, or t
  misc_feature (2821)..(2821): n is a, c, g, or t
  misc_feature (2837)..(2837): n is a, c, g, or t
  misc_feature (2840)..(2840): n is a, c, g, or t
  misc_feature (2847)..(2848): n is a, c, g, or t
  misc_feature (2871)..(2871): n is a, c, g, or t
  misc_feature (2873)..(2873): n is a, c, g, or t
gtctgggggagatagttgcctccaggcttagacagaagcagtgggtttggatggggtgggaaaggcagtgagatggcactgaccacctccttctcttcctcagtcggatctgctccagtgtctccagtaccagttctaccaggtacgtgactctggcctggtaagtactcagaagccaggatcctgtgatccctgccagctccacgggcagggtgatgtgcatagtccttggtgcctagccagccacctccctgacctgggaagccatttgttccccatacttgttgagggcctgctatgtgcaaggcattagattttaggggacagctggtgctccatgccctcttcccacagctgctgtccatcccacacctgccctggccaccacctccaatgtccagatcacttaatagtcccactgggaggctgaaaccaaggaaacaactccacctcctttcttcctggcctttaagtggngcctatcctgggttggtgattgtgtctccacaaacaacccagctcttcccataattatgccaagggtnacaattgggctttcttggtaggcagatctcagcaacctggcttggttttagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccaggncctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaatgggagcacaaggggcctcccaaaanggagccccacctcagcatcactgccttaatcgtggctccctggggtgggtggggttctctcctncctccctccctcctcctggggtgggagggcgctcctgttcccatctntgtgttccctgnaggcaggtatcacaaagcattgtgaatgctttangtgcagggacaccnnccactcaggactcttccccntcatcccttcnntgccacaccctanatccancctcaggaactnacaagtttganaaaagcaggtggtgancancagcttnntgctctcagcggttggctggctngnattttctctagcgtgtggtgcaccttcccttctgtcccaaggttataaggcttgtctttctctttgaatcctcaagtgaccagagtccccagcaaatcatgtggcatattccggccagcatcaatcccacggtgctatggggttccgggggacctaaaggggcgaggcccagtggcaagcagaatatctgactgaaggaaagagggcaagaactaagacaggggggtagcaccaagcggcaggggtcctatagggagggtcaaaggcccaggggacgagaaattggaagagcacggtggtaaaaaagacagaggaagagagactgaagaacgagagccatcaagcggcaagagggaaaaaggacgcacgacagggcatgagcaa

SEQ ID NO: 711154 - DNA, 1214 bp, Homo sapiens
aaagagaaagaacaattcaagaaggaagaaaaagctaaagatgagaaatttaagaccactgtccccacacgcagactcaaacatccaacgtcaagcacacagggcacacagagcagaaggcagcccatccgagcagcaaagagcatcatagcaacaggaacatgcaaatcaaaggaaaatgttaaaggcaggcagcacaaaaacaccagtttctgggtccttgcaaatcacctgttcccagatcagatattccagagcctgaaagggaacaaaaacgccgcaaaattgatactcacccttctccatcacattcctccacagctaaaggacagtctcatcgaactcaaggaatcttcagcaaagctctacattgaatcatactcctccaccactgtccaagagtaaggagagagcaaatggacaagcacagatttggcacaagtcaagggaacagatccagcaaaacagagagaaaaaagatgcacaaaggacaggaaagagcggaccacagggatcactcaaacaacgaccgtgaagtgccaccggacttaaccaagcagacgtacaagaggcagaatggaccaatgggggtctcacaaccataaacgtgagcagtcctggtgcactctccttatccaaatgagcacacgacacatgtaaaacaatacgtcaaaatcttcaggcaacacaaaagggcagtgattcatttcacctctgagaagactggataaaatctccaccgagtgagccaacacaggagttccaggcaatgaataaagaacacgatggcacaagcacagcgcaaacagggaccgcaaccaagagccaaaggcaccacgcagaaacaccataagcctcggacaagcgcacaataggaaaatatccaacaagtgaactcggccggaacggacgtgacaccgaactgtaatatacgtgccaaatgccgcacctaccaacgcgaagggaccactgaaagatccaaacaagaaacgacaagcaggtacgagcccagacgacaccccacgggcaaccggacacacgacaaacccgccacacacaacgagactaagaccagagaaaaagaagcgaccacacacccgaagaaagaagcaaacaaacacaacacgcagaacacacgcctacagacacaaacgcaccaaaatcaagacacaaggaaatctcacatagcgaccaaacactgccaccacaccagt

SEQ ID NO: 711155 - DNA, 2389 bp, Homo sapiens
  misc_feature (477)..(477): n is a, c, g, or t
  misc_feature (545)..(545): n is a, c, g, or t
gtctgggggagatagttgcctccaggcttagacagaagcagtgggtttggatggggtgggaaaggcagtgagatggcactgaccacctccttctcttcctcagtcggatctgctccagtgtctccagtaccagttctaccaggtacgtgactctggcctggtaagtactcagaagccaggatcctgtgatccctgccagctccacgggcagggtgatgtgcatagtccttggtgcctagccagccacctccctgacctgggaagccatttgttccccatacttgttgagggcctgctatgtgcaaggcattagattttaggggacagctggtgctccatgccctcttcccacagctgctgtccatcccacacctgccctggccaccacctccaatgtccagatcacttaatagtcccactgggaggctgaaaccaaggaaacaactccacctcctttcttcctggcctttaagtggngcctatcctgggttggtgattgtgtctccacaaacaacccagctcttcccataattatgccaagggtnacaattgggctttcttggtaggcagatctcagcaacctggcttggttttagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcaggatgggtatttattctatttggtgttgagcttccaggtctgttgcttagtgttaccagtttttgtaaataaagatttatcagaacacattcactctggttgtttacatattatgtatgtctggttttgtactataatgacagagttgagtagttgcgacagaaaccgtat

SEQ ID NO: 711156 - DNA, 2725 bp, Homo sapiens
  misc_feature (1718)..(1718): n is a, c, g, or t
  misc_feature (2043)..(2043): n is a, c, g, or t
  misc_feature (2107)..(2107): n is a, c, g, or t
  misc_feature (2154)..(2154): n is a, c, g, or t
  misc_feature (2166)..(2166): n is a, c, g, or t
  misc_feature (2200)..(2200): n is a, c, g, or t
  misc_feature (2214)..(2215): n is a, c, g, or t
  misc_feature (2235)..(2235): n is a, c, g, or t
  misc_feature (2246)..(2247): n is a, c, g, or t
  misc_feature (2260)..(2260): n is a, c, g, or t
  misc_feature (2266)..(2266): n is a, c, g, or t
  misc_feature (2278)..(2278): n is a, c, g, or t
  misc_feature (2289)..(2289): n is a, c, g, or t
  misc_feature (2305)..(2305): n is a, c, g, or t
  misc_feature (2308)..(2308): n is a, c, g, or t
  misc_feature (2315)..(2316): n is a, c, g, or t
  misc_feature (2339)..(2339): n is a, c, g, or t
  misc_feature (2341)..(2341): n is a, c, g, or t
ggttgaggttgggaccactgatccattggaagcctggtgaggggtacagccagttctccgggtctgtggggtctcaggggccgcaggcttccagccaggtagcccaggaggctgggctgcaggggttgagagctccttgctgctgtgtaactggtgaaggtacccagtactgcaaaccttcatcacagggatgcctccaacaggctgctctgctcttcctcaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccaggncctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaatgggagcacaaggggcctcccaaaanggagccccacctcagcatcactgccttaatcgtggctccctggggtgggtggggttctctcctncctccctccctcctcctggggtgggagggcgctcctgttcccatctntgtgttccctgnaggcaggtatcacaaagcattgtgaatgctttangtgcagggacaccnnccactcaggactcttccccntcatcccttcnntgccacaccctanatccancctcaggaactnacaagtttganaaaagcaggtggtgancancagcttnntgctctcagcggttggctggctngnattttctctagcgtgtggtgcaccttcccttctgtcccaaggttataaggcttgtctttctctttgaatcctcaagtgaccagagtccccagcaaatcatgtggcatattccggccagcatcaatcccacggtgctatggggttccgggggacctaaaggggcgaggcccagtggcaagcagaatatctgactgaaggaaagagggcaagaactaagacaggggggtagcaccaagcggcaggggtcctatagggagggtcaaaggcccaggggacgagaaattggaagagcacggtggtaaaaaagacagaggaagagagactgaagaacgagagccatcaagcggcaagagggaaaaaggacgcacgacagggcatgagcaa

SEQ ID NO: 711157 - DNA, 1123 bp, Homo sapiens
agcggtctctgcggcgcggtcatcggacacacgcggaggtgtcctctgttggccatggccgagtacctgattagtgggggcacgctcctacggtgccagacggaacggacatcagctagccaatcagcctagtcgtccttcgaacctggcggcagacgggccttcgagccgtacaactggacttatcgtcagttctcccatgggtacactcagactttcagcgtgcaggaccacggctggatcctgaacattctgcatctgacctagagaaaacatcgacctcttgtaagaccccgcatctgggctttatacctcgtaccgcattgggaaacaacgaagtgcaacctgtaagggcattggccgaatgggactcccattagcctacaactagggcctttcgtattatcacgtggcagggatcatttagagccctttccaattccacgagcctagcaagacatgtttaccaccacatgggaaactatgcgcaaaggggctcatactgcatagagtttccgaagaacacagggcttgtaataggaaaagagttacgttttagaaccaaaggaggggaattttcgatattctagccgatgtaaacccgcattggtttggagggtccccattaccatatcgaacgccaccaacgacgttggaagtacctagcaggattagacccggcgcagaacctggttgaatatccaagaaagtggcccctacaagtggactcctggcgacagaattagaggttatcaataccattggtcccgacggataagtacaccgcaacaattccgatccacggaaacctagccaacgcggccgctgggaattgccgctcggaatgcccccaggcttttcggtcgcatgggagtcagaaattccaggatactaaccctttgccccaggagggcagttcgaaacttttcggtaatcttttatacccgtttccgggacatatggcagaacgcggcaagcgggtacagccgagattggaatctctaagggttaaatccctattggtagacacacggtaaggaacattaagacttgggaacctcaacgaagaagcgaggcgacaaattggagacactattggtggaacaggcgtttgaagtccccc

SEQ ID NO: 711158 - DNA, 117 bp, Homo sapiens
gttctcctatctctccagtcctagctgctgggcatcactatactactaacagaacgcgaacctcaacaacaccttcttcgacccgcccgagaggaggaccccattctataccacaac

SEQ ID NO: 711159 - DNA, 156 bp, Homo sapiens
agaataagaattggggtgccctgcctgccattaggagtgccttcattggatttacgcctggtttctgaaacaacagtgtcattattttaacctagaaaacatttcttcaccttaaactgcaggtttaattctaccacagcccaggaaaaataggga

SEQ ID NO: 711160 - DNA, 3173 bp, Homo sapiens
  misc_feature (477)..(477): n is a, c, g, or t
  misc_feature (545)..(545): n is a, c, g, or t
  misc_feature (2166)..(2166): n is a, c, g, or t
  misc_feature (2491)..(2491): n is a, c, g, or t
  misc_feature (2555)..(2555): n is a, c, g, or t
  misc_feature (2602)..(2602): n is a, c, g, or t
  misc_feature (2614)..(2614): n is a, c, g, or t
  misc_feature (2648)..(2648): n is a, c, g, or t
  misc_feature (2662)..(2663): n is a, c, g, or t
  misc_feature (2683)..(2683): n is a, c, g, or t
  misc_feature (2694)..(2695): n is a, c, g, or t
  misc_feature (2708)..(2708): n is a, c, g, or t
  misc_feature (2714)..(2714): n is a, c, g, or t
  misc_feature (2726)..(2726): n is a, c, g, or t
  misc_feature (2737)..(2737): n is a, c, g, or t
  misc_feature (2753)..(2753): n is a, c, g, or t
  misc_feature (2756)..(2756): n is a, c, g, or t
  misc_feature (2763)..(2764): n is a, c, g, or t
  misc_feature (2787)..(2787): n is a, c, g, or t
  misc_feature (2789)..(2789): n is a, c, g, or t
gtctgggggagatagttgcctccaggcttagacagaagcagtgggtttggatggggtgggaaaggcagtgagatggcactgaccacctccttctcttcctcagtcggatctgctccagtgtctccagtaccagttctaccaggtacgtgactctggcctggtaagtactcagaagccaggatcctgtgatccctgccagctccacgggcagggtgatgtgcatagtccttggtgcctagccagccacctccctgacctgggaagccatttgttccccatacttgttgagggcctgctatgtgcaaggcattagattttaggggacagctggtgctccatgccctcttcccacagctgctgtccatcccacacctgccctggccaccacctccaatgtccagatcacttaatagtcccactgggaggctgaaaccaaggaaacaactccacctcctttcttcctggcctttaagtggngcctatcctgggttggtgattgtgtctccacaaacaacccagctcttcccataattatgccaagggtnacaattgggctttcttggtaggcagatctcagcaacctggcttggttttagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccaggncctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaatgggagcacaaggggcctcccaaaanggagccccacctcagcatcactgccttaatcgtggctccctggggtgggtggggttctctcctncctccctccctcctcctggggtgggagggcgctcctgttcccatctntgtgttccctgnaggcaggtatcacaaagcattgtgaatgctttangtgcagggacaccnnccactcaggactcttccccntcatcccttcnntgccacaccctanatccancctcaggaactnacaagtttganaaaagcaggtggtgancancagcttnntgctctcagcggttggctggctngnattttctctagcgtgtggtgcaccttcccttctgtcccaaggttataaggcttgtctttctctttgaatcctcaagtgaccagagtccccagcaaatcatgtggcatattccggccagcatcaatcccacggtgctatggggttccgggggacctaaaggggcgaggcccagtggcaagcagaatatctgactgaaggaaagagggcaagaactaagacaggggggtagcaccaagcggcaggggtcctatagggagggtcaaaggcccaggggacgagaaattggaagagcacggtggtaaaaaagacagaggaagagagactgaagaacgagagccatcaagcggcaagagggaaaaaggacgcacgacagggcatgagcaa

SEQ ID NO: 711161 - DNA, 2428 bp, Homo sapiens
  misc_feature (1421)..(1421): n is a, c, g, or t
  misc_feature (1746)..(1746): n is a, c, g, or t
  misc_feature (1810)..(1810): n is a, c, g, or t
  misc_feature (1857)..(1857): n is a, c, g, or t
  misc_feature (1869)..(1869): n is a, c, g, or t
  misc_feature (1903)..(1903): n is a, c, g, or t
  misc_feature (1917)..(1918): n is a, c, g, or t
  misc_feature (1938)..(1938): n is a, c, g, or t
  misc_feature (1949)..(1950): n is a, c, g, or t
  misc_feature (1963)..(1963): n is a, c, g, or t
  misc_feature (1969)..(1969): n is a, c, g, or t
  misc_feature (1981)..(1981): n is a, c, g, or t
  misc_feature (1992)..(1992): n is a, c, g, or t
  misc_feature (2008)..(2008): n is a, c, g, or t
  misc_feature (2011)..(2011): n is a, c, g, or t
  misc_feature (2018)..(2019): n is a, c, g, or t
  misc_feature (2042)..(2042): n is a, c, g, or t
  misc_feature (2044)..(2044): n is a, c, g, or t
agcatctttacatatcacccgagaatgcagtgagtgctcctgatgcgtctccacggtagggattgggagaggaagcagactggaactgtgggctccaccagagaagtacacccctccaggaagacccagccaccctctagggctctggggcgagggagggggaagcagcagtcgggagattgacaccacatcttccccccaccaggtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccaggncctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaatgggagcacaaggggcctcccaaaanggagccccacctcagcatcactgccttaatcgtggctccctggggtgggtggggttctctcctncctccctccctcctcctggggtgggagggcgctcctgttcccatctntgtgttccctgnaggcaggtatcacaaagcattgtgaatgctttangtgcagggacaccnnccactcaggactcttccccntcatcccttcnntgccacaccctanatccancctcaggaactnacaagtttganaaaagcaggtggtgancancagcttnntgctctcagcggttggctggctngnattttctctagcgtgtggtgcaccttcccttctgtcccaaggttataaggcttgtctttctctttgaatcctcaagtgaccagagtccccagcaaatcatgtggcatattccggccagcatcaatcccacggtgctatggggttccgggggacctaaaggggcgaggcccagtggcaagcagaatatctgactgaaggaaagagggcaagaactaagacaggggggtagcaccaagcggcaggggtcctatagggagggtcaaaggcccaggggacgagaaattggaagagcacggtggtaaaaaagacagaggaagagagactgaagaacgagagccatcaagcggcaagagggaaaaaggacgcacgacagggcatgagcaa

SEQ ID NO: 711162 - DNA, 2075 bp, Homo sapiens
  misc_feature (477)..(477): n is a, c, g, or t
  misc_feature (545)..(545): n is a, c, g, or t
gtctgggggagatagttgcctccaggcttagacagaagcagtgggtttggatggggtgggaaaggcagtgagatggcactgaccacctccttctcttcctcagtcggatctgctccagtgtctccagtaccagttctaccaggtacgtgactctggcctggtaagtactcagaagccaggatcctgtgatccctgccagctccacgggcagggtgatgtgcatagtccttggtgcctagccagccacctccctgacctgggaagccatttgttccccatacttgttgagggcctgctatgtgcaaggcattagattttaggggacagctggtgctccatgccctcttcccacagctgctgtccatcccacacctgccctggccaccacctccaatgtccagatcacttaatagtcccactgggaggctgaaaccaaggaaacaactccacctcctttcttcctggcctttaagtggngcctatcctgggttggtgattgtgtctccacaaacaacccagctcttcccataattatgccaagggtnacaattgggctttcttggtaggcagatctcagcaacctggcttggttttagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctgggtgctgagctgctttctacactgtagcatagttctcaaactgtggggaaagaggtttctcccgtccgggaagaggcacgattacgtaattccggcctggcagggttttaagactcctcttctaacacaaccgacaacgacgcacaacacgatagacaacaaaaaaaggggggcgctaaaatcccagggcacacattgaacacacttttataaaggcccaagaggataaacggacgggaaaaagtccagaaca

SEQ ID NO: 711163 - DNA, 1133 bp, Homo sapiens
ggctgggctcggtggctcacgcttgtaaatcctcagcctcccaaaagtactgggattcatcaggcatgaggcacaggccaagcctggtcatttataacattatatcatcggtcacagaccccagtgacaagagtcttcattctgtttgcccatgcttggaagtgcagatggcgtgaatcatagctcactgacagccttgacattcctaggctccagtgatcctctcacctcagagttccctaatagctaggattaccaggtgtgtggcctccaacaccaaaccaacccttcacacctggctcgcattcgcaacacacgtcccaccgggagaaaacagggactcaccatgtagtccagccgggcctcaacatccctggtcctcaagtgatcctccccgactcagcctatcaagtgcgggaattacgaggtgtgagacattttgcctggcgtaccacataacttggcatacattcagaaatcaccatcctatgcacaaaaattggtcagaacatagttcatgagagacgcaaaagagacaagaagaagacctttaaacggaatgggtacattacatgctaaggattacagtggtggtaatttacaaggaaagaatacgtagcaagtatgggctaaaaagattgttcactggtcaattaggtcagggcaaatcgaagaactgacgggtatatgaaacagttgaatatttgtatgacatatagtgttccagcgcgttccacgaaaacagctgatgagtgtaaaaactgtcatggcatacgctggcgactattagtgggcagcatagagtgagactacatgtatagccgtggttacacatgtggcccagatcttctgtgaaaggaaaaggatgcaacaacacacgttccggtgttacagtattggtgagcatatcgaccaaacctgatgaacaacgggagaaatcagcagcggcagacaggaacaaaaaggggtacacaagagcgtggcgagacaaactcagggggaaaacgctaggcaacggactctgtgaggagcgtacagaaaaaaaaaaaacagggaagcaaacaccaggagaaattatgattaacacccactcccggccgtcgtagcagcagacacgagagcaacaggacgga

SEQ ID NO: 711164 - DNA, 2544 bp, Homo sapiens
  misc_feature (477)..(477): n is a, c, g, or t
  misc_feature (545)..(545): n is a, c, g, or t
  misc_feature (1537)..(1537): n is a, c, g, or t
  misc_feature (1862)..(1862): n is a, c, g, or t
  misc_feature (1926)..(1926): n is a, c, g, or t
  misc_feature (1973)..(1973): n is a, c, g, or t
  misc_feature (1985)..(1985): n is a, c, g, or t
  misc_feature (2019)..(2019): n is a, c, g, or t
  misc_feature (2033)..(2034): n is a, c, g, or t
  misc_feature (2054)..(2054): n is a, c, g, or t
  misc_feature (2065)..(2066): n is a, c, g, or t
  misc_feature (2079)..(2079): n is a, c, g, or t
  misc_feature (2085)..(2085): n is a, c, g, or t
  misc_feature (2097)..(2097): n is a, c, g, or t
  misc_feature (2108)..(2108): n is a, c, g, or t
  misc_feature (2124)..(2124): n is a, c, g, or t
  misc_feature (2127)..(2127): n is a, c, g, or t
  misc_feature (2134)..(2135): n is a, c, g, or t
  misc_feature (2158)..(2158): n is a, c, g, or t
  misc_feature (2160)..(2160): n is a, c, g, or t
gtctgggggagatagttgcctccaggcttagacagaagcagtgggtttggatggggtgggaaaggcagtgagatggcactgaccacctccttctcttcctcagtcggatctgctccagtgtctccagtaccagttctaccaggtacgtgactctggcctggtaagtactcagaagccaggatcctgtgatccctgccagctccacgggcagggtgatgtgcatagtccttggtgcctagccagccacctccctgacctgggaagccatttgttccccatacttgttgagggcctgctatgtgcaaggcattagattttaggggacagctggtgctccatgccctcttcccacagctgctgtccatcccacacctgccctggccaccacctccaatgtccagatcacttaatagtcccactgggaggctgaaaccaaggaaacaactccacctcctttcttcctggcctttaagtggngcctatcctgggttggtgattgtgtctccacaaacaacccagctcttcccataattatgccaagggtnacaattgggctttcttggtaggcagatctcagcaacctggcttggttttagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccaggncctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaatgggagcacaaggggcctcccaaaanggagccccacctcagcatcactgccttaatcgtggctccctggggtgggtggggttctctcctncctccctccctcctcctggggtgggagggcgctcctgttcccatctntgtgttccctgnaggcaggtatcacaaagcattgtgaatgctttangtgcagggacaccnnccactcaggactcttccccntcatcccttcnntgccacaccctanatccancctcaggaactnacaagtttganaaaagcaggtggtgancancagcttnntgctctcagcggttggctggctngnattttctctagcgtgtggtgcaccttcccttctgtcccaaggttataaggcttgtctttctctttgaatcctcaagtgaccagagtccccagcaaatcatgtggcatattccggccagcatcaatcccacggtgctatggggttccgggggacctaaaggggcgaggcccagtggcaagcagaatatctgactgaaggaaagagggcaagaactaagacaggggggtagcaccaagcggcaggggtcctatagggagggtcaaaggcccaggggacgagaaattggaagagcacggtggtaaaaaagacagaggaagagagactgaagaacgagagccatcaagcggcaagagggaaaaaggacgcacgacagggcatgagcaa

SEQ ID NO: 711165 - DNA, 297 bp, Homo sapiens
cctgctgtcttcgcgctaggggtcgccagctgctgaagcagaggcggccgattggcttccacctgaggtcgccggggctgccatttatcggcaacatctattccctggcagcctcatctgagcttccccatgtctacatgagaaagcagagccaggtgtacggagaggtaccagccgacgggcccgggcagggacggcgccaggctgaccgggaagccagggacttcctggttggaattatggacgccctgggcgaatagtcgggacctctaagtgtgacggctgcactttgagggc

SEQ ID NO: 711166 - DNA, 842 bp, Homo sapiens
  misc_feature (477)..(477): n is a, c, g, or t
  misc_feature (545)..(545): n is a, c, g, or t
gtctgggggagatagttgcctccaggcttagacagaagcagtgggtttggatggggtgggaaaggcagtgagatggcactgaccacctccttctcttcctcagtcggatctgctccagtgtctccagtaccagttctaccaggtacgtgactctggcctggtaagtactcagaagccaggatcctgtgatccctgccagctccacgggcagggtgatgtgcatagtccttggtgcctagccagccacctccctgacctgggaagccatttgttccccatacttgttgagggcctgctatgtgcaaggcattagattttaggggacagctggtgctccatgccctcttcccacagctgctgtccatcccacacctgccctggccaccacctccaatgtccagatcacttaatagtcccactgggaggctgaaaccaaggaaacaactccacctcctttcttcctggcctttaagtggngcctatcctgggttggtgattgtgtctccacaaacaacccagctcttcccataattatgccaagggtnacaattgggctttcttggtaggcagatctcagcaacctggcttggttttagatcccagggacctgcctgctcccagaggtgacagaggaagatcaaggaaggatctgtgtggtcattgacctcgatgaaacccttgtgcatagctcctttaaggtaactcaatgtctggaacccttcctacctttatcttgggccttcttgtgaattggcaacagatgtgtaaggcagcctaaaggtgaggaaagaagagtgattagaagggaaaaggccaggcctctggcattctggccaccctgt

SEQ ID NO: 711167 - DNA, 361 bp, Homo sapiens
  misc_feature (19)..(19): n is a, c, g, or t
cagctggatcaccctgttncccctggttttattaccacaattcagaaggctagaagaggagtttgggggcttggcaccctgaaaatttagaccgcattccttattaagtaaaggaagaggtagggaggccgaggcgggcggatcatgaaatcaggagatccagaccgtcctggctaacacagaaaccccgtctctactaaaaatacaaaaaattagctgggcatggtgacatgtgcctgtagtccatcccagctactcgggaggccgaggcaagagaatcacctaaacctggaaggcggaggttgcagtgagccgagatcacaccactgcacttcaggctgggcagcagagcgagactcca

SEQ ID NO: 711168 - DNA, 374 bp, Homo sapiens
  misc_feature (16)..(16): n is a, c, g, or t
  misc_feature (248)..(248): n is a, c, g, or t
  misc_feature (251)..(251): n is a, c, g, or t
  misc_feature (309)..(309): n is a, c, g, or t
  misc_feature (354)..(354): n is a, c, g, or t
  misc_feature (374)..(374): n is a, c, g, or t
actgtgttcccaagcnggtttccataaagaaaattccttaacccttagaaccctcggatatccctcctatgttttagttttcatttttttaaaatgccttccttaaaattcactaaattgggcctaggtgtggctcatgcctgtaatcccagcactatgggaggctgaggtgagaggatcacttgagcccagaaggttgaaaccagcctgggcaacatagtgagaccccatctctacaaaaagttttnaanccaggtatggtggtgccctcctgtggtcccagctactcgggagtctgaggtgggaggntcacctgagcccaggagactgaggctgcagtaaggtgtgattgcnctattgctctctagcctggn

SEQ ID NO: 711169 - DNA, 1069 bp, Homo sapiens
gaaccatcccagtaaccctgaccgcctgctggtcttctgctggacaccatgaatcaaactgtccaaaccttcttctctcctgtcaacagctggcagccccccaactatgagatgctcaatggaggcagcactgagtgtgcgctgtcgctgggtggctgccccaacaaccctgctcccccgatgtccaccgtgatccacatccgcagctgagaccttcctgtgccctgaccatgtcgtactgggtccctgttcaacagcctcttcatgaacccctgctgcctgggcttcatagcattcgcctactccgttgcagtctagggaccaggaacgatggtctggcgactgttgaccggggcccagggcatatgcctccaccgccaaagttgcctgaacatctgtggcccttgattcctgggcaatcctcattgaccattcttgctacatcgtcatcccaagtgctgatcttcccagtgcctattggatacgatcaaggagggcatccacttgaggacccaaggagctcttggcccatgaccgtgtatcccaagtactccaacgttccattccttcggcccttgccccggagccgagagtcttgtatcaagcccttaatcctcaacaccgccttttcctaccaattgtgcattccaataaaaggtgccacggttgttcttgaaaaacccacaacacacaccaccaataacacaaaaccgaaacaccacacaacacacaacaaacacaacaccaaagaaacactacacacatccacaacaacaccacacccgcacaacctacgtgcacattattcctctcatatctacataccgacaagaaaacaacacgaagacaatgagtgtgacaaccgacaagaaaggtggccatgtccctccacggagtcacacacacaaaacagcacgtacccacgcaccacactcaggtgtggatgtgcacacacccagcgggcaagcgaaacgaactggagaaatgcccggaagcgacccacgcggccagcgacaaacggaggtcgcggaagtcggtcgacgggcgacagagagaggacggaaccggc

SEQ ID NO: 711170 - DNA, 848 bp, Homo sapiens
ctttacttattgctcacaggctgaggacggcagaatgactctgtctccactaggagccattagggcttcttccctggaggactgcctgcttgctttctggggacaactagccctcatttcccttctgtggtacagtggtccaagattatttgtattaagcaagcatttatgggaggacaacccggtcccgaaaacggagcccccaagtatagcacaaccctgagagattatgaaactatgaattgtctctagtagagatatgatttctgcaaacatatctcagtcttccctctgtttctctggtgatgtaatgaagtctcctttctggtaaggaagaaggattctgaaccatagacgttaggcatcatggaaattcaaaccaggatttcttaatacctggtcttcctcaaagagagaataataagcagtaatagtggtgctgggaacacatatggcagattacttgaactgaaaattgaattaagcttgaactaagagtgctgtgaatttttctctaaaaatgaataaccaaaatgatactaatagagggaatatcacgggcagtaaccccgagtgcagaaatctgggcccctgagggagtactaccattcgtactgaactgcgcccacgaataccctcagtagactcgtacgttgttccacacggccctcacgaactaatgtgaacacaatctaggggaccttgatcgttgagcgcctgagcaaaattgtgagaggcccacagagttggatccattggattctcggctgtacatgacatggtgcaaactgacttggactttaaggcctttgatatccgcttgggtccgccacaagcatatgggtgag

SEQ ID NO: 711171 - DNA, 595 bp, Homo sapiens
gccctaaaagccaaaactgggaacacggaaaagactcatatcaacatggtcgctcgttggacacgtagatgcgggcaggtccaccactactggccatctgatctataaactgcggtggcattcgagcaaacatggaaccacttgagagaaatttgaggaagggacgcgcgtgcatgaggactgtggaaagcgggcgtcctgtcaatgtgtatgcctgggatcttgagataatccctgcaaaccatgagcgctggaacggtgggtatcaccgattctggaatactcctcctcttgctggacaagtgatgatgagcccaggcaacgtcactcatgatgacctagtccaatgtgactgccgcccaggcacgacagtagtagctttagtcagaaaacgatgactctacaagggaacaatcctcagcgactgatcctggtgtactgcatccttgaagtgtgttctggctctcgcttgggtagtgcaggtgcgcacattgttgagatgccttggctcatcatctcccaacgacattggggctaaggacccctcgtaggacgccattgcgcccgtatcgtgtggccctttacagcgacgttg

SEQ ID NO: 711172 - DNA, 749 bp, Homo sapiens
  misc_feature (390)..(390): n is a, c, g, or t
  misc_feature (749)..(749): n is a, c, g, or t
tggagatcggatcttttctccaggcaatggggggaaagaagggtttttctctggaattcgcttagtgtaaccagcgggcgtatattttttaaggcgccttttcgaaaacctaagtaggttaatattcatttggtttaaatcttaatttatttttaagctcaaactggcttaagaatacccttaattcccttaaaggtgaaataattttttggcacagggggtttcctcggatttggagactttttttttcttccaccggtcatttcctaactccttcccaactccagattcccatccatgggtgatggttcaagcaagaatctcaaggtcttttggagaggtgggtctttaacggacccctggaaacagggtggtacggggaggtggcgnagaaagggtggcgtgggccgggggtgaataggtggacgggtggtggtgacaggttaactcgctggtctaaaggccggttagagaatctctgggcttggcgggaggtgggctataaggtggctcttggactgtccgggggaatcccaggcaggtggcaaagcagaacttcgcgaggtaacctggcggctatggaagcacacggccttctctctggggaagaccacggcaaccaggtggagaatggagaaggtggatccatgagaactgggaaacaaatatgagtaccagttcatggcaacaacggattataatggagggggtccctggattctcaaccatgtggcgtgagcctgtggcgn

SEQ ID NO: 711173 - DNA, 299 bp, Homo sapiens
ttgggggggttttttttttggggggggccccccaaattgggatttcggggtttcgggggggggcccctttgcccccccccccgttttccttgggctttttttttttaaatttttttgggggggggggcccccgtttgggaaaaaaaaggcccccagggttggggggggggggggtttttgggcgggtttttgtcttccccccctttacccgttttcgggaccttccttttttcccccttaatgtttccctttttggtttttccttttaagggttttttttttttaaaagggaaaaggga

SEQ ID NO: 711174 - DNA, 228 bp, Homo sapiens
atattgctgtgagaaaagctgtggttcagttgagcctgggtgctgtagaaggtggtagatttctcactaagtgctggcactgtgtgtgctggcaggtgaccactgttgacagagctgagcctggttggctatgaggggtggtaaattcttgagcaaaagatgaagtttgtgatagcttgccaggggaccgtgttgtctcagttgacgccttggcttacttgtggcacg

SEQ ID NO: 711175 - DNA, 218 bp, Homo sapiens
gccgctgtcggtccacttgtcgccactttcacagatctcggtcacttcgacttcgtcggcgccgatgtccggcacggcaacgtctttggccgcagcggcggccggggcagctgctgctgctgccggtttttcttccgctttcgccgccggtgcagcttccgctgcgcctgccgcttcgaagatcatgatcagtttgccggtttcggttttatcgccga

SEQ ID NO: 711176 - DNA, 260 bp, Homo sapiens
atttagaggatccctacttccacaggggaggagattgattccaggagacggtgaaatgattcttattactcttccagggtgaggttaggtgatggactctgggctggaacctgtcgtccgatggtcctcatcccgtgatgcacagcagaggtaagaggcactgaaatgtagcaccatggtcttattggtacgggaggcatccaatgtcttgctcgagtgggtaccgtagctcgatcttcgttaatctctggtcagtagct

SEQ ID NO: 711177 - DNA, 364 bp, Homo sapiens
gtgtgtgtgcttctgtgagaacaagcatatgtgggtgcctgtgtgtatggatgcgtaccgaggtgcctgtgccgtgctgtgctgtctgtgctgtctgtgctgtgctgtgctgtgctgtgctgtgctgtgctgtctgtgctgtgctgtgctgtgctgtctgtgctgtactgtgtgtgctgtgcagtctgtgctgtggtgtgctgtctgtgctatgctgtgctgtctgtgttgtgctgtgctgttctgtgctgtgctctgctctgctgtctgtactgtctgtgctgtgctgtgctgtactgtgctgtctgtgcagtgctgtgctgcctgtgctgtctgtgctgtgctgtgctgtgttggtcgacgc

SEQ ID NO: 711178 - DNA, 709 bp, Homo sapiens
cccacaccgcaggattatgataagtggctctaataccatagtcgtacacatgccagtacaggaatatattaacatctgtttatttgccagacgaagagcagtgtccaatataacatttcccccaaaatcattgtaagacctgtgaatttgtgaccagttcacaaaaccaccaactgacactttagcatgaagaaaaaaacaaacctgacagactgtcagctctaaagacattacagagcagaaacttccaaaagcgttatacaagctgtctttctgggcgaatgaaaaatatagcttgtataatacattaacaaaaattcacaagataagattgtgttgacatactttacaagcatgctctatgtgtctccaacaaacaaagctaaggaaataatgtaaccatctttacacagtacattaaggttacaagtcatacacaagaacagaactgcttgcgcgttagaaactgtccagctccatggtcatagggctaaatgttggcacttaaaccattttcggttacatacaagcaaaggttattatatattcagcaattaataaattttcaataatttaagatacggtagcttaaaaaagtagactgagaatggtcttgataaggcaggtgaaacatcttagtggaactaaactcacagaagctccgcaaatgtgggggacctctaagtcacctgcgcttgcacttggactg

SEQ ID NO: 711179 - DNA, 321 bp, Homo sapiens
ttagttagtcgggacggttgttgttaaattgtggtaccatatacttaacacaaaaattaccattttaaccttttttttgtggggggagggacgggatctcactatgttgcccaggctgttctccaactcctgagctcaaacaatctgcctgcatctgcctcccaaagtgctgggattagagacatgagctaccacacccagcctgattttaccaaaagaaactttttttctttttggagacagagtctggcttggtggtcaggctggagttcaggggcatgatctcggtcccggcttaactggcggccccgatttaacttg

SEQ ID NO: 711180 - DNA, 269 bp, Homo sapiens
  misc_feature (36)..(36): n is a, c, g, or t
  misc_feature (72)..(72): n is a, c, g, or t
  misc_feature (83)..(83): n is a, c, g, or t
  misc_feature (137)..(137): n is a, c, g, or t
  misc_feature (171)..(171): n is a, c, g, or t
tgtcggggtagcagtgagctaagatcatgccacagnactctagcttaggggacagaccaagacctttctcanaaaaacaaacnaaaacaaacaaaaaaagacagaagttgtatcctaaggaaaatgagacataccanttaagatgcaggagaattctgctgaaactacttnaaacaagattcagggagatggaggtcaaaatggctgtgtggaaacaccacacggcttagaaccaaacagacttggtttccaagccccgaacacggata

SEQ ID NO: 711181 - DNA, 203 bp, Homo sapiens
tctagaggtcccatcagtttacacaacttaatgagacttaatagaaatgtgaacttacttaacatggtagtcttagtttctcatcatcaggtgccataactcttaggcagattccaaaagaaaatgaagattaataacaaaacaaaacaataaaacaggaggcctaggcacttctttacattcctctcttgtgtaaactgata

SEQ ID NO: 711182 - DNA, 1292 bp, Homo sapiens
gtctagcgcgccgcacgacttagtgcgcccggccgtatcagtcagcgcgaggccgtggatatatgtatcgtggaacatagtccgtatcatgtgatactgcggaatctctccgaataccagtgctaccatccattgagagtgacgagccagtgttggcgttacctgcgtgtgctatgtgccaaccgagattcgactcggcccgagtcgtgggacgagagagatggggaaggtcgatccaaggaattgaacactgtgaaactcgaatgtctaagggctctggatgcagtactctgccatgtgcacctcattaatcgttgaaaccatgagttgcaggaagctcttgcgtagactcgagatgctggcatgcattgacatgtccatataattgagcgcagacactatgagagtacagcaaattggatacctcctaggatccgggacccatgtgagaagcccatttgagcgtgtactgcttcaatacacttcgaaagacaaaacatggctaggctttcggaaaatatccatggagtggtgggctagaccagggggcgatcaaatgacccgcgcatatcgcttcccggatacacctactttggcaaagcaaactaggcaaccgatccaataagcccgtgacttcgtaattagaacctttggttaagctacgcatacgtcggctactgtggggaaacaactatgttgcttggcacccacttgccttgtccacgcagtattatcgtgtgggcatgcaacctggtgacaattcctaggtggcgtacttccacgcagatgggctccatctcgttacatggaccaaccacaaagctaggccgacacagggaagcatgtcctggccctggggatgaacccgtaagaacagcccggagccgtggcgaccctccaggggaggaaaggcgcaagccttggtaagtcagttttccattccatatagaaagggacaccccaagcacaaagagataggcgcaacgcccaccgggacggggctccttgacatacgttctgcccatgcaatttgttcccacagctcactgggcggctaagaactcgcgatgtcctaagcggcataattgcaattgggcccctccgcaaatattccttgccaaaagcagcccttgcgtgcccacagccactcggaatgtgtcagtcaacgcttcgccagggagaccccatgaaaatgcctccgagaaccaatggggcactatccgcgccaattcaaactctcggagcacacgaccctcacttgataccgccacgtctaacgggtggcgttccaa

SEQ ID NO: 711183 - DNA, 134 bp, Homo sapiens
tcgttttacactgaggaacgtgttataccccgggaaccggttttcactgggcaccgtgttacaccggggaaccggctttccccgggagccggaatacactggggaacgggctacacccgcgggaaccggatatc

SEQ ID NO: 711184 - DNA, 146 bp, Homo sapiens
ccccttccctttccttccccctggggcaaccgcctccctttcaaccttgttaattccccctccccaccccgaggggcttgcaggggcaaggcggccgactgcgcttagctgcttttttttttaaaataaaccccgggaaagtttta

SEQ ID NO: 711185 - DNA, 208 bp, Homo sapiens
atggtaatacacacagtggtgttgtgtacttctgaatgttaaaaccgcctggctcctttgaagtaaccacatagtttatctatgggatgtacattatttatttactctattagtgattaagttttatctagatcttatgatactgtaaacagccacagtgatgatcctttctggtgttatgtgagcacatgcacaatttgtcgagatt

SEQ ID NO: 711186 - DNA, 641 bp, Homo sapiens
  misc_feature (44)..(44): n is a, c, g, or t
  misc_feature (411)..(411): n is a, c, g, or t
  misc_feature (441)..(442): n is a, c, g, or t
  misc_feature (487)..(487): n is a, c, g, or t
  misc_feature (524)..(524): n is a, c, g, or t
  misc_feature (548)..(548): n is a, c, g, or t
  misc_feature (551)..(551): n is a, c, g, or t
  misc_feature (553)..(553): n is a, c, g, or t
  misc_feature (559)..(559): n is a, c, g, or t
  misc_feature (573)..(573): n is a, c, g, or t
  misc_feature (587)..(587): n is a, c, g, or t
  misc_feature (602)..(602): n is a, c, g, or t
  misc_feature (604)..(604): n is a, c, g, or t
cacccaagagcgggcagccagaaccgattccagcacccagcaangtgtgtcactttttaaccgccccgcggaaggggaccaaggagaacttctttgaaatctgcgatgagctgggagtgaagcgcccattttctgtgaaagtattctcaggcaaaagtgagcgcagctcctttggactgctggagtgggaatccaaaagcgatgccctggaaactttgggcttcctgaaccattaccaaatgaaaaacccaaagggtccaaacccttacactttgaagttgggtttttccccggctcagcacccctcctaattaggggcctaggaagagtcccatttgagcaggaaaacatttttttttccttaaagccatttttggttttggttatttgcaaaagatccgggaccccccntttttttttttttttttttttttaaaaggnnaggtttgaagaggcttacttacccttaatggaaacgctggaaatntgcagggggagggaaaggggaactgttatctcccaanattacccttcacttttaaaaaatnatngnacatgngatttttttttccngttcaaacatttgngcggcccatgtactntnggcacatttcaataaaattgtttggaaaataacccca

SEQ ID NO: 711187 - DNA, 424 bp, Homo sapiens
  misc_feature (26)..(26): n is a, c, g, or t
  misc_feature (28)..(28): n is a, c, g, or t
  misc_feature (30)..(30): n is a, c, g, or t
  misc_feature (94)..(94): n is a, c, g, or t
  misc_feature (98)..(98): n is a, c, g, or t
  misc_feature (101)..(102): n is a, c, g, or t
  misc_feature (173)..(173): n is a, c, g, or t
  misc_feature (337)..(337): n is a, c, g, or t
ggcggcggcggcaccggcagcggcantncntctcacttgaacgccgcgagcgagcttctcgtctgtgtcctgacctcggagcctacgagcaganggcngcnntgacggaccggtacaccatccacagccagctggagcatctgcagtccaagtacatcggcacgggccacgcngacaccaccaagtgggaatggctggtgaaccagcaccgcgactcctactgctcctacatgggccacttcgacctcctcaactacttcgccattgccgaagaacgagagcaaagcccgcgtgcgttttcaacctgattggagaaaatgctgcagcccagcgggcngcccgcggacaaagcccgaggagaacttgaggtgagcgctgcccagtcttccccgtgtgccggctgcgagccttcctttgctcctgg

SEQ ID NO: 711188 - DNA, 296 bp, Homo sapiens
  misc_feature (147)..(147): n is a, c, g, or t
  misc_feature (150)..(150): n is a, c, g, or t
gctttgggtgcaggcatccagacagatgcacaacagacttcggagatacctgagctatgaagacacgcttcttctggaagaccagccaacaggtgagaatgagatggtgatcatgagacctggaaacaaatatgagtacaagttcgnctntgagcttcctcaggggcctcttggaccatcctcaaaggaaatttgggtgtgtagctacttggtgaaggctttcttgacccccgagccagccaacttaagagacaagaaaactttgagtagtggatctggtggatgtcaatacccct

SEQ ID NO: 711189 - DNA, 272 bp, Homo sapiens
caagtcaatcgtaaactgggtatggattagtccacctcaactgcctgctatgatggataaggttgcgagagtgaggagaaggctacacgtatagtgagggagagatttggtatacgattgactatgtgctgtgtgcacaagccaagtgaatcgtagtggctgtcagtggctagcacggcttgatgtagtcatcgttcattctcacttatgtgatcgttgtacatactgcactttatatgctgcaggacccaaatggaaccaacatgatgggt

SEQ ID NO: 711190 - DNA, 301 bp, Homo sapiens
ttcgcgtatataatcaagaaagataagagtgagtaaaactgacatgcagagattagttattaaggaaatgagtaataaaagagtgaaaaccattgggggtggagtcaaacaagcctagacatttgattgggagagaaaagatccaatatgaagttcacaaaccaaaagtttataaactcaatggcataccaatcctttttattgtacaagctgaggttgaaactaaaagatctataaaaactgttacttttggccttaaacagtacccactcttatggtaccggggagggtaccgcgctcg

SEQ ID NO: 711191 - DNA, 1017 bp, Homo sapiens
gcatttaccatctcacttctaggaatacaagtatatcgctcacacctcatatcctccctactatgcctagaaggaataatagtatcgctgttcattatagctactctcataaccctcaacacccactccctcttagccaatatgtgcctatgccatactagtctttgcccgcctgcgaagcagcggtgggcctagccctactagtctcaatctccaacacatatggcctagacgtacggtacataaccctaagacctacgtccaatgctaaaacgtaaatcggtcccaacagattaatatttactaccactgacatgactttccaaaagaaacgacataatttgaatcgaacgacaaacacccacaggcctaagttattagcatcatcccccgtactattttttaaccaaatcaacgactaacctatttagactggttgcccaaccttgtccctccgaacccctgaaagattcccccttcataatactaactgactcgtgaatcctaaccctacaaaatcatggtaggatgggtaacggcacttgatccagtagaaccaaggtatcacgaaagaaaagtctatcctctactatactaatctccctatcaattctccttagttataacattcacagcgacagaactactcatattgatatcttgttggagacagatttatacccagcttggttatcatcacccgatgtaggcaacagccggaaacggctgaacgcgggacataccttctattctacaccctagtaaggtcccttcccctaatcatcgcactattttacagtcacaacaacctggctcagtaaaattctaatatcactctgctggccagaaatataaatcctgagcaccagttaatgactggtcacaaagcttatacgaagaacccctggtcattgatcacggccgttgaccctcggtaaaattggcggctaaagggggtaagcaacttcccgaaagcgttttgcgggataaccgaaaatttttcacggatacaagcca

SEQ ID NO: 711192 - DNA, 254 bp, Homo sapiens
actctgtagaggttcgactcattgctctttcttacctatcacaggtatgcttgactcagaatacttctattcaatgtcagagtacacagagaagtggcctcccgtgcaggagaagcagcacacaaccaccaagtgtctattcatttcacgttcactgtcggaaaaagaagtgcaataggttagcccaataccatatggagagtccatgtagtacttagatgggtagcggccttccaactccatgagtggcccag

SEQ ID NO: 711193 - DNA, 128 bp, Homo sapiens
acagctaggggtacacttgtctcccacaacaaagctgcacagtcgagatccaatcaaagaacgtcctggtgtgcttctacacctatgccccatttagctaggatttacttgaatgtatcgtatagggt

SEQ ID NO: 711194 - DNA, 404 bp, Homo sapiens
  misc_feature (208)..(208): n is a, c, g, or t
  misc_feature (211)..(211): n is a, c, g, or t
  misc_feature (306)..(306): n is a, c, g, or t
  misc_feature (363)..(363): n is a, c, g, or t
  misc_feature (390)..(390): n is a, c, g, or t
  misc_feature (403)..(403): n is a, c, g, or t
taaaatgccctcgatgagtagcagttggttacacacaagtaccttccatgggagttaaatgactcaaatatagaaatgtgatctctccatgaagtttgttattttacctaaattctttactgcaaatgacccatacaaggatgtatctaagtagactggttctctgttctgtttggaaacatagcagttgtcagccagcgaagcgctnctncacccgccagcagctcctgtggtgtcccagttttagtgcctcttccgtgtatgtctgtaaagcctctttattggattctctgctatatatttttnaaattgcttactttgttctgattatatggctccttaaggaaagtccaaatagtttanatatggctaaactctaaaaatacaatnccctaactgaacnt

SEQ ID NO: 711195 - DNA, 648 bp, Homo sapiens
agtcgagtcgaccggtttcgcatgtttccgcttttctggggaaagggcaagtaccccaaccccttctctccttgtctctatcccttctctgcttttctggggaaagggcaagtaccccaaccccttctctccttgtctctatcccttctctgcttttctgggagaggggcaagtacccctcaaccccttctccttcaccctcagcggcaagtcccgcttttctggggaaagggcaagtaccccaaccccttctctccttgtctctaccccttctctgcttttctggggcaagggcaagtaccccaatcccttctctccttgtctctaccccttctctgcttttctggggaaagggcaagtaccccaaccccttctctccttgtctctatcccttctctgcttttctgggagaggggcaagtacccctcaagcccttctccttcaccctcagcggcaagtcccgcttttctgggggaggggcaagtacccctcaaccccttctccttcacgcttagcggcaagtcccgcttatctagggggcaagcaaccccaatcccttacttccacaccccgacctcttatctctgtgccacaatcccttatttctgtgcccaacccaccttcccaatttctggagggaagaaccca

SEQ ID NO: 711196 - DNA, 930 bp, Homo sapiens
  misc_feature (432)..(432): n is a, c, g, or t
cggccagtcgtgcgggtgaactagctctcaagtggatacaggtacgactgcgtcagcgaaaggacacggccctcactgtatggcaactagccattgggcgacaggagcgttcctgacgtctacagatgtgtgccaatcctctctcgcggccctcgcggcaccagaggtcctttgttgactcgttccctacagaggcgaaggggcgtgtgatggcaagcttcgtctagacgtctatcatgggtcatacccatagttcccttaataggtagagccacataggaaaggattgacagagacgatcgtaacatgcaccgaacatagctgatggtacgatacgtaagccttggcttcctcaagacgagacgtagtactggtctcgtgacatggcgctatgcctcctattgcacgtccatggtctggcggagagatggngcaaggagatagccgctacctttcgcaatcattgctctgctctccagaacacaataacgatcacctatatttgatacgtagccatatccctgtggtgcggcagcctagcgccgatcctgaggggactgtgcgccagacagtggcaccccttttgcaagatgcacaaatagttgtgtcgcgtggggcctcaaggttgtgttcactgaccatagtaactcaccccaaggccacttttgtgtgcgcatggcaccagggggccacggccaagaatctagcgtggagagtctcggagatgttcagaggaagcaatagccatgtgtctaaaccgttggttgataaacagccatctcgcactgaaggactcacaaaaatattggctgcgattgccctggtaaatcccacgctacctttggggagggcctcgaagggtgggccggattccattttgaaggctcaccgaacgctctgaagacccaagctggacccattattggggaa

SEQ ID NO: 711197 - DNA, 123 bp, Homo sapiens
cagcgtaaaacatgcaggtggaaagcaaaagggtaagtgcacagcctggcactatccatagtctctgttcttaagatttaatactgtctccaaaaccctggccggtcaaaactggaatttcac

SEQ ID NO: 711198 - DNA, 518 bp, Homo sapiens
tggttcctaggaatgcgtgtagaccaatccaagcatatcgacatggttgctaaatactgagcctcgcaactgctcacatgatcttccaggagtatagctgacccctctgattgttcgagagtaatgttccctctctgacttactgattgctactgtcttgccgtctgcacccatactgctgggatatgcctgcactctgcagtttgttgactcctctgcaaccttggctttggtttctccccaggtcctgaccacctggccgtgggcccctccctgtagagccacactgcaggaaaacaaggctgcttcagcccagcgagacccatcttgcctgggtgccacctcccagcctggatcagcactcggagctcccacctgcctcccaggggagtgggcatccaccctgagcacctggttctaggaatttcccttcctttcatttctgaggcagtgccggacggcttgagcatctcatgctgtctcacgttccgcagctggtctggggccaagtgctgaag

SEQ ID NO: 711199 - DNA, 391 bp, Homo sapiens
tggagaacgaccggtagctgaccctcatgctggatggcaggcaggaccacttcatccgtgcctacagcctcatagaccagctctttcaggacaggttttttaaccaggagccccacgatacctaccagtacctgcccttcattctgacgaaacagaaggctcactacttcttttccaaataccgcattatccgcagcttgatgcccttctctccatacgagcccctgaactgccacgccatagttgcatgccttccttgagatgatacacgaggctcaccagggcctggacatgcactaccatagtgcggacttccagcagacgccaacagaattcatgcgagaaggcgaccattaccggactgtgttgcgggagatgcgccacaaatcca

SEQ ID NO: 711200 - DNA, 1140 bp, Homo sapiens
gtctggatataacgtactccttgcgctacacggggccaactcaattctaaactgcgtccaacttggtagtcattatatggtagccgttcccgcgcgcatggtgtatcttacagtgcgccggtttcttcccgacctcgaaggcacggggtgatccagatcgagtatcggggtcccgtaaacacggtgcaccacatgctcagcgcatgcatgattgttacgatgcacggatgaatcattgtatgtgcctgtgcatgtgtaaccgcagcaaccatcggaacgctactcatgacgcgtggtcaccggatgcttcccgtggtcacgttgtgtcccatgaatggtaggtgtgacgcagcaagatgcttcggtcccatcgcaatgagacaatgaacagtcgatgggtacgttccgtgtggagattggctcctccgaagcaatagtgtgacaaggtggccgttgttgttatcgatcccgtcgcccgctgggcttcaatgaatgtccgtccaccgttcatcgggaaaacagcatctgggcatccatggagctgttcgaatgcgcatctcgcgtagccatgttacactgagcctatgttccagtgctgcaaggtcctttcgcctggtactgggatacacgggcgtcgaagggctagtgaacgatgatggtagtatccacccgaagggccgacgaagcacatcattgaaatcgcacgctggatgtaccgcagttacccagtcaatgttacccacggaacggcccacgtgttcctgacgagaaacacggggcctagaattgttaccggaaaggaatagaacccgaaagggaatgtgacagttcggggaaagggcctcacaggggacgtccccaaatgtttggaaagcctagcttcgacacttctggaagggtagacgaaggtgccaagaatttgtggctggtcccagactggaccctgaaaaggcacaaagacaaggatggtcttaaacacgcccccccggagagaccaaatcctttggcatttgccagaacaacccatttgggtttttcccccttcgcacacctaagagggtcatcacccctttagtccgggtcactttcccatcggcaaagttaagtaaattagggcacttacgatacatcccgcggaac

SEQ ID NO: 711201 - DNA, 292 bp, Homo sapiens
tgaggatcccctctacgagcgcaaccaagcaacatggtgaaacctggtccctcccaaaaatacaaaaatgatccaggtgtggtggtgcgcacctgtattcccagctactttgcgggctgacgtgggagcctcacttgagcccaggaagtcaaggctgcagtgagctatgatcagtgctcaagagatcctcccacctcaacttcccaagcagctgggactacaggcatgcatcacctcacctggctaatttatttcattttttattttaattcttgtagagaacgtatctccc

SEQ ID NO: 711202 - DNA, 2273 bp, Homo sapiens
  misc_feature (1305)..(1305): n is a, c, g, or t
ctgagatagatctggtcgtcacccagcgagaccaggggcaagatcatggctcaacgcagcctcaaatccgggctcaaagcagtcctcccaccgtggcctgcccaagtgctgggaaaacaggtggtcaagcaccacacccagtcagggctcacggttcaagcccctaacagaaggccttgggccaaaagtgtaattcttcgggagctggttactattattttttgctagatggaatctcgctctgtcaacccaggctggtgtgcaatggcgcgatctctgctcactgcaagctccgcgccttctcgggtttaagccaatcttctgcgtcaagcctcacaaactagctgggaactacaaggtgcacaccaccacacctggctttttttttttgtttctttctttctaagtagagacagggtttcatcatgttggccaggatgatcccgaactcctgacttcagatgatccacctgcctcagactcccaaagtgctgggattacaggcgtgagccactgtgcccagcctcttggaaagatttggattcgcttcatggagccagggagcaggacataggtgaagaacccagcttgtggctcaagttggcctgaatagggttcgaggccctgctcccccgggcctctttgtccatgtgttcaaggaaaaaatgggagagtccaataccaaaaaggtggtcagagatccggagttgggcctgattccaaagaagggtcaaggccaaggcctcgagcttacgtgtggccaccagggggcagcagggatcggggtgtgcaggtggcctttcctccccgcctccactggcccatgggtcagaagtccagctcgggcatcagggtgtgcttgaccgggcagctgggggtctcgggttcctgctcgcagatgtccccggcaacacccatcctgtccccatccccattcccactcccgtccctgtgctctgcctcccaggctctctgctgggccggccagtccaggtgcgcccagcgggggtcagggcccccgatgacctcgtccaccaggtccgccaggtcgggcaggggctcgggtcgctccacaaggatgggcgcgaagggtcccaccagccagggcagcggcacggcctgcaccaccagctccagcagctcgtccacgcaggcgtgcgcgtgggccacgcgaccccggccctcggccagcgcggccgctggcacgtccctgaagcagcgggcatcagcgaaggcggtctgcagggcatccacactgcgccgcacctcagccaccttctcctgggcgccggcgggcaggccccncacgctggactccagagcctctaccgtgccctgcagctcctgggtcaggctgcgggacagcaccagcgtctccagctctgcctggctccggcggcggctctccggagggcgctggccccattccccccacagctcgtgcaccttcccagggcgggccggggcggtgggggtcaccccacactgcatgtggtctatcagctccagcgtctcctgcagctgggccagggtgtcctgggcacggtgtttgctctgcctcagtttccccacagagtgctcgtaggccaggtggcggatccgtgctgacagggagccgaggcgcacaaagtagccctgctgtctcctctgatcctccaccgaacccacttcagggccttcagcctcagccgccagtgccgcgagctcttcctccgtcatgggcaggaagtgatccaccagctcctctgatttttccagtacaacatccacagcatggctcacggagcgcttcagctccacgctccagcgccggcccctccgggccaggtccaccacacccgtgacactgctggccaccacgtccttggctgaggtcaccaccgtctccgaaggttgctggagaaagggaagcttctcttccagcttgtccaggcccctgcaggcgaggctgttcatagtggccagctggggctgcaggtgctcgagcagcggctgggcgtggtccagggcacgggtggtcaggccgcacacgcagttctcagccaggcggcaggcggagcccagcagcgggtgcctgtccttggctgcactgtaaacatcgcagaccgcggtgcacgtggccctgaccaggggcagagccaccacacgctgcaccacgttctgctggtcctgctcccacacactggatctggggatctgagccgcctcttcttcagacatcgtgctgcaaacagggtcacctgggcgcgagcggcttcagacaccagctgtct

SEQ ID NO: 711203 - DNA, 122 bp, Homo sapiens
  misc_feature (85)..(85): n is a, c, g, or t
tgtcaaggctgtagtgagctgtgatcgtgccaccgcactccagcctgggcaacagagtgagaccctgtatcaaatatatggctgnttggatggtggttatgatcaggtgtgtagtttagaag

SEQ ID NO: 711204 - DNA, 928 bp, Homo sapiens
  misc_feature (297)..(297): n is a, c, g, or t
  misc_feature (459)..(459): n is a, c, g, or t
ggagcgccgtctccggtgcaccgagctcgctccgaagtttccaggctcgtgctaagctagcgcctgtcgtcgtctacccttcagtcgccatctatgattatctacgcgggacctctatcgagccactgattgagatgtttctcgcgacatcttacagagatccggggaggatccgcggaccggtgtgtgttgcctgggaaggtgggacgggggacagcatggtcagttaggcacagaccggtacacccatttgatgtgacttcgggcttcatgtgggtggggaaaattgccttccgnttggaagggccccgaaggggcgaaaggttacccgaaaagccacaagtacatcacactgggtggtcgattatgtgtcatttgaacccattcactctgtgcaggacacacaatgtttcacccaaaaggaacgctaacagagaatgtaccttccagtgatcaccnttgaatctccactccaaagcgggaacttttgaaggaacacaagagacccgagaagagagtaacaaccctttttatgaccaggggtttgcaggaaccaattcaagcacattcctttgcctatttccaaaaaaattaccagtttccttttattgtgcctggccacccttggaattccagggattggggctgtggtttgctcttattgtgacttcacccgtgcagggctttggttggttgacaccacaatatttttggattttcctttaaagcgctttgcgttcacgacaacttggccacacttgttcacccacattggtgcgcccactcttttgtgggttctattccacctgttcatcattaaactgcttctggctggttatgccaccaacacccggtctttaggccacatgtcggactgatgtcaccttgggggccttcattatttcgcctgcgatcattggcggtgagg

SEQ ID NO: 711205 - DNA, 139 bp, Homo sapiens
tctaagaagggaaccccaaatttaattaagccttagcacaattagttaaagtgaaaggtagttgtacaagcagttcatcacccaccatagggcatgattatcaaagcaacctttcccttcccccaagtgaattcgcgaa

SEQ ID NO: 711206 - DNA, 418 bp, Homo sapiens
  misc_feature (82)..(82): n is a, c, g, or t
  misc_feature (98)..(98): n is a, c, g, or t
  misc_feature (130)..(130): n is a, c, g, or t
gtgactctagacgatccctttatcatcccccttcgtactcactagcatcttacatatcctctatcagagatctggccagacncacaaaggcttatccncctgtccaacagaacagtcatattaagaatgncacacattatatccttggagacaacttcagcatactcttctgtctctcctttttctttacactaaatgttaggcatcaagagtaaagttataacctagtactacactttctcctcttcataaatccatcactgctagcgggtgtaaccatcaatacttttttacttacacaaaatttaaacaatcaaaccctaacagtcctgacaaatatatactcctgtgatatcagtctgcacagacagatccacagggaaattcatacaataacataaaatacaacaataccaaa

SEQ ID NO: 711207 - DNA, 440 bp, Homo sapiens
ggctcctgacctcgagtggtctgcccgcctcggcctcctggggtactgggattgcagacggagtctcggtcactcagtgctcagtgttgcccaggctggaatgcagtggcgtgatctcgggtcgctgcaacctccaccttccagccgcctgccttggcctcccaaagtgctaggattacagcctatgcccggacgccccgtctgggaagcgaggagcacctctgcctggccgcccggtctgggaagcgaggagcccctctgcccggctgccaccctgtctgggaggcgaggagcgcctctgccctgccgacaccccgtttgggaggtgaggagcgcttttgtccggccacacccccgactgggaggtgaggagcgccatctgtctgcacgacaccctgtttgggatatgagggactcctctgcccgggctgaatcccatt

SEQ ID NO: 711208 - DNA, 850 bp, Homo sapiens
gcatcttgtcgatgagtgcaataggtggtcgtaaggtaatcacgaaatcgctaactactattgctcgagggcgtctcagcgtttcgacactgcgaggccaccgtggttctgagagggccagcttccgtgtcagcgcctcagccgtcctggcctcgtcgtgaagcgcgtgcctatgggcggtcagccttgtcgtcagtcatctaccattgcgctgtgggtcgtcgttggcctagggacctttcgtcatggctaatgggcccgagggtctgcggacctggtagtgaccacgtcactgcgtcctcgtgcccaccctcatcgtttggtcccttttgacacgcattacctcctccaaagctgcgtaatgggtccttcggtagtgcctccgaaacgtgtgaacgggggtctcgtcgctccagtccattgggggtgcaattcgtcgagagatctttgtgagacgacctgagggaacgccgtgtcgcggtatgcttcatgggttccgtaatagtcatttgacaggcggaacgccggcgttggcagaggttgagtaattggcctagagtggcaaacgattttgtgcgcagctcagtccaagtgtttgctagcaagcaccggggactcctacttattatgacccttccgaaatcgaagctactgtatgcaatgataccgtgtgatgcgccctgacgtgtaatttcctcacgccagatgctgaatgtgagttctttacccctacttcgtgattggaacactcctggagggggaaaccctggggttcaggtgttaatttctcttcgcacaggggaaactctggctcagttgagaccgaatggaatctttgccaggatccgaa

SEQ ID NO: 711209 - DNA, 632 bp, Homo sapiens
  misc_feature (29)..(29): n is a, c, g, or t
gaacaaaattactaactaaatccaagagntgttcttagactaagtgattctttgcgcactgtctcacctcaggaatgagccatgcgagctgcgcttaaggcagcggctgtgttggaagcatgttatgacgctgcaccgagagcccagcccgttaccatgaggtcctcgtggtacttcactaattaactctctttggatcagatccagaaaaagaccagccctaaacttaatttcactagtaggaaaggttgttgtaaagaagttccattgtagtttgattttcttaacggggcctttgaaattaaactcttctgtagtcatgattttccaggtaaaagtaagagtgttagttcagctatgcttgaggaaccttagaaacaaaaattaaaccccaggctttttacttacctttttcatatgtcttttcttaaagtgtgtgtatgtttgtgtgtgggggtgtttaaatgaataataatataaatttaatgaacaaagaaaattgatggctgggtgtggtgtcacgcctataatccgagcactttgagaggcagaggtggaaggattgcttaaggccagaagtttgctactatgggcaacatagtgaaatccatctctatttaaaaaaagaaaaa

SEQ ID NO: 711210 - DNA, 637 bp, Homo sapiens
gagacttggcgaagtaggagccctgtgtgttcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccaacctcaggcgtgcgcggacggtgtgcgggtgagtctccccaaaagtggcgcccttgtgatgtcgaggacaggtctccctgtgtgcccgtgggctgctgtctcaccggtggctcgtagtcgcggagaccagaacccggcagcttcaggggctgcctgggggtgggtgttacctgctgtatgtctgtgtccattatgggggtgtgtgtgtgtgtgtgtctgtgtgtctgcgtgtgtgtgcgcgcgcgcgcgtgcgtgcgtgtctgtgtgcccactaccgtctctctcttaagtctctctctctctctctctctctctctcccttctcgctctttccgtcgccctctctctctgtctctgtccgtgtgtgtgtgcgtgcgccttgggacacgtgtcccgtgtgcgccggacgctgagtttcgtgcccgtcggcctctcttctggtcagcctctct

SEQ ID NO: 711211 - DNA, 1036 bp, Homo sapiens
tggaaacagtcttgctgtatggcccaggttggattgtggggggcacaatcacagctcatggcttcctcaatcacccaggcctaagaaatcctcccaccttgtagctggggactacagctcacagcacacctgggctaaaaattttttttcttggagagaaacgggatcctcttatggcgcgcccaggttgggtctacaggctccaggggctacaaatggtgtcctacctggctctacagtttccaaagggcaacgaggccaggtgtgtgataggctttggctcccttgtgcaattcatgtgccacaaacagagaggtttcataatacctatttaaagtgaatgtggacctttcacacataaactgtgggttaatgttgggggtggggacaaggatatcttaaaaggcgtggaaaacagttgtgtaaaatgtgcctcgtgtgaaaagtagtgtttgtttcaagtgccgagttacacctgtggactgtaatatcatataagcataaaagagggagtggcttctggggggatgttacaaatacttgtgaagaaaagagacgagaaagagaagaagaaaagagcatagaatggaagagaaaaaaaaagataaaagagagaaagaagacacacgacagggaaggagagcgcgggacgcagagaagagaacagcgagcagggagggacgagaggcagaagaaacaagcagaaagagagagacagagcgcgacgtagaccgaagaggagagaagaaagaagacgagggaggcaacagagcaaagaaaaggagaaggaatggaatagagaagaagcggcagaggagagaggaagcagcgacaccgagaaacagaagcaagcaaaaaagaaaaagaagagaaaagaaagaaaaaacgagagacaaagaagcaacgcaggaaagaacaaaaaaacgcagaagataaaaaaaaagaagacaaagaaaacgaagaaaagacggaaaaaagaaagagcgagaggaaagaagacaagaaagcaagaaaagaagaagagagagaaaggaac

SEQ ID NO: 711212 - DNA, 167 bp, Homo sapiens
aacaaccgccagcaaatcctaagtcttggccatggctgtttcctgggggaaaaacaccccccaccaaatccttagcttgcccttggggggttccagggggaaaaaaaacggtccaggaaaattttgttttgctttggggtgattccagggggaaaaacatgggttcc

SEQ ID NO: 711213 - DNA, 464 bp, Homo sapiens
acacgggcagccaggtggagagaagggcagagctaccttcagcagacaaaacgacccatgcaaaggctctggggcctggaggagctcgaccctagatgagactggcgctggtattgtccccacttcaccaggaaggaagccaaggctgcagaggatgggcagcacctaacgcctcagggctaattgttctccatccgtccactcgttccaagtccattcacttcctgctacccaaggccactgtccccttccggtgggaccagttacctgatgctgggtttaaccttctccaccagaataaccactggccttagaaactcacttgggtttcacgtctgcatgtgtgtgagctagctctggggttgaaattgtatcagcatgatcatcacagttatatctgatacttgatttgtctccaaaagctccaattgataggttaaataaatgacatatgcttcatcaaa

SEQ ID NO: 711214 - DNA, 856 bp, Homo sapiens
  misc_feature (58)..(58): n is a, c, g, or t
  misc_feature (180)..(180): n is a, c, g, or t
  misc_feature (214)..(214): n is a, c, g, or t
  misc_feature (218)..(218): n is a, c, g, or t
  misc_feature (283)..(283): n is a, c, g, or t
  misc_feature (302)..(302): n is a, c, g, or t
  misc_feature (308)..(308): n is a, c, g, or t
  misc_feature (341)..(341): n is a, c, g, or t
  misc_feature (398)..(398): n is a, c, g, or t
  misc_feature (460)..(460): n is a, c, g, or t
  misc_feature (597)..(597): n is a, c, g, or t
  misc_feature (601)..(601): n is a, c, g, or t
  misc_feature (626)..(626): n is a, c, g, or t
  misc_feature (632)..(632): n is a, c, g, or t
  misc_feature (665)..(665): n is a, c, g, or t
  misc_feature (720)..(720): n is a, c, g, or t
  misc_feature (732)..(732): n is a, c, g, or t
  misc_feature (840)..(840): n is a, c, g, or t
ttcagaagtttgccattcatttcactcccccccataaaaatgcctggccttagcaganaatcttctatctttcaggtattttctcagtagaaggtttatttgttgcagttactttttaagagtttaattttcattgttaaccttactgaatcatcagtgaacccagccgattgggacccnctgtggttccattctcagtttctctatggcagtntgcngtttttcaaaggctttgtctagattatcatttatgatgatcaaatcaaaatagtggttgtttgcnctctgaatccgtgcccttncatccnctgttttcttcaagttagattgggtcagaagcntgggagtgattcctgcctcccccacacccttgtccatgggacgtcacgcctctcgcnccggagccgcaataaataccacacagggcataaactctgaggtcctcaatactttcagtccntgtgggtggacatccagaatgccagttcgtccagtctggacaacctcaagaatagaatcaattttggttccatagagatttccttcatattccccatgttccacatactttccagctttaatatctgcttccatctnagancgtgacaaaaacttatatgcctggncatctntttcatctccccttggtttccgtgaagtaaatngcaccgtagttccaaatctagtgggattaaatactataaacctgtctttcaagcntcttcggcctanaccttgagcccctatcaatactaatgtttttctaaagaagggaggaattttggctacctcctcaaatatctggatttcatgacgatcaaattcagcataaaggtagcnctcaagtaaagaaagt

SEQ ID NO: 711215 - DNA, 169 bp, Homo sapiens
  misc_feature (43)..(43): n is a, c, g, or t
  misc_feature (75)..(75): n is a, c, g, or t
  misc_feature (93)..(93): n is a, c, g, or t
  misc_feature (124)..(124): n is a, c, g, or t
  misc_feature (158)..(158): n is a, c, g, or t
cgcgctgagccgcctggggcgggggaccccgtgcaggccccgngccctctggtgctgccagcgcgcggccgcaanacccgccacgacccgctngccaaatccaagatcgagcgagtgaacatgncgcccgcgtggaccctgcggagttcttcgtgctnatggagcgtta

SEQ ID NO: 711216 - DNA, 126 bp, Homo sapiens
cttcaagcagatgataagattgtttcatgaaggacaagtgctatccaatctaaaagtctctgagggaaccatagtaaaaagtctcttataaagttagcttgctataacatgaacttggaatagctg

SEQ ID NO: 711217 - DNA, 94 bp, Homo sapiens
ttggccccctcccgtcaggcccagggcttggagtgaaaattactttcaggtggtggggtggggaatgtgaataaacattatttcttgtcgggga

SEQ ID NO: 711218 - DNA, 537 bp, Homo sapiens
  misc_feature (342)..(342): n is a, c, g, or t
  misc_feature (367)..(368): n is a, c, g, or t
  misc_feature (370)..(371): n is a, c, g, or t
  misc_feature (393)..(393): n is a, c, g, or t
  misc_feature (481)..(481): n is a, c, g, or t
  misc_feature (530)..(530): n is a, c, g, or t
aataaagcttgtcaggatgttaagcatctcaggagaaatattggaaaattatatgtataaaaccaaagtgctatttttaaaagcatcatttatggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgcagaagcacaaggaacagtttgatcacttttggtctgaaacaaagctgtatagggatcctctctctcttgagcaaagatacaacagaatatattttttggtgaagctttngagccatgtttactaataatctggnntnnaagcttctattctacctatggntgaatcctcatgctcttggtaatggttacacacttgcagtgtagcccagttggaatattatttgggtatcaactggccatggaggagntcttgatgatccaggctcttggccttcatacccacacaggctttggccnggttccc

SEQ ID NO: 711219 - DNA, 599 bp, Homo sapiens
acagcatatgccaaaaattcttttgcttcaaataaagacaagccttcaaataaatcattatgtctgacaactgaattatttgaaggcttgtgtgatttgaagaaaagcatattgccaaaaattctggttaaaagcttccgtaatgggtaacagaccatgggagagatatgtggttgggtaatgcgaatgtagttatacaaagaaaaatacagatgtctccagacctgaggactttttaatagggcggttgttgtgttggtggcacattggatatttctaacatgtacaaagctatgtagtgtgatgttactttacatatcttggctatggtatattgttagctttgctttaaaatgccaatgaagcttgtgatcatgtgctagtcgatggctccattttgaagagaattcaagtttgcatgtctacagctgactgtggtgttagagattgagtcagtcgacattcaggatttcaagtctgaggtagtcgaacccgtcaggaaaacaaaaatgggcttgatctgaaatcagtactggtggaaatgaactaatattaggtattatggaagtaatggtccagttataagaatatgcttctgg

SEQ ID NO: 711220 - DNA, 455 bp, Homo sapiens
gctatacccgcatacccaagtgtgcagaagctgctgcaggactactttaacgggcgcgacctgaacacgagcattaaccccgacgaggctgtggcctacggtgcggcggtgcacgcggccattctgatgggggacaagtccgagaacgtgcatgacctgctgctgctggacgaggctgccctgacgctggcgctggagactgccgaaggcgagatgactgtcctgagcaagcgcaagtgcaccatccgcaccaagcagacgcatatctttaccacctactgcgacaatcaacccggggtgctgatccaggtgtacgagggcgagagggccatgacgaatgacaacaatctgttggcgcgctgtgagctgaacggcatacctgcgtgccccagaggcatgccctagattgaggtgaccttagacatcgatgccgacggcattctgcgtcacgtgcc

SEQ ID NO: 711221 - DNA, 168 bp, Homo sapiens
tctcaaggtacatcagtgtactataactgcagccctcatggatccctctgcattctaaaagatagtgggtgtatggatagaaggaggtggtggtcgtttattttttttttttttttattttttttgaaaaaaattcattggcccctaaacaaaccttagccccattac

SEQ ID NO: 711222 - DNA, 216 bp, Homo sapiens
cgactggcgggtctcgacacccgactggaccacgcgcgccagtgcaaagccgagggcggctgcaatgccgatcgccaccgccgggctcttcgcgacgaaggcgcgggcgtcgtcgagcagttcctcgacgtccttgtccttgatcgcacccgacagcgaggtcacggtgtcggccgccgagcgggcatattgaccatattgattacccagcttttc

SEQ ID NO: 711223 - DNA, 523 bp, Homo sapiens
  misc_feature (43)..(43): n is a, c, g, or t
  misc_feature (59)..(59): n is a, c, g, or t
  misc_feature (91)..(91): n is a, c, g, or t
  misc_feature (312)..(312): n is a, c, g, or t
  misc_feature (315)..(315): n is a, c, g, or t
  misc_feature (372)..(372): n is a, c, g, or t
  misc_feature (384)..(384): n is a, c, g, or t
  misc_feature (390)..(390): n is a, c, g, or t
  misc_feature (427)..(427): n is a, c, g, or t
  misc_feature (434)..(434): n is a, c, g, or t
  misc_feature (491)..(491): n is a, c, g, or t
  misc_feature (498)..(499): n is a, c, g, or t
  misc_feature (516)..(516): n is a, c, g, or t
gacgccaaagagactcgagtggaagttaaagtttcaagtgagngcaagcaaggtgttcnagccgggctgcgggttccctgttaacgttctnccctaggcaaaggtcccagttccttctcggagccggctgtcccgcgccactggaaaccgcacctccccgcagcatgggcaccagcctcagcccgaacgacccttggccgctaaacccgctgtccaatccagcagaccacgctcctgctacctctgtcggtgctggccactgtgcatgtgggccagcggctgctgaggcaacggaggcggcagctccggtcngcnccccgggcccgtttgcgtggccactgatcggaaaacgcggcggcggttgtgcagcgntcacctctcgtntcgctncctggcgcgggctacggcgacgttttccagatccgcnctgcagntgccccatagtggtgcttgaaatggagcgcgccatccaccaggccctggtgcaagcnatgggcnncttcccgaaccgtgtcncttcgcc

SEQ ID NO: 711224 - DNA, 164 bp, Homo sapiens
gaaagatcccaaataaacaatctaactttatatctcaagaaattagaaaagaaaaagaccaacccaagcccaaagttagttgaaggaagtaaataatgaagttaaaagcataaataaccacattagagattagaccacctaacatgatcaatgacaccgagtag

SEQ ID NO: 711225 - DNA, 165 bp, Homo sapiens
ccgattgggctcactgctcctttcacaccacactctcgctttgatgtgcttgtgctgtgactacttcacagagcagcacaccttctcctgtgcagatgtgggctcccaatgtgcccacatacagggtgtgctagcagtggctggactgtgggtgtagtgagtgtt

SEQ ID NO: 711226 - DNA, 803 bp, Homo sapiens
  misc_feature (15)..(15): n is a, c, g, or t
atgatacccctaaanaggcaatgatggggagaaggatatacagacatcagtatcaagcatgtgatcgtgccgatatggcacactgtcatatatcgtggacgaaaatgtgcatccatctatctggcgcattcctggaatctaatcaaatgacgtgatgagacagtcgtactagaaatgaacgcatgtagaacatagattgtgatgcaaaaggtaagggcatagtcgtagcaggtagtggggtgacaagggacgtacgcaatttcgaaaagttaactcgtcgccttgtgagattcaatatgcgtattaacaagcatagcaacatagtcgctgggaaggcggatgggaatacggtgagtcaacgaaaccaatatgtatggatctactctttgatgagaattacattttgatgaactcgaacgaagatagataccatattggtcgatcttactcgacattgaagtaagacctctaagtgaaggaagcatgagtacgtgataaatcgaagaacaagctattgagttataacaggggggatcgagatctcgaagggcgatgatcgttgtgctatgttcgcatgattaaagttggctggtctgtgatagtgagggttgaactttttgaaacagtgtggctaatacattccaagggaaattaggagtcaaagagacccgaaagaggcactagcacgcattgcgtaggacatatatcaggcactggagagatgatttgagaatcagatcatataattagtccgggatgtataaactaatacattgagatattgcagcatggatgacgcgatc

SEQ ID NO: 711227 - DNA, 108 bp, Homo sapiens
cgatggcggtccacatgatgtccacgctcacacaatggggctcagctgaactgggagagggaagtagccaggaagggtactgatgagcgtatggaagcagaggagcgg

SEQ ID NO: 711228 - DNA, 147 bp, Homo sapiens
cgaatctctcaacacacatgggcttgccatgaaccatatcatgaatggcatgcatcaccagacttcaacaatttagggtcatcttccagctttttacccagaacggcgatcaatcttctccttcagctcatcacacttgcatgcgat

SEQ ID NO: 711229 - DNA, 185 bp, Homo sapiens
tcttcttcctgagactgcatcatgtcgcccttgcacccacccccccctccctcgaatcgaaggggctaccattcccgatgaggctctcgaaccaccgttttgggttgtgttaaaggtgagaccctccctcccctttatgtcccatctcgaactaactgctaataaaatggggttctgtcttgtta

SEQ ID NO: 711230 - DNA, 146 bp, Homo sapiens
atgcatccccacaatagtgcactgtgaaatctcaacattcccaattctgcacacacttccatccaacccaacagtggccagcacaagctcagctgcagcatgcatggtcacagggccacaatgtggggggcatcctctcagcagtc

SEQ ID NO: 711231 - DNA, 710 bp, Homo sapiens
atttcattcaatatgtctttatgaattatttaccattgtgtacttcaatagtagcagaagaccaaagaaaaggtcatctaatacatgggagaaacatggatttggcacgtattgtcttgggtggaacataaataatgtatacgctgggtcgataactgaagcaattaaaactctttaactagtgaatttggatttccaaagaaacaagaaaactgtcttcaagggcttcaagcattggctggctatgtgggcatgtcaagcagggattcaagaccaggacgtgtcacagatcattacgacgtgaatgaatggtctcagtataactggtggtgatctgggtatactagaatggattctgggaagagaacagatgccatgtgcacagggtgcctcactagaagcagttctggaaagatagcacaagttatgaagaagccaagaatttatggaccaatgaccaagatattggccccagcctactttatcctgggaggcaagcagatctggggaaggtggtgtgattacacgagcacagaaaggaatcatcggatgtatatgaactcgatgctaagcacgggtagctggtatgtggtacaaacaaatttattgaccgtgggtaaccatccattcttccttgatgatcgcagaagcctgcaagatgttgtctgaaccgaccagcagagaatatttcatttgaaccatgttgatgc

SEQ ID NO: 711232 - DNA, 399 bp, Homo sapiens
ttttttgaagtggacccaaggcccccggagcttttcagcagctggcttcagagccggcctgacctttaccttaattttgtggctttgcgcagggacttttttggggggccccggttcctgcatatccggaggtttgggccctagcatggcttccctgtggatgccttgtcagttccccccgcctgacccgaggggaggtgggtggcactttcccgagcccaggtttttttggcctttcccagggttttgtgatttccccctgctctgcatttttagggtatttttagggcacctgggttggctccctcacatcagggtggctgagggccgtttctctgtgttggtgaaaattctgtgggggtatcgggggatttggcccgtaaagttttggggggctta

SEQ ID NO: 711233 - DNA, 662 bp, Homo sapiens
gttagaaggcatctccctggagttcagaggtattggattgaccaaagaagtctgctggacagtatgtgtgtatacaaatggggctccacagtgattaaagacaagagacttataacaacagtgggtatctactgaaggaaacatgcatgacatttagtgttctgtgctggtctgggcacccagctttggttgccaaagatggtaaggggtgtaaaagtcatgtcacgtatgaaagagcttggcaggaactagtttcaaacgatccacagcttgtggaaggagcgattagagcagagctaagtccacttacaagataggtagattgcagctcaatataaggacttgttggttaatatcagtgcagttccaaatggaataagctgtatgaacatggcttagcagaatctgaatgacaacctgttagaagttctaggtaattctgcactgagtacaacgttggattatatccttgggctgtttccaactcaagattctgttatctcattataagcattttgaggaaggcagttggtataaaggtgaccttagtaataaaagtcagtgtgaagtctaaagtggtgccacaatgaatttaaagacaagaattgtagggtcaaggatacagaaaaatgcctagtaacatcgtgccgaattcctgcagc

SEQ ID NO: 711234 - DNA, 103 bp, Homo sapiens
  misc_feature (37)..(37): n is a, c, g, or t
  misc_feature (54)..(54): n is a, c, g, or t
  misc_feature (80)..(80): n is a, c, g, or t
tggcaggactgtttgccacaacggggtgctaggcctnacccgcctgctgttttncctgctgggcttcctccggattcgcnttcgtggccagcaagcctctcgc

SEQ ID NO: 711235 - DNA, 200 bp, Homo sapiens
cagttccacacctataacatctaatcttcaacacagtcacaaacaccaagcaatggggaaatgagtccatattcaatacatgttgctgagataactgagctaaccatattcagaagactgaaactggaccctttccttaggccatatgcaaaaatcaattcaaaatagattaaatacttatatgcaaaaactataaaaac

SEQ ID NO: 711236 - DNA, 519 bp, Homo sapiens
tagaggaccaggtcatgtatacggaagtcgtaactacaacagtcattgagtttagactctctgtatcatagagcacaacgcatcagtccagtctctggtgactgattataacactgtagactgagctgatactaagataaagcaggcggtctagagtgtcacataatcagatgtctaatggcccagtcaaaagagtgcaaagcttacatcagtaagagagaaaaataaaaattttttattggtttataagtatcttttgtgctgaaagtcaactttatgactggatataaaaagtcaggagttaagagtgtcatgcagcagcactgatttaatgactggagatagaacaaacagatgtttgaacaaagactgacattcttaacaggttttattatatagggtggaatgctctaaattcatgaacgcttttggaaaatcttcaattctcaaccccttaaaaaagtaccctgaaccaggaagaaaaatccagagacagaaataatgatctgggtatacatg

SEQ ID NO: 711237 - DNA, 1564 bp, Homo sapiens
gcagcagcagtggggcacgtccggcattcaggagctgtggcagtgttctgttcgtagccagcgactcaacacacagcagcacattaaatcattgtggttgcattgttgcagcaacatgtgcaagcacagcatttttcattcattgcaagttgttccacagttgccgagaccagttgcaaaatgggcagtgcaatgcgacgaatgacttgtgtgcccaacatctaccattggtcttcttttgtgagctgtgcaagacaggtgtcatggcccactgtgcatcactactataccacatgccctgcctaatacagcacaccacaaggccatcactctttgggtcgcagcaggcataacactgactggccgtattctgtgcagacatcccgaaagaagtacccatccctgggaaccaaacaatgcatcttttgtcgtgccattcaacgcacagcaaggccacgcacaaggtgcaagcacttcaactcagcttcatcgtcgagaaaaaagctcactcacatgcagtacataaatctggggcccacttgcctcttcattttcatatcacaacaaaccagcacacatagtcatccatggcactttacacatcatagctggtaacccaatccctttctcacatacagactcgtccaatcaccaaccgagaacatttccatagcatcacttgcacattgcactggcaccagcaaattcattcgcgggccaggggcgatgtcccttggcatctacaaacacacctcacaggccactgggccttagggttgggttcaaaaactcgcagacgtcagtggatttcgcaggcatcagtttctggcagctttcgttgcacgtcgtagttacagactcccaacaatttaccaaggttacaacattggggtaacatcacacgttgtgtagaataacaccacccaccttcttaagacaaggaacatctcctggactttacggaaactttacagccgcaacgatcaaccgtgctagcacacgttcttctacaaccaactggacgttgatgacacgtctgtcacacgttctttgaagacaccatttatacctggggacgcaccctgggggccgtcacacatctgtttcactcacttctgctcttcttaccgcctcggcgggtcctacttgtcaaccaccacgcatagtcgctaacacaccccgtcggcgcgcgcacatgatcgcatccaacgtactatcaatcaaacaccactgtagaagcgacgactccaccaacgtggagacaaggtagccacatggaagtaaggccaccgaacaaggcgtcgacgcgacacgacatactctaagccagaacgaacggcaagacaaacgagcgcggacaacagccaacgcacagaagacgagacaacgaggacgacagacaggaggacacgaacaaccacgcccgcagcggcgaagaagacgaacacgaagacacgagacagcatcgcgcacggccaggtcacaggcagacagaacgggaacaacagccaagcaacacacgacggacacaacagcagagagtagacgagcgcctgagccgggg

SEQ ID NO: 711238 - DNA, 213 bp, Homo sapiens
ggtgtacatcaaatgaaatgtagaagtgtgtatgctgtacaaaccacaagaaactttctttaagttgtgttaaatgaggagatgacctagaatccaagcgtgttacatgaaaattgtacatgagcagctgcttccacctttcagatatagatgttggaaccacatgcatatgttcttgctctatcctgtgatctgcatagccacaaaggtagt

SEQ ID NO: 711239 - DNA, 375 bp, Homo sapiens
  misc_feature (12)..(12): n is a, c, g, or t
  misc_feature (32)..(32): n is a, c, g, or t
  misc_feature (41)..(41): n is a, c, g, or t
  misc_feature (61)..(61): n is a, c, g, or t
  misc_feature (76)..(76): n is a, c, g, or t
  misc_feature (103)..(103): n is a, c, g, or t
  misc_feature (105)..(105): n is a, c, g, or t
  misc_feature (107)..(107): n is a, c, g, or t
  misc_feature (109)..(109): n is a, c, g, or t
  misc_feature (124)..(124): n is a, c, g, or t
  misc_feature (138)..(139): n is a, c, g, or t
  misc_feature (184)..(184): n is a, c, g, or t
  misc_feature (191)..(191): n is a, c, g, or t
  misc_feature (200)..(200): n is a, c, g, or t
  misc_feature (217)..(217): n is a, c, g, or t
  misc_feature (221)..(221): n is a, c, g, or t
  misc_feature (295)..(296): n is a, c, g, or t
  misc_feature (301)..(301): n is a, c, g, or t
  misc_feature (372)..(374): n is a, c, g, or t
gacaaatcaganagggcacttgacaataaatnttgattctnagccaggagaaaaacttganatgttgacttaagtnagggggaaataaaacccagagcgagananananacatgttactatganagacttgtattccnnattgtctctgaactttaatcctgtgaaaatgctcaaagttttggngagagtnatataaaanaactgactgtggctganaganttgcatttaaaaatatttatgtgcaccttgttactttctactctgcaatgatgtattaacaattcatggtattnntttgnattcttcaatgacccttccacatcaacagtatttatcatgtgttaaagtcatgggtcttatgtgcagattnnnt

SEQ ID NO: 711240 - DNA, 875 bp, Homo sapiens
ggaagcccttgcaagagaaagagcataaattgtaagagtacaagctgctaagctagccagagtttccctggtgcgcaaagaactcaggtcccggatccagagcctgcctaagaacttatctcgattgcccaagtgtcactgggcagccacactgacacctgtccctttgcgggagacatctacagtgagagagttgatggaccagcctctttccaggtcccagtgactttgcaacgcagatggacgcacaggtaacgtggatagtcctgttagtgtatatgagtactcatgtgagaaagaaacactaacaaaaggaacaaccgtagtaatttataccaatacttgtttaagaagtgtcggttgtgtgttactatctacacttcggtaaattagacgatgacttgaattcgcatcaacacgtggatgatctgtgtgtagtaattaagctcaacaagatagtgattatctgcaagagagatctttttgtaaatttcttgttttgatccaaggccttgggagaaatctctggttggattcctctcgggtattcccactggtgtgcctttatttgtcttcagcatgtaatcactgtatatcgatgtaattccctgagagcgacagagcctactgaggaagtcgactgagacttataaggtctagcttgggacccgatcgtcggaaggggactcaatgtccaaaattatcttgaccttctccccaaacagaattccattctggtctatacaagcccttgaatcacttagaggtcggggattaaccctaaaaaaggtggcccctgcggggggaaaaagctctaaaacgggctatacaacggaaagtcccccccgcgccgtgattcaaggggaaaggcccct

SEQ ID NO: 711241 - DNA, 93 bp, Homo sapiens
tttttttttttctgcctactatagaagttaaaccacccgatagtccttcgagcaaaagcaaagatccaccgagagaagaagagaaagaaaaga

SEQ ID NO: 711242 - DNA, 338 bp, Homo sapiens
tagtcggacccagttctgcttcttgaaagatccgtacctctctttggacacagctgcagtagtcatccttctgggatagccagcctggatcagaacaactggggctcatatatctgctgtgcactaaacctgtgaaggcgtatgataggaacgttccagtcagactgtactcctctggtggctctggggaaaagggcctgatgaggggagatgcgcttttttcctccggtaatgctggcctcatccctaactccctctcctgctgtcttctatccaatgacagagtacccagattataaccaaggtggatggcctggggttcaagaagcaggaactgg

SEQ ID NO: 711243 - DNA, 1492 bp, Homo sapiens
  misc_feature (115)..(115): n is a, c, g, or t
  misc_feature (121)..(121): n is a, c, g, or t
  misc_feature (137)..(137): n is a, c, g, or t
  misc_feature (163)..(163): n is a, c, g, or t
  misc_feature (215)..(215): n is a, c, g, or t
  misc_feature (228)..(229): n is a, c, g, or t
  misc_feature (302)..(302): n is a, c, g, or t
  misc_feature (321)..(321): n is a, c, g, or t
  misc_feature (389)..(389): n is a, c, g, or t
  misc_feature (400)..(400): n is a, c, g, or t
  misc_feature (511)..(511): n is a, c, g, or t
  misc_feature (538)..(538): n is a, c, g, or t
  misc_feature (548)..(548): n is a, c, g, or t
  misc_feature (553)..(553): n is a, c, g, or t
  misc_feature (618)..(618): n is a, c, g, or t
  misc_feature (628)..(628): n is a, c, g, or t
  misc_feature (648)..(648): n is a, c, g, or t
  misc_feature (715)..(715): n is a, c, g, or t
  misc_feature (761)..(761): n is a, c, g, or t
  misc_feature (763)..(763): n is a, c, g, or t
  misc_feature (765)..(765): n is a, c, g, or t
  misc_feature (774)..(774): n is a, c, g, or t
  misc_feature (864)..(864): n is a, c, g, or t
  misc_feature (869)..(869): n is a, c, g, or t
  misc_feature (888)..(888): n is a, c, g, or t
  misc_feature (984)..(984): n is a, c, g, or t
  misc_feature (1108)..(1108): n is a, c, g, or t
  misc_feature (1153)..(1153): n is a, c, g, or t
  misc_feature (1210)..(1210): n is a, c, g, or t
  misc_feature (1260)..(1260): n is a, c, g, or t
tttctatatccatccgacgacaccgccgcccaatctgtgcacaggtcaccctcccgccgcacccctcggctctcttgcttgtgtctctctcaccacttaatccactatctttatntctctngtattaagtaatagangcaaacttagtcacgtcgtctattanggttcttgttctcgcttattgtatactctacacaatctcgcttctcacacancaccctcacacannccatagtgatcgactttctaggataccaaactcacattcactgaaatcatatacatgcatattattttaatantcctccgcgcagcagtggngcatcgtgcagtgagtgcttacgtatatgtatatattgagctcaatagtagaatctaatatgctggtnttattatgagngatataaatgtaattctattacatttatatatatacgtccgcgcaatagacaaaccatcgctcgaagaacacgaatcactaatacactcacgaggacaatctgtcacatcncaacacctactgctcccagcgcacatnctaagctcanctcgntccctgcgttaacgagtcccacaagtatgcacagcgtcgcataccacgcgccagtgacgcttcgncagtgtcgantacgacgcgtcgtctctcgngtcgcctaatggtgttcagtgagactagcgttacgttgcgtcttcttctcgctcgtccgacgtccgntcgttctcgctcgtctgtgtctcgtgcttgtctgtgtttgttgctntntntcgtatgantgtgaaacttagcatatcactacgcactgccactaactcagcttacatacctctcacagctatctcacatctgagaatcatagctatgantcaanactatcacgactaactctntgtatatatatagatatataatatagatagaataatgtaatcatatacttatatgttataatatatatattactaggatatgattatacgtataanttagatacgcacatctcgctacaatatcacactccacacaatacatactacatcgctacgatttcttatcaatgatcactctggaactcaactcgactgctcctgacgtgcaccgctactgtantgtatatacacgcagtacgatgtgtagcactagagcgttcctcantctctactcctgcgtcatactactactacactgctcctatcatctttctatcacacnctatctgatcagtgcatcaccatcatacacctcacgcattatactttatnctcactgctccatgtactattctcttagcgtatattcaatgttagtctcataatatagagatagactatttgcatatttacatcccgccatccatagtatcactatgagtgtcgcacggttacgccgacactcaccgtcagccgcacgtccgcgtatcgtcgactcctctctctgtggactctacgcacaccgtacgcaccattcatcgtacactaacgtataattctccat

SEQ ID NO: 711244 - DNA, 1939 bp, Homo sapiens
gggggcgcgggggcagaggtgacctggggctctggacttagacccaagggctagacaccccgggtctgactggtgggagagaagacgtaatgtgaagggggttggcaaccaagacgcgggaccccacttgcagtaccccccgtctgcggccggcgtcgcccacccgcagccgccggccgggcaatggcaccacctagcggacggcaccagtgcggggaccccagcctcgaggaggcgctcgtgccgggcggaggtggcgcttcagcaccgtcgtgggccggacagcgcctcccgcccccggccctcgaaacctggcttctggagcccagccgtagggaccggacggaagacaccgaaggaatggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 711245 - DNA, 2028 bp, Homo sapiens
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcggtgagcggcgggctcgtgggaccggggaccgcactccctgccctccctgtgcctccctcccttgtgacacttgctctgggccccacactaggtgcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 711246 - DNA, 2807 bp, Homo sapiens
  misc_feature (1794)..(1794): n is a, c, g, or t
  misc_feature (1976)..(1976): n is a, c, g, or t
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggcccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccaggtaccccctcagcctgccacatcttcgagggccactggcagctgaggaatcacaggactttggaaagggcatggatgaactgggatggattgaggcttaaggaagatgtgggaggagggagtggacccacaagcacggtcagttctccggcggctgcagcagggcctgtgtgggaaggcttagagatggtgagtcaggagaggtaaggaggggtggaaactatgaccatatccttaaaaagataaacaacatgcatgtggatggctttgccaccaactagctgtgatcccaacctgttagatgggaaaaggaggtgccttcttggccaagtgaaagaaaggcttgctgtctgctctaagcccagggaaccaatggggaaagaataagctaaatgtgttaacggattccaaattacttaaagcctttatgggaacacggtagattgtaggtaactagatagggttgccagatcagtttgatttgactttcagtataatttttcagtatatgttccaaaaattgcatgggatatgcttatactaaaaaaaaaaaaaatgttgctaggctggacacggnggctcatacccgtaatcccagcactttgggaggccgaggcgggcagatcacctgaggtcaggagttcgagaccaacctgggcaacatggtgaaaccatctctactaaaaatacaaaaattagccgggtgtggtggtgcacacttataatcccagctactcaggaggctgagacaggagaatngcttgaacctgggaggcagaggtcacagtgagccaagatcacgccactatactccagcctgggtgacagagtgagactccgtttaaaaaaaaaagttgctaaatctggccgtcctaaactagatggcagactgagaaatgtgactcccctccccagtaccttgttttctgtgtccttgtagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 711247 - DNA, 1295 bp, Homo sapiens
  misc_feature (578)..(578): n is a, c, g, or t
ggctgtcgcggtgttgtgctgtggggaaggggagaaggcattatgtatagccctggcagtggtaggtcttctgcttactcctgagagtccgctgtgactgatgcgggagaaccgcccgaggatgcaagccaccagtctgatcatgttctgcagcagtgcaggtccacacagaccttcaaactgagttggactctgcggtgcataagagaggaaggtgaagtataattaatagctcaaaggtcgattggcactgaggcatagcgagttgtgagattcacttgtcataatgtgcaacacaatggaggagagcacaatgtctacgtagaacttcatgagaaattctacttactgatctgagaagacgaggagatgcttcgcaactgcacattcaccgtctaggatttctcttcctctcttggagaagggatcgaacatgcaattttggcgtagcacttagagtcaaagttaccttccctacaaataatggaaacctggggcgcatcagtcgcgcaagcgtagagggaccatcactcggttcgcatgtggcaacgctatctcatctcaagggcagaccaaanacctggcgcggggctgcggtttcaaaaccagcgttctataggaattagtctaccgttaatgtgtcactttttcataacacctccctttattatttctccccgttccaggagtggaccatgatattactctgaattgtatataatcaccacctaagcacttcaagggattgccttatagcacgcgtggagtatggtggggggtaagttccaccaaactacacccgtgaagcatttaggcaaagcgctgtggcgcaagccctccgcatcttcgtatattaggatacacccattccatttgcgttgacaatttttgggaaagtgtacgttaagttttggccgtccaagtacaattctcccacttataactagccgatagaagggattcagccacattgggttgcgctcgaagttgcaagcgggggtggaagttccacaaggcccgtcccaagttcactcccgttgtcactttaattatagccacgtgctttcccgtttctgtgtaacaatagcagtgcaacgagtagatagccaccgggaaagtaaggggtcacaagacatatattttccaagcgcaccgatttggcaaattgtctctcaagggtcagtggattgggtcgacatataaagagtacaaggaattcggaagccagaagtgcacacaatgctggtatccacagaagttgaacccttgtatgcccaaaattatggggcgacact

SEQ ID NO: 711248 - DNA, 382 bp, Homo sapiens
  misc_feature (291)..(291): n is a, c, g, or t
  misc_feature (354)..(354): n is a, c, g, or t
  misc_feature (368)..(368): n is a, c, g, or t
tgtccaccgatcagctatacgtcattttgctcaaagttacaatttctaagaaccaacctattgatgatgtttagtgaggacttactgtagttgaatttgtcaatcttgttcacaaagatatatcatctaaaatttttctgcttttactcttaggttgtgaaatgagtgcagtttccttttttttccccaaaatgcatatttggaaagccatattgaaaagcctatcttttccccactgatcttaagtgccagctcagacgtaaaacaggtttccttctatgcatggctctntctgggatctttattcttttattggcaaatctgtaccagtctgtactgataccacactgtctntcttactatagctntataaatagtcttg

SEQ ID NO: 711249 - DNA, 386 bp, Homo sapiens
ggtcgacataaatacacttaccccacatgtttcccaaccctccggggggcggttttcaaaaaaaactccccccccacttcttgtttattttggggggggggggggggtcgaaataaacacccgcgggggtttgtttttttctaaaggggcggcggggatttaaaaaacaccccccggctctgttacccaagctgggggggggggggggtcttttacaacctcccagccccaagcattcctcccacctcagcctcctgagtaaatacaatccccgcccattttgttattttgttgagatggggactcgctatctcaagctgcccttgaattcctggtttcaaataatccttcccacctcggccttccaaagtgccggatttacaggc

SEQ ID NO: 711250 - DNA, 1990 bp, Homo sapiens
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagatccccaggctgaggaggtgggtcagtggcccacccgctgttctcaccccacagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 711251 - DNA, 103 bp, Homo sapiens
tgtatttactcgaagaaaagtcctgtttgtatcgtcacaaacaacggaaggtggctgaatagtccctaggggacactgtccctggcgagtgaaattacggcca

SEQ ID NO: 711252 - DNA, 3055 bp, Homo sapiens
  misc_feature (2042)..(2042): n is a, c, g, or t
  misc_feature (2224)..(2224): n is a, c, g, or t
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtaactcccacatcacggtggccccccagggagtgctggtgtctgggaccttggaaaatgcacaggctttctaagaaccacagctcccatgcaggctcagggaacactagggacctgccttcagctccatggacgtgtgcacctagcacccggcagattgctgctttccccactcctcaggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccaggtaccccctcagcctgccacatcttcgagggccactggcagctgaggaatcacaggactttggaaagggcatggatgaactgggatggattgaggcttaaggaagatgtgggaggagggagtggacccacaagcacggtcagttctccggcggctgcagcagggcctgtgtgggaaggcttagagatggtgagtcaggagaggtaaggaggggtggaaactatgaccatatccttaaaaagataaacaacatgcatgtggatggctttgccaccaactagctgtgatcccaacctgttagatgggaaaaggaggtgccttcttggccaagtgaaagaaaggcttgctgtctgctctaagcccagggaaccaatggggaaagaataagctaaatgtgttaacggattccaaattacttaaagcctttatgggaacacggtagattgtaggtaactagatagggttgccagatcagtttgatttgactttcagtataatttttcagtatatgttccaaaaattgcatgggatatgcttatactaaaaaaaaaaaaaatgttgctaggctggacacggnggctcatacccgtaatcccagcactttgggaggccgaggcgggcagatcacctgaggtcaggagttcgagaccaacctgggcaacatggtgaaaccatctctactaaaaatacaaaaattagccgggtgtggtggtgcacacttataatcccagctactcaggaggctgagacaggagaatngcttgaacctgggaggcagaggtcacagtgagccaagatcacgccactatactccagcctgggtgacagagtgagactccgtttaaaaaaaaaagttgctaaatctggccgtcctaaactagatggcagactgagaaatgtgactcccctccccagtaccttgttttctgtgtccttgtagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 711253 - DNA, 892 bp, Homo sapiens
  misc_feature (44)..(44): n is a, c, g, or t
  misc_feature (169)..(169): n is a, c, g, or t
  misc_feature (208)..(208): n is a, c, g, or t
  misc_feature (234)..(234): n is a, c, g, or t
  misc_feature (248)..(248): n is a, c, g, or t
  misc_feature (312)..(312): n is a, c, g, or t
  misc_feature (336)..(336): n is a, c, g, or t
  misc_feature (355)..(355): n is a, c, g, or t
  misc_feature (357)..(357): n is a, c, g, or t
  misc_feature (359)..(359): n is a, c, g, or t
  misc_feature (464)..(464): n is a, c, g, or t
  misc_feature (467)..(467): n is a, c, g, or t
  misc_feature (514)..(514): n is a, c, g, or t
  misc_feature (517)..(517): n is a, c, g, or t
  misc_feature (519)..(519): n is a, c, g, or t
  misc_feature (524)..(524): n is a, c, g, or t
  misc_feature (675)..(675): n is a, c, g, or t
tcaggcggggcgagttaggcgacttgtccctaattttcgatggnccatacctaataggcatattgagcacaatgaagcgagagatgatgtagaaaggtttgtagggcagatgatggaaatcaagagaaagactagggaacagcagatgaggcactatatgcgcttccanactcctgaacctgacaaccattatgacttttgcctcatnccttgaatcctaaaagttttcgctgnggttaatgtgaacnctgctttacaagcttgtatttttgtgatttactttttctgtaagccttttggggtttacacttnccagtttctaatggaaattagaantctaattgaatattgtttngncncagcctaaaagttacggtcagcatggcaattcacctattttaggaaaaatactcttttcataatatgaaatgcataaagcagttcaaaaagcagtctgtattccntcntcttcctttttcattccagtccttatttttgtaagtattactttccnccncnggctncctggactcaaaatctcagttgtctttggacagtttttttcttgtccactgacaaaaaaaggaatgatcatacccagaattcaatgtttgatattttaagaatgtatgttctagtgtttttcagagtgagtctaccatctgtataaaaacnccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagat

SEQ ID NO: 711254 - DNA, 300 bp, Homo sapiens
tggtacctaagtttgagcgtctcatggacagtgggcagggagtgggtggatgcccatctgtacccacaagtcacgaccctgctggagctcagacattcctcagcagggtcagggccgggtggagtcgtctcaccctgtcattatgctacccactgaccagcagccaccttgctccgtggcagccacaccacaggagtcgggggagccccaggaacactttgggaggtcagggatgcaggtccagggtgcccttggacccactggtgctcccagctcaggctggccacaactcccagcccc

SEQ ID NO: 711255 - DNA, 123 bp, Homo sapiens
cacgaggcgcctcctcagggttccctgtgtctgtacttttcagccatgggcatatgtgaatagagtatctgtcaagcccgggcttctgtgatggtctatcatgacaccattattaaatgggta

SEQ ID NO: 711256 - DNA, 1722 bp, Homo sapiens
gctagtacaatgacatttttgttagaaaaaaatatatggagagagattagtgtgtacataaacgaaagaaagatgttaacaatagttatccaaggtttttatttttctatatttaccaagtttgctagctcctctgggccattgcctaggcagaggcacatggctgggccccctggctgggcctgtacccctcatgggggtctgcttagggccttagcacttgggtgtggctccgatcctggcccactgactgtcctcttggcccgtttccttacacatcccaccagatccccaggctgaggaggtgggtcagtggcccacccgctgttctcaccccacagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 711257 - DNA, 2841 bp, Homo sapiens
  misc_feature (1828)..(1828): n is a, c, g, or t
  misc_feature (2010)..(2010): n is a, c, g, or t
gctagtacaatgacatttttgttagaaaaaaatatatggagagagattagtgtgtacataaacgaaagaaagatgttaacaatagttatccaaggtttttatttttctatatttaccaagtttgctagctcctctgggccattgcctaggcagaggcacatggctgggccccctggctgggcctgtacccctcatgggggtctgcttagggccttagcacttgggtgtggctccgatcctggcccactgactgtcctcttggcccgtttccttacacatcccaccagatccccaggctgaggaggtgggtcagtggcccacccgctgttctcaccccacagctctgtcctgtccccgtatgagaggcagcttaacctggatgccagcgtgcagcacttggaggatggagatggcaagagaaagaggagcagctccagccctcggtaactcccacatcacggtggccccccagggagtgctggtgtctgggaccttggaaaatgcacaggctttctaagaaccacagctcccatgcaggctcagggaacactagggacctgccttcagctccatggacgtgtgcacctagcacccggcagattgctgctttccccactcctcaggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccaggtaccccctcagcctgccacatcttcgagggccactggcagctgaggaatcacaggactttggaaagggcatggatgaactgggatggattgaggcttaaggaagatgtgggaggagggagtggacccacaagcacggtcagttctccggcggctgcagcagggcctgtgtgggaaggcttagagatggtgagtcaggagaggtaaggaggggtggaaactatgaccatatccttaaaaagataaacaacatgcatgtggatggctttgccaccaactagctgtgatcccaacctgttagatgggaaaaggaggtgccttcttggccaagtgaaagaaaggcttgctgtctgctctaagcccagggaaccaatggggaaagaataagctaaatgtgttaacggattccaaattacttaaagcctttatgggaacacggtagattgtaggtaactagatagggttgccagatcagtttgatttgactttcagtataatttttcagtatatgttccaaaaattgcatgggatatgcttatactaaaaaaaaaaaaaatgttgctaggctggacacggnggctcatacccgtaatcccagcactttgggaggccgaggcgggcagatcacctgaggtcaggagttcgagaccaacctgggcaacatggtgaaaccatctctactaaaaatacaaaaattagccgggtgtggtggtgcacacttataatcccagctactcaggaggctgagacaggagaatngcttgaacctgggaggcagaggtcacagtgagccaagatcacgccactatactccagcctgggtgacagagtgagactccgtttaaaaaaaaaagttgctaaatctggccgtcctaaactagatggcagactgagaaatgtgactcccctccccagtaccttgttttctgtgtccttgtagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 711258 - DNA, 99 bp, Homo sapiens
catttcaagccgctccaggttaaatcccatcactagcgtttgacagagtcaaaggctgaagaataagtccaggataggggccaagagatcttgaggagt

SEQ ID NO: 711259 - DNA, 217 bp, Homo sapiens
gagtatgttcatgaacacccgggtgcacgcatgtgctctctgacgcacacgcgtgctctcagacaccatgctccagcaaccctagtcgggcagcggggtaggtgtagagggactcggagaatgagcagctacctgggctgcgaatcctgcctgtacagccaggcaagttccttcatctcatccaacgacaaattcctgttgcacaaacacgggattt

SEQ ID NO: 711260 - DNA, 1269 bp, Homo sapiens
  misc_feature (295)..(295): n is a, c, g, or t
  misc_feature (467)..(467): n is a, c, g, or t
ccgagcgcacgtgtagcaagtcttgcagtgtagtctcgcgatggcgcacgttgggaacgttgaatgcctgccacggggaaggctatgcattattgagtccgcacagatagaactctatcggcgtgtgcaactctgtgttccagtgacgctgcgccgtagacgcgcatgagtgcgcaatgtgggccatacgagacggcgggagatcacgtatgcggaaagcaattggcccgaaacctccacttcgaggaatactgaattacgcagttaggtgtaggcagaggaatgggaggagacngactggttgcaggaatcaggaggcacgtgagggcttaggggcacacggaccaaatggctccatgtcccggaaccatgtgcactccgcaggtgtgggaataggaagccttatctggtgtggatgggacacatgtatttccgtacacttctcgaccttccgaggctgagctacnctggatggtaggagtcggcgttggaccgcgtcgaagagacctaactagaaatgcgggaagaatggctaagagctagagacgctgtgttgaccgcactgccttctaccgctgtctgggcaatgtagccacaaatgcatattacggctgaagttgggaatcgtgacgtgggatggacggtgagcgactggtagcgggacgcggcttttgggtggcgggtcgtccgattggaggtcatcgaccagcatggcgattcgacttgtgtcagtggatgcttctggcgtggccgagggctctcgaccgtggggtcccgcatactctgggggtgcttggcgatcgctgaagcctcttccccatggggggccatgggtgagtctagtcggtaccagggtgctcgaatccgggagaatccagagggcagataatagttgttgccagttctctcctggggggcggttgcagccgtcctgtgaaggctcgtgcccagtacaggtgactagctggcggatacggtgagcggggtgaacggaaagcccggccggggggcggtacggctgtcgtgttgcggactgggctgcgggggcccagggaggagcggaacggaaagcagatacggacgcgagcctgaaagagaggggcggacaatagacgcggaactctcacggaatggccccagtggaggcacccaaagagggaggcgctcaacaggcgcaagagagatgcaggccaggggacaagacgggagagcatgccaagggcggagaggagccacaaatgtggaggcaccgcacaggggggaaacaag

SEQ ID NO: 711261 - DNA, 949 bp, Homo sapiens
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagagggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 711262 - DNA, 421 bp, Homo sapiens
aaatctgcgatggttcacacagcacattagatccaaagttgaccggtgtgacctaagatcttgtctaggagcttattgaacagatgttctctgtcttttgtatcaagctatccatatgatcacagaccctctcctctaggatctaggtcgtggatctgaggtctgaaagagctattaccattttttgctgcctttgtgcctcaaagacagaacaaagccgatacatagagaaagtcagaaccaatagaaaccagaggaacatggagatcgagccctgaatattgccacaaaactcgtatatcacactcatagctgaatgctcaaatacagtcgcaggagtctttattttcccttactcatttcagcccagattgctcaatttgttttgttacttgcaacgtcatagagaagctttggcgga

SEQ ID NO: 711263 - DNA, 1039 bp, Homo sapiens
gcgagtgacgcggcttgcgtgatgtgagagtgctggattgctaactaattacgatgggaggctatgtcactacgatgtccagcagatgtattgcagtacagaagacgttgtttcaagtggatgtcaagatgtccattctgaagatccatctacatgactcgctgtaatcgcgtcgcgtgtgctggtcaccaattgccacaaagtgcttgtcgtgaccaaaaagagatgcactgcttgacgacccccactggttccttctcaccaattccacaaagtcacaggaaggctgtttattggcggcttatgccattcgttggctctacagggacgagtatagaactatacatcacgaccatatatgtgttacatcactgacagttcgcatcgtcactatcgcaagcttgcgacacgcggtggactcaacataatgatagaggggaatcccagtttgacaggacaccattgtgggtaccatctaaaactccacagggtagtcgagcttcagagtactcgtgtgaccgacggactgccggccgcgcatttgttactagctggtatcccaattcatcatggaactaactcaatgagggacgctgcattgcattggccctcttcatacgatccagcgaagatccgctgatgctcgcagagcgctgaacatgatcgatgctatggaaggatctaggagacgctagtggcgacgaggtcgagggagatgatcccgtactcatgtgcataggcccaggtgtctggatgtcgagacgggccgtcaagtgaaagtaccgctatggtgctaagctaagtgcgagagtaacttgacagctgactggactaacgtaaaccaatcacctgataaggatccaggcgtcatgggacaagcttgaatgacggcgcgaagaccgcacagagccctgagcctttcccctctctcgtttaaagaaaaaaagccattaggagaaacgaacttaggtaataccgcaaccaaagggagaccaagaataatgcatctgtgtctctcgcggcctcttcaagagagaaa

SEQ ID NO: 711264 - DNA, 356 bp, Homo sapiens
ggcctctcattcctgcttgcttactccaccctggctcctccactggccgccatgtgggctggtccccaaatgtctctccacgctgggcccagaatggagaagaggcgggaaaacccagctggccgaatggaggcctggaaaagattccctggacagtactgcctgtcccctgctcaggtgggacatatgagcctgaacaggccgcaggctacctcttggaggtagcctgggaagtgatggggccctgggctgtgactggggacctacagccttgctcagccccgtccctgaggcccccatgccgtggaggtagggaaggggcacgaacccacgctaggtgtctcacacacccgcct

SEQ ID NO: 711265 - DNA, 374 bp, Homo sapiens
tcgaccactgtactcactgtagcttctacctcctcggttcatgtgatcctcctacctcagctcctgtaatagctaggaccacaggcatgtgccaccatgcctggctaatttttaaattatttgtagagatggggtctccctgtggttgctcagtgctggtctctgaactctctaggctcaatgtgatcctttctgcctcagcctccttaaagggattacaaagcaggagccgctgtacctgggcctacttggaaggtcattttttaaaaaattatatactcttccaatcttttggtcttttaattggtagtactccagaccattttgcttctaaaaataattccctggggtaccggagctccgaaattcgtaat

SEQ ID NO: 711266 - DNA, 130 bp, Homo sapiens
tcgaattctctagaccaccagttctaaccttcaaaaacccaacctctttgtcgagatctcctcaacatactactcgtagaccccactgcttcttcactaaattttctcaacatctgttctatttggactc

SEQ ID NO: 711267 - DNA, 159 bp, Homo sapiens
ctctctgggttgtgggaggttattttgatgccatttcccacgaagggaaatgtgtggagccatgaggcgaggatccattctgacgacccagacctgaacggaaatgcatccctttcagtgtattcccgtaatgaccagatttaaattggagacaaagca

SEQ ID NO: 711268 - DNA, 426 bp, Homo sapiens
  misc_feature (91)..(91): n is a, c, g, or t
  misc_feature (93)..(93): n is a, c, g, or t
  misc_feature (102)..(102): n is a, c, g, or t
  misc_feature (373)..(373): n is a, c, g, or t
tggtaggagaaggagccacagggacaagcggtgaatatctggattcccaaccgccctccatgggggcccgcggccctctccctcctctctnangatgcgccnccgccgcttgctccctgggtacggcctgaggatggacggagcgccgtccaatcgtccaggactcaggcctggccactccgagccccccaccccccgccccgcgccggcccgagcaccctgcttccatgcaacttgcagcaaacgcagcggcatatggagagcctagcgacgggtagcaaactttgtcccgttaagcgcaagagcaatcctcgcaaagtttgtgcggcggctcccactccccacatgagatgggcaacctcccgcccgcctngtgctcttgccgcgcccgcgggctgcagctaccaggccggcacccgtcgccta

SEQ ID NO: 711269 - DNA, 421 bp, Homo sapiens
taaccgagaatcggtttatcacgggaaagtcgatgttcaagggtactggtatgatgcgacatggctcttgagcgatgagaagatgctcagcatagtcaggaaggaaacgcaaatcaaaatccacaatgagatacttcttgatgccgtgccagaatgattatcagttaaaaagaccagtagtagcaagcattggcaaggatgtggactaattggaatccaaatacattgctggtggaaatgtaaggtagtacactcactttggaaaacagtatggcagttcgctcaaaacacagttaccatgtatcagttaaatagagttacctaatgacccagtagttctactcctaggtacatacccgagagaactgaaaacatatgtccacacgaaaatgtgtatacaaatgttcatagtagcattatt

SEQ ID NO: 711270 - DNA, 151 bp, Homo sapiens
  misc_feature (71)..(71): n is a, c, g, or t
cgatctctgagtgccccatatggcaatcagcaggatcctcagtatgcagcaataataataaggtatcgctnactctgctgcggccaagtcgtccgcaatagattgctgttcctagtaggtgtctgcgaagtctatagtctcaattgcagct

SEQ ID NO: 711271 - DNA, 317 bp, Homo sapiens
tgggtaaagggatttaaaatattgaaattgaaaccatttgcgaaaaccttccttttcgccacaggagcttgacagcttcatagtacttaaaaattttacttggccgggtgcggtggcgcatgcctgtaatcccagcactgagaaggcgaaggtgggcgtatcgcggtagcccaacagcctgtttgttttctctataaaaccaaatcagtattctataatcacaaattgtgattgcggtcagaaaatatctcacgtgtattgtgctgcagataacacacagcagaaatctatcctttgtataagaggggactatgtgt

SEQ ID NO: 711272 - DNA, 161 bp, Homo sapiens
tctgatcagcagcactattctcaatagccaaaggtggaacaacccaagtgtccatcaagcagaagaataaacaaaatggtgtatatacatataatggaatattactcggccttaaaaggaaggcagtcttgatatatgctatataccatgatgggggtacc

SEQ ID NO: 711273 - DNA, 938 bp, Homo sapiens
gattagtctggtgcggggattgctcgaggtggtttgtgagttcctgtccgttgcggtgctatctctctttctgatcatggccgtggtgccgacaggatgtgcaacgtgtcgatgaaacttgctagtggttagagtaagatctctgtagtcacacgaagaatggaaacagatagtggcatgataagacaggtataagaatagtctcatttgggacagagaccgaaatggactaatccttttgatagtgtattcctcattgcaaaaaggatatctgtggcgggaacaaatggattacgaaatggttgaagtcacataacagatcaaatatctggctcatttaggtaagtgtttatatggggtactagcatagaatacaaagaatggagactagcaaacattataaggcttttgaatccaattagagggatttgcataatgaaactttcaatcgaaggatcacgtgacttgaatgttttgggtatgtgagatttggttcagcaaacggatcttgctgttgtagatatttcttgggagtcagtataaagggaggtggttaaaatgtagactactgttcaactcttatggatcatatacaaagggtatgaaggtgaatgaaccacgaatcataagttatcgacgtggttgataagcattgtaggttatataaattttacatattgactgaataattaagcaaggtctaacgtaaaacaccttaatttttaagcatttcttactttaaaagatttatataatacctaattagtaaggcatggcgtaatatttaatttagaatccgagcacaagaggtactaagaaatacggggtgaaaagtgttgttgtttacaccttaataatgcaggggcttcctatggtggggacccgaaagggcgttgggcaatggggtttagaaggccaaaagatgtaacgggggggaa

SEQ ID NO: 711274 - DNA, 213 bp, Homo sapiens
atcccacggattgcgctgctttgcgcaaacagcgggtgagggcaacagtgcggccgtgactggggtaggagagggcggtccccagtgcagatgggtgcctcgcgttgcacacatggagtctctggtgtctatgcttggaactgacctagctcgtgacaggggacactcggctagcggccccaagagccaatgctgacacggatacccgagctc

SEQ ID NO: 711275 - DNA, 340 bp, Homo sapiens
acagaacatcagtttcaatattttaaacttgtactaggtccagtatacccctactcatgcggtgttgagcagaactatggactgtccttaggctccagccttaaagtattggataaccaaccttgagtaagaatgagaattctttgaaaacctcagaccaaatctagatgtgtagtatagttttttgtagtattattacttctaaaggatataatcttaacaatgcatccaatggcaaaattgctgttgacttgacattacattacattttatttcagctgtataacattgtcaatagattgtataatgaaatgcatgtatccattcttgaggtcgacgc

SEQ ID NO: 711276 - DNA, 750 bp, Homo sapiens
ggggctggagggtgtctccttcactggcggcaagtgccgccgaactgggtcaagtgcgcgggtttcatccgggccgacgatgtcattgcgctgtcggtaccctgtctgccctgagtgccgaaaacggcgcgtcccacgtctggcgtgtacaaccggacaacacccttgaacgcactcccgtgcgcattggtgcctttggcgagaacaccgtaccgatactggaaggattggccgccaccgattgggtggttgccgcaggcgtgcatgtactccatgaaggccaattagtgcgcccggtggatcgctccaaccgtgtggttaatctggcggccaaggagtagtccccatgggtttcaatctttccgagtgggcgttgcgtaatcgccagatcgtactgttcccgatgatcctgctggccgtggttggcaccttgtcctacaccaagctggggcaaagcgaagacccgccctttaccttcaaggccatggtgatcaagaccaactggcccggggccacggcccaggaggtatcgcgccaggtcaccgagcgaatcgagaaaaaactcatggagactggtgagtacgaacgcatcgtgtcgttctcccgcccaggtgaatcccaggtcacctttattgcccgtgattcgatgcgttcggcgcagattcccgagctgtggtatcaggtgcgcaagaaaatcagcgacatccgccacaccttgcgccggatatccagggtccgtgttctacgatg

SEQ ID NO: 711277 - DNA, 449 bp, Homo sapiens
tgagcagaatactggagaaggataagcggagccagcagatgcgtatgcagctggttgaaggcgaagctgcagatgccataccagagcggggagttcaaggcgctgaccaggcgccatgctaggtggagccccggactctgatcaagcagatggccggggtgcctgaagtactgcacgcgccaggcccccgaaatcccctgggaggagcagttgtcccgtgctgctagacaggatgcccctgggaatctgagcctcgatgtggagcaggccccgttgggtcaacactcgtcagtgcccagctctcaggtcagcagcagaggctcctggccttcatcaagtgctgcctgctcactgaccagcttgcccctcgcccagcacctgctggtcgtccaccacgggcagcggcagaagcggaagctgctcacgctggacatgtacaccgccgtgat

SEQ ID NO: 711278 - DNA, 282 bp, Homo sapiens
  misc_feature (198)..(198): n is a, c, g, or t
  misc_feature (206)..(206): n is a, c, g, or t
  misc_feature (236)..(236): n is a, c, g, or t
cgcctcccaaagtgctaggattacagacttgagccacctcatccggcacagtgagtttcttaaatgattcggtcagtatcagcagctgaagcccatgtgacctttagagcagatggggaaagctctctctgaagaaatgcagttagcatctttcacaaagaacccttcctgcctctccacgtgccagagatcttcagnccgagaanggagagttgaagaggggcacagcctgttangggaatacaattgacgtttagtcaaaagagggcggcttccacttgg

SEQ ID NO: 711279 - DNA, 159 bp, Homo sapiens
ccgtcccctttctctgctaggccctggcacttccagaagctcctttctcatatttggccattttttttggttgaggacctgggaccttccccacctacagtttccttggtggggtaatgcagaagggatgaccagcagtgtgggggatggagcacccat

SEQ ID NO: 711280 - DNA, 545 bp, Homo sapiens
gggtcaaatagcaaaaagtgaaaaaagccaaagaagtgtcaaatgtacaaagagggagtgaaaagtgccacagagcagtcaccgtgtgaggaaaggcgccagtaggattctaagctcatggagataggacagggaagccaggttaccctcttaagaagccttgactgtgtaagagactaattacatagcaacaataacgaatgtgattcccccttaatctcaacacctctggggggcggggggaagcagcactgtatttcaaataaaaaacgaaatcaaaactcttacaaaatagtctggtaattttcaagcagttcataatgtatttgagctttgttctcattacaaggaacgtttaaaagttttacctcatcacctggctggccagttagtttctgtagttgcaaaataattccatcaatattctcctgaatccaaataaatgcatcatcaccggctgtttcaaactgcagcctttaagaaaaagataaaaagtgaaaacagaggaaccaagttatgttataccggaaccaagttatgttata

SEQ ID NO: 711281 - DNA, 1238 bp, Homo sapiens
  misc_feature (664)..(664): n is a, c, g, or t
  misc_feature (940)..(940): n is a, c, g, or t
  misc_feature (1238)..(1238): n is a, c, g, or t
ggtggatgacgtcaccattgtcaacatatagaccaagcgtatcaatgcacagagagaggatatagccttcgcctaccagagaaggagctaaaaaaggatagcttgctagtcattcacatgagatgtcacgctcttcaatcttggtcacaccgtgggatgcacggcgattagtaattctaagagtgcccctagttcgtaatgcacacacattagcttcgagtactgactgcatctaacgtcgagtctaagaaaggactttcccatgacatgggcgcatgggagataccgatgaaggaacatctcttcacttgagatcagtctagctccacaaaactaaccatggagctgtctcacgacacacaattaagacaggaggctcctgactgaagggcacaactgtgtgaccaagtcacatgacatcctggggagcaagtgcacgatttcatgttacagcgtagcgacaatcgtgggtgaacagtacgcatgcacagactgcccatggattagtcccttggccagaaaggcgttaccacagtcagtccagagtgtagtgcggttgcttggtgcgatttaggcaattgaatagcaaacttggcaacttcgcacaccaatagacattgcgtccgcgggcatcgtcctaactcgccatcgccttgaggatagntcgtaccacacaggggtacacaacgggaagattgcgcaattagtactccatcggcaccggtaagggttatgttcacgcccaatagggattccgtacaatttgcaattggagagcattcgcgttagcactcgccttaagtcttccccacgaaaacatgtaagtctgtggcgactgctagtgtgtacgaagaaagaacgtgggacgaggtgccccacatcaataatggaagcctttagcgttaccgcggaaacaaggacgattttgtctaggttgccnataccagaaagaggtctcaactagggagaaagaaaacaatagagggagaagaattggacattatattctcgtaaggacacaagcatttgtgcgttccgaaatgtttgaataacttttcctattgtaagagccaacacatttcgcggacaacttaaggtaatatttgtgtggcattgagaaattgcggggctttcggatgattgacatatctccatttgaagattggggcggacaagaacggggggtaacctgcgaaaggattgcaaagcggaacgttggtaatccaaagaaattacan

SEQ ID NO: 711282 - DNA, 964 bp, Homo sapiens
ggatccttccaaaatcacagactctctgatggaaccagagctctcctccaaaggtgctaacttcttgttaggctgacaggctcttccccagatccgtctctttggtgtgtgtgtgctaaccatagattctaatcacacaaagagtaagagtcccatttgctatcctcgtgggtgctaaccccatacgtcattatccatcgtcttgttccgccagaagacccattcatgctgtcgtccatttatgtgatcgatctcgcccatgctcgctttccccagtgcctggagtttacgcgttatacattcatagccgttgactggtgaattttctcaacatattctactcgatataatagtctaccattctatctgagctgaactctgtggccagataccctatataactagagtgttgatataatgagctctaggaaacgttattatctcaagacgaactgtatgaccaagtgtgataagtatcctcatacatcaaagtaactgagtatcgtgatggacaccaggtgtgactccaaacgctcagtgtgatctgtgtgagtgtatacatcttccactagctcattaaatattccacttaggtactccgaggacgtagtgttattatcttattttcacagatgatggaaaacccgagtatacgcaggtcattagacttctcattaccaggttcccaacttcttctggatggccctccaagttactcctagcctcttcgggccattatttgccagctctgtgtgtggcactattttggcacactagccaatgctgccgtccggagcggcgcgtcagttgggcgtggccctcagaccatcagcttcatgttcatgctccggctgagataggccttctcgcctcgaccgcgttggcccaccagtccccgggcctcggtcttccaccccaggctaggtcggcgttaccccgccttcccgggtctcactctcctatt

SEQ ID NO: 711283 - DNA, 743 bp, Homo sapiens
cgccgccctcgcaactaatggggcctgagcgcgcgggggagaagcggtagcgggagcgggagcggagctggctggcgccgtctgggcgccgttgccggtgccatgtgatgctgtggcctgtgtctggccgcggcgctgctgttgctgctgctgctggtgcagctgagccgcgcgtgccgagttctactgccaatggtctgccctagtacttgcgctgctgtgcttcactggtgtcctgccgtggcctcgctcgtcttgcctgctgctgccactggccggccggacgtgtggagaaccattgagcattcatcggcctggcttcgctgcgaatgcttcagagtacgttttactggcgctccgccttccgacggtgcctggtgaccctgtcgcagggctgccatggatgtgcccgttccccttgtagtcgatctgtctaccaatccaaccgagaggcagtccgtggcacactgcatgcggccttcactgcgaggatccgttccgtgtagctgcttgcctgtgcaacgaaatcgcccaaagccgtggaggctagctcattcactggcggccctgtgtggccctcagtccatcgtacgctcgcgggtgctgtccttcgttcagtcacacctgtgcatgcgcttcttagcatctgcccattgacacgtgcatggcccgaccctgtggctgacgctgccattggtccaggtggagtatatctccatttcggtgctggactcctagtccct

SEQ ID NO: 711284 - DNA, 138 bp, Homo sapiens
atatagaaggtggagcgattagtaggttaattccgataacgaacgagaccctggcacctcctcagtgctgtccacctcctgtgtgggtggagcgacttgtctggttaattccgataacgaacgagactctgtgcgtgt

SEQ ID NO: 711285 - DNA, 367 bp, Homo sapiens
  misc_feature (27)..(27): n is a, c, g, or t
  misc_feature (79)..(79): n is a, c, g, or t
  misc_feature (122)..(122): n is a, c, g, or t
  misc_feature (133)..(133): n is a, c, g, or t
  misc_feature (149)..(149): n is a, c, g, or t
  misc_feature (171)..(171): n is a, c, g, or t
  misc_feature (187)..(187): n is a, c, g, or t
  misc_feature (270)..(270): n is a, c, g, or t
  misc_feature (334)..(334): n is a, c, g, or t
tgcaagctgactcccaagcacaccccnggaatgcacttactgataagatattgaggcaaagtgtacccagcagcccccnggggacgtgcctcagtggagggtacccaagcccctgcatttanccctttgtganagtttaagcccctgcncccgggaactgtgtatttttcngtaactatctctgtanccattaattttttttaactttttgcgtgttctgcttctgtaaaaattgcttcagctaggctccccctgccctatttagaccanggtataaaaagaaatctatccccttcttcggggctgagagaattttgagctctagccatctctnggtcactggcaataaaagaactcctgaattagt

SEQ ID NO: 711286 - DNA, 161 bp, Homo sapiens
gcttccttcgttatttggagccaggccgtacagcaccagcgagcgcatgtccaatggacctgcagatggtattgatcttggcaacactctactcttgtgtgggtgtgatcccgcacggacacaagtcgagataatggccaatgatcagggaacccgaacca

SEQ ID NO: 711287 - DNA, 652 bp, Homo sapiens
  misc_feature (200)..(201): n is a, c, g, or t
aggggggttgtcattgggacgtttcttgggcagtgtaaatgtccatgttgcattcagacaatcatcatgttcacaaaaaacaccagtcactcccttagtgttctgcagtgtatacactcgagtaaagacatgcgcacaaggatagtaaatgtgatccatgtcatgtgatcacaccatggtcgtacagatcagagccattnnaagcctctggtttgtcagcaaggaaaattaactctcttatgtgaccatacactgggactatgaatgtgcacattatagtcaaggatgatgcaaactcaatgtccttctcgtgggactatgaatgtgctcttcagattatccatagctcttaatgtgcatatttacatcagcagtatggatttccattgtctaagccatttcaaatgtctcattgattagttctgagtctttcatagcgagtccaatccagatcttatagatcgagctaatatcttgacttctcagcatcatagaaggtggaggtcattccctagagtctctctaacataggtattatgcacaatagtcgtcagaccggctgcgatctctctcaccagtaattgcagcacttcaggatgattagctagtaaattcccagtctgccagaagtttcagatgatcctgtctcggc

SEQ ID NO: 711288 - DNA, 218 bp, Homo sapiens
atctgtcgcttcggacgttcccggcatcgcactgccgtgctcggccgcattccctcgccggaagaactcgattacctgtgccgaaggcggatttgccggctaagaaaaaggggacggaggggattaagtcgtgtgtgccataaacgaattaatcccctccgtcccctttttcagtgccgatcagtacttcggcacgccgattgtccacgtcttcacgt

SEQ ID NO: 711289 - DNA, 835 bp, Homo sapiens
gctccagcgctcttccagctgcgaatagcggccttcgctggctgtgggtccacgcccaggtgtaagggatcttgtggctgtcaggatggcagaggagcaggagttcacccagctctgcaagttgcctgtacaggcctcacacccacactgcgtgaacaacacctaccgcagcgcacagcactcccaggctctgctccgagggctgctggctctccggagacagcggatagtcctcttcgatgttggtgctggtggtggagggcagactagcatcgaggacccatcgctatctgctggtctgcgtcctgtcaattacttcagaggaatgtttgctgggggattgaaggagatggaacaggaagaggtcctgatccacggtgtgtcctacaatgctatgttgcgcaacatcctacatttcatatacacctccgtagtctggtagctcagcctgaatgcaatgtagcaacgacgacacctggtggctgcctgccagcttcagactcccagaaattatccatttctgcttgtgatttcctcatgtcctgggtggacgaagagaacattctcgatgtctaccggctggcagagctgtttgacttgagcccgtctgactagagcagctgtgacacctatatcctcaaaaacttttgtggccttctctcaggacctgacacacgtaccgccagcttccagttggtacgaaaggtctacgtcccgtcctcagcaggcaactcgcctggaggtctcctgcgagaccgaggtatatgagggggcccttctctaccattatagctggagcaggtgcaggctgaccagatctcgtgacgagccccca

SEQ ID NO: 711290 - DNA, 151 bp, Homo sapiens
aaaaaggggaaatttttttttagtttttaattggggggtggaaggggccgggaggttttctataaaccgtacccttttctcctaaggggggagggccccccccctttaaccaaggggattgtgattttgcctaaaaaaaaaaaatttgtta

SEQ ID NO: 711291 - DNA, 540 bp, Homo sapiens
gcataataaactggtctgtatacagacagtatgttacgataaatgggataacgtcaactgggtcaaggttggaacgaaaaaggggtggaagatgagtgcagtggtagagaggtgatcaacaaaagagtgactttggtggcactgtgagagtgctcacccagtggatggacatacagtggatgcgtgtacctggtcattcgggtattataggcgatgaaaaagctgacagattagtctgataaggagctgcccaatcgggagactgagccatgtgacttgattcctggggagaacttgaggccacgcggctgtcttgctggctgtacttactggtgtggaaaatagccatgcaggtaggatcatcgcagagatgggcagatgcgtcttacagacggaatcaggaacagtggtgttctgtgacatgtgtggatcagaacgggttaagtatatgataagtcgagcatcttagagattggagaattatgtgagatttccacattatgtttactgtgttcaatactgtccttgcttgttccgctg

SEQ ID NO: 711292 - DNA, 797 bp, Homo sapiens
gcatcacttcctctcaagctcggcgtctgtttggtggggttacagcgcgggtacaacatgcgtatcgaaaagtgttatttctgttcgggggcccatcatatcgctgggacaccggtatgatgttctggccaggccacacgatggcacatggtgtccagatttttgcaagtccgtaattggtccataaagaacttgtcaagaagagagagcgcaatcgctctgctaaagtatagcgtcggaccagagctattcctggtaaagcagcgtgtgttaagagagctatacagtggagataaatgcatcttggaatttgaagaaacgtagaaatagaacctattaaatatcatgcgagaagcatattggtaataaagagctagttgagtggcggatggaaagagatgttgaatgaatataaacactagaagcgcctaagctataatttataagtgaaacagaattgagaggaaaagaattataaagaagctacaagaaaagttcaggatgtcaacagaaagtcaatggcatagaacatccagtcttatcactgagagccccttcttgacaggacaaaaggggtacacacgagtcggaagagaaacagggtacagccagtccacaagggaggatgtggacctggacacgatgctccttaaaaaaatctctgtaacatgcttttgatgtaacatgggaaaatgccctttggatcataggaaacgctaaattatttcctcttttacctaaggtcacttagatgaaagcgattaaagaccttttccgtttggctccactaaatccga

SEQ ID NO: 711293 - DNA, 663 bp, Homo sapiens
attcattctcttgctgctgatcctccttgcctctatgtttagaagccaatagtcagatagaggatcactgaatactctgcattaggctgtatcctgctggaggttgagtcgcacgttagtgatcgcataacacgatctcagtctcgtgtttctcggaacggtatctattagatcctgcggagcttgacctgacaagaagctatacgcaggggatgaatagaaacgataatcgtagtctccagtgtgttgcatcacaaacgcagaattggtataaccagtatgacttcatagttgtgatctcgagatagaaagaaggaatttctcctttgttgtcttgcgagttaatgtaagaagtactttaaatctctaagcttctgaagtgttagaggtagagatggtctagtaaagatgtagtagtaatgttttatccatttagcatgtgtttatttttttcatatgtactcaaaggtgacttattggttcacctcagtgatattacaggtaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaag

SEQ ID NO: 711294 - DNA, 163 bp, Homo sapiens
caacgatggtcctcagctatcaggaggctgaggcaggagaattacctgaacccgggaggcagaggttgcagtgagctgaggtcacaccactgcactccagcctgggtgacaggtgtctcaagaaaaaaaaaaaagatagtatactagctgaggaccatcgtgg

SEQ ID NO: 711295 - DNA, 129 bp, Homo sapiens
ctacagttggaccaacatctctaaaaagcaactgacatggctcgtcaataggctcgcaggactagaaagacttcctccgtagcaggctgctcctaggtctgcagcgctctgccctcgagaacctaccag

SEQ ID NO: 711296 - DNA, 242 bp, Homo sapiens
ttcaggactcttacccagctactcagtgaggcgacgtggatttcatttgaggtcgggagtacgagaccagcctggcaacgtggtgagaccccacctgtactaaacatgcaaagattggcgggcgtaatggcatgcggctgtagtcccagctaactcaggaggctgagggaggagaatcccttgaaccccggtaggcgacatgttacagtgaaggcccgagatttattgccacttggccttcc

SEQ ID NO: 711297 - DNA, 313 bp, Homo sapiens
acaccggatacacggtgtatcatctcatctgagaatcgctccttgggtgatatctgccctatactctcttgttttgtacagagggaggaccttcattcagtaacttagtaaacccttactaaatatttcaaaaataaaaccaatcatcatcaaacaaacaggagccacttttgtaggtcaggtaaatcacaggataatgtatggggataactctgtttttttaaaataaaaaagccttacatggtcagggattgatggagtggggatgacaaatgcacatttcagactttcatcaccaatgaaaaaataaagc

SEQ ID NO: 711298 - DNA, 220 bp, Homo sapiens
cgctggtcccttaaccggtagcgtccgttctttacacgcgggaacagcggtgtccgctgtgtgggctgcagctcctctgtgtgtacggcccttcactctccgggacgtgtgtcttcagtttaattctcattatattctatactgcacgacgattttcccgcggggacacaacaccagcaataacattcatatctctggagcagctacctcatacacgtaa

SEQ ID NO: 711299 - DNA, 131 bp, Homo sapiens
gtccccactgacaccaagagacaaaggtaggacggacacaagacaggaagactacaaaacggacgcaggaagaaacttacttagggacaagattagcatcatacatacctaagagtgggggaccaggaact

SEQ ID NO: 711300 - DNA, 183 bp, Homo sapiens
  misc_feature (163)..(163): n is a, c, g, or t
actaaggaccaggtctcagattgttatttatatgtagaagacactgtatagcaaatcgcatgaactaaagaatctctgtgctttcatatgcaatatattctccagagtgcctggtgtgctccaagagtcatgttacttctttctgaaactccttttcttagtngtgtattcttgaaaacactc

SEQ ID NO: 711301 - DNA, 1024 bp, Homo sapiens
tgcattggctcacgcctgtaatcccagcactttgggacggccgaggcaggcagatcacaaggtcgggaattcgagaccagtctggccagcacagcgaaacctcatctccactaaaaataaaaattaaaaaaattagccagtgtgcgtgctgtgcgcctgtgatgccagccactcaggaggctgagcgccggagaatcgcatgaacccagcgacatggcaggtcagcagtgacgccgcagatcatgccaccgcacctccagcctgggcgacagctgcaacgacatccactctcagccaaacacacaacaaacggaacacaccacccccacacagctcctgctcgctcacactgcacccacttgccacactcccactctctacaccccacgcaaacctccacactcaccccctcccacctacacacccactcccccacaccactcactaccccctcactctcccccggccctcacatccgcccccccaccgcaccccaccaaccccacacacgggcccccaccacactccacgcccaccaccccacacgccccacagcgtccacacgaccaacgcacgcaaccccacgggaaacccccccgcaacccgctccctccccctcacacacccccactagcagtcgcacaccgccgctcacaccccccacacacagcacgcgctccccccccgtacgcgcacgcacgcgacaccacacctctcagaacacacaaccacccaccgaccccacaccgctccgcccactcccccgcccccccccacacagacgccccccacacacacatacactatcgcaaccctagcgcacaccccacaacagtccaacacccgcggccacgacaattctcgtcccacagcgacaacccggagacgcaccacacgctatcgcgtcccttccccaataacaaacacaacccggccgtacacaccgcgagcctgtcgcgcacacaccaacacgcgagcaacgaccgcaacacaccggccctctcaaccaacgaccccccgccgc

SEQ ID NO: 711302 - DNA, 479 bp, Homo sapiens
atacgcatggaaagacatctatcactctaaaagggagttagactggcagtaggggatagcacaggagatactagctgtgatggcttggagcaaaagtgtaaacgcagcagtgtaaacaagagcaggacatttatgagtagttgagaacagtgaataggagtatgactagacagaagatagtacggatgacaagtttttggggtgcagtccaagttgggctggtgtctggaatgagcctggagcctaacaaaaaggagcgtccatacagaagctcaaatgggctgtaccctgtagcatcccgaggacaggcctgaattctgagaagggcaagtggtaaaagtattgtccagtcctttttaagttggaggctgaacttggcgaggtgtgtttttataagaccattagtccattttacctttcctgaagattgaggatggtaaggggcctgaaggttccactgaataccaagagcctgagaa

SEQ ID NO: 711303 - DNA, 293 bp, Homo sapiens
acgatctggagctactcggagctatctcgggcttactcggagcttactctaggagtatgagactacagacctcagaacttcggaccacccttcttgtgacagtcaaactcagtagggtacagctgggggactcaacagggaggaaagcgcttcggcaaacccagaacctgaaagccccgaacgggtggcgtccagaggaaggaggggtggctccccaccccagggtcggaaggtcaggccagcagcagggtcagaggggtcagtgtgcggtcaggaccaggttaagggtccgg

SEQ ID NO: 711304 - DNA, 218 bp, Homo sapiens
tactctacgccatcgctgatcttcgccacattccccaggcgcagggcggttccattttggttgctgaccagtagaggttcgtagtccttggccttttccagctggtcgttggcctggatctgccagttgcgctcactgtcttccagcgagcccttgggccggcgcacgttggcattggcgatggtgttacgcacatcgtccagggccacgccgtactg

SEQ ID NO: 711305 - DNA, 962 bp, Homo sapiens
  misc_feature (33)..(33): n is a, c, g, or t
  misc_feature (78)..(78): n is a, c, g, or t
  misc_feature (114)..(115): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (175)..(175): n is a, c, g, or t
  misc_feature (177)..(178): n is a, c, g, or t
  misc_feature (200)..(200): n is a, c, g, or t
  misc_feature (334)..(334): n is a, c, g, or t
  misc_feature (443)..(443): n is a, c, g, or t
  misc_feature (588)..(588): n is a, c, g, or t
  misc_feature (641)..(641): n is a, c, g, or t
  misc_feature (658)..(658): n is a, c, g, or t
  misc_feature (678)..(678): n is a, c, g, or t
  misc_feature (716)..(716): n is a, c, g, or t
  misc_feature (728)..(728): n is a, c, g, or t
  misc_feature (741)..(741): n is a, c, g, or t
  misc_feature (755)..(755): n is a, c, g, or t
  misc_feature (785)..(785): n is a, c, g, or t
  misc_feature (798)..(798): n is a, c, g, or t
  misc_feature (854)..(854): n is a, c, g, or t
  misc_feature (858)..(858): n is a, c, g, or t
  misc_feature (861)..(861): n is a, c, g, or t
  misc_feature (867)..(867): n is a, c, g, or t
  misc_feature (876)..(876): n is a, c, g, or t
  misc_feature (881)..(881): n is a, c, g, or t
  misc_feature (885)..(885): n is a, c, g, or t
  misc_feature (959)..(959): n is a, c, g, or t
tctgttcattaagaaacatgctaaatagaagtnaatgttttattcttccaactaaattccagtactacaagggcagtnaaacaatgatacactgggaaaaaaaaaaatgcggcnnttaacatttgttaaaaagactgatagaataaataaaactacnaaananaaaaaaatcttncnnaccctttctggaacccccgggngtcctgggttccgggattgccctcctccttccctttttcccggggggccctgcgggctttttgcttttttttgtcctgggttttctttcttaatttggtttctggtttcggctcggttgtggtgcccatttttnttcccccttccttcttctggggtgtctttcttcggttttttttttaccaccggtggggggcttgttctgggttcccggcttttttccttttcccactttttttttgggngcccatttgtcttggtccggccaattggggcccctggtgttgttccgggtggccggggtccccctccgggtggtcctggcttcggggggttttcccacacccgttgctgctgcctaggggtggttgccactgacgaaagcttganataacctgttttcacagaaggggtattggcattgctgcatgtcataattgggncctcttgccacaactcnacaagggacaaggcggcccncaaatgcggggtacgtgatttatgaaacatagctagcnggctgttctccntatcgtcgcattntttgatcatgcgtnaacttcacaaacgcatcatattgttctgcnagttttgtgttcnatatttcttcatattcttctcgaactttctcttcacgttctttcaacaaacgttcncagntcntccccncctgccgtngggtnaatnagggctgttctttttttattggtgggggtgctgcagatgaagtccctggtggagctggtcccctggggaggaantgc

SEQ ID NO: 711306 - DNA, 534 bp, Homo sapiens
  misc_feature (188)..(188): n is a, c, g, or t
  misc_feature (509)..(509): n is a, c, g, or t
  misc_feature (514)..(514): n is a, c, g, or t
tgtctatgaagtgtaggctatataggtaaatatgcacacagggagagctagagagtgccctgtgctaaggactgcaggataaatatgtctacagggatttccatagcctacggttttctcctgttcctggttcagttagtgctagactgttgcaggggagtccgcgtggtgtttggaaagagcctagnctttagattcaggcagatgtgggttaaaatagtggccttggccgagtgcggtggctcacgcctgtaatcccagcactttgggagtccaaggtgggaggatcacttgagctcaggagttcaagactagcctgggaaacatagtgaaaccgtgtctctacaaaatataataatgatgatgatgataaatttgccaggtgtggtggcgcctgcctgtggtctcagctacttgggaggctgaggtgggagaatcacctgagcctaggaggcggaggtttcagtgagccgagatcatgccactgccctccagcctgggtgacagancaagnctctgtctcaaaggaaaaag

SEQ ID NO: 711307 - DNA, 92 bp, Homo sapiens
tacccagtagactaaccaggacgcagaggttgcagtaatgggattgtgccactgcactccagcctgggagatagagagataccctggtcccc

SEQ ID NO: 711308 - DNA, 416 bp, Homo sapiens
  misc_feature (25)..(25): n is a, c, g, or t
cactctccttgtcggccccggccantgggcctctcaccccgccgactctcccttgggtcccctgagagcagaaccgttggacttcctttgggactaagggcagggaaacgctgctcccttacggggggttaaaaaagtgcaagggcttggggaggattctggggcccaggcaaccccattttttcccagctgaccctgtgagcccaagcaggcctgctgaactcaaaggagaaagcctgagtgagtaacccctcattttggccgaaagtagggcagctgcctccagactttggggagacgggggctaaatttgggggtcaaaaggccctgctttttcccatccaagtgaccaaatgccctactcagcttccatcccccctagcaatatgtattaaagtttgaagggttgccatgga

SEQ ID NO: 711309 - DNA, 1046 bp, Homo sapiens
  misc_feature (256)..(256): n is a, c, g, or t
  misc_feature (343)..(343): n is a, c, g, or t
tatggcgtctctttgcttgcgggcgagcgattggtgcgtgcgtttgggccccgtgcggagagctggagccagagcggctagcccgaaagctgcgggccgtagcttgaggccgcgctggggaagaagcacagatgggcggtgatagctccacgtggcctccctatgcgccttggatttcgtattcgcgtctcgattccgggatcgtgctaccaggctagtctgcagagaaaggtgattccgagaacgtagtagcccntccgatgatgcttccgtacgggatagcgcagttgagaatctagtctcccgagaagggttgtcgaaggccttccaagggatagcaccnatggaagcttattgttgcacctgtgcctggacgcacagggattcaaatggaatacatgccttgcgcgcaatggaagtgcaagtagtacagactggaatcgaccgcggcgaaacagtcgtatctttgtcgatgggagtactagagaacattgggttgcggaactcgttcaatgctgaaaccttggtggaaaaggcacgacgttgcaggaatcagttcgcacatgtggctcctggctacagttcaccaaatcctttcacagtttctcactttgttcgagcgcgcttgggcttggcttgcacctctacggtcatggcagcgtctaaccggttgcgaaattgccaaaatattattcctgtcagacacgtagatagttggcccttcggccgcgcgtgcctaagacttgtctactttgactctgttggaccgtcatagtgagctggggttactggcccgagggctggtatgatcagtgggtgcagcggcgaaatggaagggcgagtctggggaagaaaccgttgtgaaacgttgggtgactttcagttcaattcaaaggttctaggagacaagacctcttgtgagcggctttccaaggcttccaaattgggcaagtcacactggacttcagtcaaaagcccattccagtaactttttgggtgactttccaagcttccaaggttagttctagaagaggaccaaagccccg

SEQ ID NO: 711310 - DNA, 144 bp, Homo sapiens
ctctctgggggctgaggcagaagaatagcttgagcccaggaggtggaggttgcagtgagctgagatagctagaggagaatgatgccttcagagtagcattatactttggtgggagtataatggatccgccctcagaactgtagg

SEQ ID NO: 711311 - DNA, 356 bp, Homo sapiens
attctgtctggtctgacaggcataaggaggtctggccggagaggcgcggaaggaaaacgggctgaaggcgtgtgaggaatgacccatggctgaagagcactgcaggcgggagctggcctgccgaagcggcgagaggcaggagctttggactgcggaggccgcagtgaggcgagagctagctgggcgtggagagtctgctgtgaggcagaggctgggcctgtgcaggccttcgggaggcaggaggccgggccttgtcgaggcctgcagaggccgccaaaagtcaaaagcggggcctgggaaggccgcccagaggcatgagctgggctgggccgaaagaggccactgggaggcaggag

SEQ ID NO: 711312 - DNA, 265 bp, Homo sapiens
  misc_feature (74)..(74): n is a, c, g, or t
  misc_feature (112)..(112): n is a, c, g, or t
  misc_feature (130)..(130): n is a, c, g, or t
  misc_feature (136)..(136): n is a, c, g, or t
  misc_feature (236)..(236): n is a, c, g, or t
gaaacttccactatggcagcgcagaaggaaagtttgggctttaagcccccacacaggaggccacgatcctccanactccagattaataggcccaccaacagctcgcactctnagtgtggaggagctgcangcactnaacaccaacccagcccatgaaatcagccatgggggctacaccctgcaaagccacaggtgcactctcctggtagaggtttcccatgagcctctgcctctgnagcaggttaattcccaccttcccaccacc

SEQ ID NO: 711313 - DNA, 860 bp, Homo sapiens
ggacaccacccctggtccctggctctgccccacccggtacctggggctccgtctgctgcactcggtcctgcgcctccagcagctccttgtcaatctgctccaggcgcgaggcgcggatctgctcaggaccacacgagggcaagtgctggagctgaccccgcccccggctctgaccccgcctctccctgggatgaccccagcctgggctctgaccccgcctcttcctgataaccccgccccaggccctgaccctacctcttcctgggatgacttcgccctgggctctgactctgccttctccctgatccagccctgccagctccctaagccccgctcctaagatatgacccaccatgtctaaaccccgcctttagtccatcccaggctctgactcctcccacttcccatttgggctccacccagaacctagacctcgtccttctaggccccacccacctgctgatctggccctgcccacaggcatgccaccttccactgtcgcaccccaccgcccttgtgctcaggctctgagcctcctgactccaccacaagactccagttctggccccgctcctgaaccagaagccgcgccccccaaccaggaggcataaagactccctcccgatgacccagagagccccgaccataatatctggactctgatttgccactggcgcaaggacccgcctacgcgagcgaacccgccaacgccgaacctgatgccgctgaccaactcgtcagaagcggcgagcgccctccatcagacagggatggtgggctcgaatcaagtgtgcgatcaggcaactgactacaaaggggcaaggaggggggggcaagaggaggagcgggaggacggcccc

SEQ ID NO: 711314 - DNA, 883 bp, Homo sapiens
tcctcctctctggccttgccccaggcctgcagcggtggttgtcacaccctgacttcagggaaaggtgaaacagggcttgtccctccaactgcaggaaaaccccttaataaaatcttctgatgagttctaaaaaaaaaacaaacgcacaacaaacaaccaaacaacaaacaacagaaacaactcacacacgaaaacaacaacaacaccaacaaacaacatgtggaggcgacgccacacagacaccagcaaagagatataacaacccaacatttgggggagcggccccaccacacggaatgatgaaaacagcggcgacaaaagagggtccccagaagaaaaacccggtgagaaagacacacgtgggctggattaacccacaaaaaaaaaaagccggggaggggacaacaacagacgatgtagacaacacacaacccaacgagaaattagcgaacaataagaagaccataaaacaaacggggagctcaccagcgcacgaacaaaaaaaaacaaaccccgtcgtgtcgatctgaaaaaacaaagacacgaaaatgacaaaagaaaagaacgacacagaaacgaacagaaaccaaaacagacaagaaaaaaacaggacagaaaaaggcgacgagcaagggaaacagcagaggggaaagggaggaagaagaaggaagagagaagaaacaaacaaaccagacgcaagagggcgaggagagacagacagagaagaaagagagaacagaagaaagggagaaggaagcacagaacagacgcgacacaacgagagaaaggcgaacaaaaacgagaaggacaaagagacggaaaaagagaagaaaagagcgagcaagaagagagagagaaagaagagaccgaagagacgaagaaa

SEQ ID NO: 711315 - DNA, 475 bp, Homo sapiens
catgacactagggtgataaagacaaacatctgaatctgaacaaagatgaccatagatcgcctgataggggttcatccctggattatgtctaccacgcatagccaaaacacatctaaggtcgtacacagtgtacagtatactttttattttattttagagatggagtctcgctctgtagtccaggctggagtgcagtggcatgatgttggatcaatgcaatctccaactcccaggttcaagcaattctccggcctcagactcccgtgtagctgggattacaggtgcctgccaccatgcccagctaattttgtatttttagtagagatggatttcaccatgttggcccggctggtgttgaactcctgacctcaggtgatccacccacctcagcttctcaaagtgctgggattacaagcgtgagccacagcacccggcccagcatagttctttactttattccctcttctattccctt

SEQ ID NO: 711316 - DNA, 251 bp, Homo sapiens
attagaggatcctgtctagctcgccagtgtggattacaggtgtgagcacttgctggctttttttggttttaagaagcaaagtagaattattcccaggctgttttggaaatcacctaaaaacaggtgatataaactctatttggaattatgaggcatatgtaatccgttgtatgggaaaaagggaaagagaaagaaatagtaaatggattagcagaagagaggtgggtcaaacccaagtggttcagggagac

SEQ ID NO: 711317 - DNA, 583 bp, Homo sapiens
aagggaatctagaagatccgacaactgacatagatcgcaggatatgtgtatgtatatacagatgtctacaccatttaaatataaaaggacttgagtcttctgtggattgtggtattgttggggattcctagctactactcccccatgcatactaggggattactaagctataaaattactgaagtattttattgaatactactttagaacatgttctacatccatgttacctgatactgtactgggcattttcattcagtttgctttgccatttcataagctaactttcccatatgaagcacatgaccagcaaacatggctgtcttcctcattagaagtaataatctcaatataacaataaagtgtgattactgaggatagtataaaccagcacttatttgtacaagttctgcagtggagactaatagtcaggggttactggccgtggtaattcaaccttccatcaagcacacaaagcagaagggtttacctacccaggtgatttaaaagtgcaacaaaatttgggaacaagtggataaagtaattcggacagtctacttctgaaacagctaccttacaaaag

SEQ ID NO: 711318 - DNA, 150 bp, Homo sapiens
aaaaaaaaaaaaaggagccagctaatacaggacaaaataattatctctctctctctcttttttttttttttttttttttgagaaggactctgtctgtgtcacccaggctggagtgcagtggtgtgatttcggctcagtgaacctgcaacc

SEQ ID NO: 711319 - DNA, 475 bp, Homo sapiens
tggagagaacacacacaaacccgatataaaatacacccccctctcgtgtggtgtggtgcgcccactcacgcgtgtgcagagaggtaggtagagtcataatatgtgtgagtggggggaggccccccctccccggcggcaagacatctatctctctcctctccgggcgcaggaaaagagtggaggccgcccacactgagacgagagagacgagagacgacgcgcacgcacgcgcaggaggggggggggaaagaaaagaagaacacaactcacacccaacccaccgacacgcacgagacgcccgcgacccgcgcggccgggagcggcgggcgcggcgcaccagcgggcgcgccccgcggggaggagggggaggccggcacgcgagaagagacgagagagagagacgaccgcgacgcaacacagcccaccaccacaacccccgcgcgagcagaacgaacacgaggaggagggaaaacac

SEQ ID NO: 711320 - DNA, 215 bp, Homo sapiens
  misc_feature (60)..(60): n is a, c, g, or t
  misc_feature (64)..(64): n is a, c, g, or t
  misc_feature (93)..(93): n is a, c, g, or t
cgactttagaggaacccctccttgtaatccaagcagtcgaagacgtgtcacattctggangtcnaaaaagacctggccggtgaagtcgccgtngaccaggaagccaagcgccttgtgcgcgtgcgtgaaaaccttgcacgcctgggcctgagcgccgagctgatcgccgccgacggccgcgacaccgccacgtgcgactgcttggattacaagga

SEQ ID NO: 711321 - DNA, 415 bp, Homo sapiens
tcttacttgcccacgacctggccttcttactgtgaacagccaaacgaaaattctgctacctgaaaagttgtatagtctgttccgatttcaagttatgtaggggggcttacccctatggctggggagccttttggggaattaaataaactatctaactacggccggttttcctggaagctgcccaccaaaggtcaatttcttcctgcacactgggtggtggacctttggttttgaaaaaaaggctaattttgggcctggcctttggccaaatggaaccccaaaaacccttttgttggaaaccaaaaaggagtggtttattaaactttttttttttgagaacccccccctttgcagaactttttgtcccccaacccttgggcttgttttttccccccccccgggggggttttttttt

SEQ ID NO: 711322 - DNA, 173 bp, Homo sapiens
cgcgtgtagcaaaacgtgcatgctaatcgtgttcagtaaggacgagttccccgaggtgtacgtgaccaacagttatcgagaactatgtggccgacattgagatggacggcatgcaggtagagctggcgttgtgagacacggcggaacaagaagacaacgaccgcctgcggccg

SEQ ID NO: 711323 - DNA, 187 bp, Homo sapiens
ctcgaatccagaggattccttcggatcttgagaagcacagtagtgttctaagtgctgagtgagttataactgtaacaaaacgatgcctgccacttgagaaacttacagggttatgagttaaaagtgcacacattccataaggtaacctgtgcataatggagaaatgctagtgaggaaaataaattgg

SEQ ID NO: 711324 - DNA, 617 bp, Homo sapiens
aagtgattcactttaagcccctgcccatttagagtttctcccctcaaagaccgtaatgacaggtgtccccatcagttaggacaaaagagttattcaatttcccataaattcataaagtggcaacattctccaatgtattagcaaatccaatgcgctcaaaggacatgaagttatataaaaaggttatacgaagatctcgtactagagctcatagagatttacgcatgcacaattaaggaagtcgtatcatgtgttatcacatgtgagtcatcgttatgaacgtctcatagcagtaactaagaatgttatcatgcgcaagtcagcatcttgcaggtctgggcccacatatccttcgagtgacagacgcatttgccccaaagacttgcatcaatccagatcaaatgacgtagtttcagtacctccaggactgatcagtcacatacatgggcttcacacttaggtactctaattctatgtagacaggtcatagtacatgtctatatttccatgacaaaataattatgatactgtaattagacatctgtatgtgcagataatagcatggcctatgaagcactatatcattaggtcgagagttatagttcagcttactaaac

SEQ ID NO: 711325 - DNA, 734 bp, Homo sapiens
tgtttaatgatacattagaatagtttctcattggcaatgatctcttatcctagtacctaatcgctttgaaacaagaaaggtattgcttggtggacagatacaaaatgtgaaattcagaaatccccctggaggagacaacctggaagaacgatttaaaggtacaacaaagcctgtgaactggcttaaatccgagtttacatgctggattctgagccagataataatggattcataaatgacggattttattgttcggatgcgtactgcagcattacctacttttcgcaaggttgtatcgtcttgatagaaaggaacaagtgatttacattcaatcattaccagctggccgatactctttgaatgtcaccatacagtatccttttctggctgggtatacagattcatagagcttgacaaggagtcgagtccaaccttatatctgtatgtggcatgttaccttgtgctttagtttcggtctctgcacttctttacaccaagtactgtgtggttatctgttgagaatgtcattttcaacatttacgtcttctagaaaatgttttgaattcggtatataccttggtactggggtatgacgcatatgtggggtacaatttacttacaaataataggtgcttgttaatcaacaagctaggtattttacaggggagatcgtaattggggcttacatgtaacggccaatgagagtacctaacattggtgttgagtggtactgg

SEQ ID NO: 711326 - DNA, 447 bp, Homo sapiens
taacagagtcggtgtcagagcataataactagccactcagataagaatttatagtttaactatctcttaggtactacatcagctagcaagacaaaatctatgtagtaaataatacttaaacactgaataaaaaaactttcccctacaattggaatgatcttagtattgctttgagttttgttatctagcatctatataagttgcacagggctctattgaggtcctatgtctctgatttcttttttaccccagaataagccctggagctgtctctggaaagtagctcgacgagagttaccttaactatcactgaagaaaggaaattttctgacacactgatggcatgtgacttgtctcctaggtcagcgaggcatcactttgtttgcatcaagtgtacggttagtaacggccttagtccttgtgagatgccaaccagttgctagtctg

SEQ ID NO: 711327 - DNA, 230 bp, Homo sapiens
gatgatgtgaactcccagagagctctgttagtctggggcatcccagtgaactggtgatgaggctgaaatcgaagagaccctccaggctgcgatgcccaggtctctacgaatgcttgggagatgtctcgagggagaaatccgaacagccttattagactcactgcgctgtagatacgcgcgatcccaggagatgccggcaaggagggtctgaagtgtattagcccactctg

SEQ ID NO: 711328 - DNA, 174 bp, Homo sapiens
gatctctagaggaccccgtcagccatggtgatgcttgtaatgacttacacagctaggtttggcgtttcacacacagtaaatccttcacccacagctttatgctagaccggccttccttaatcacgtttccttccctcttgtgtgtgtgtgtgtgtgtgtgtgtctgtgtgtgtg

SEQ ID NO: 711329 - DNA, 151 bp, Homo sapiens
cgggcttttctgctgcccaggcttggagttcacagttgggcggggattctcaatttacacggccaaccatctgacattcctgggtttaaagcatatttcttccttgccaccagtcgtgggggaccaccgggcaacagtgccaccataaggc

SEQ ID NO: 711330 - DNA, 437 bp, Homo sapiens
gggttgacacggcttccagttcttcatagacagtcaagacagctggatagattgcaagcatgttgtgtttggcaaacgttctaggagtggcattgcaggtggtgcggaatcgtggagagcaccaagacagacaggcgggattaaccccttaaggatgttatccttggcgactgcggccagatcgaggtagagaagccctttggcatcggcaaggagtaaggcaccgggacatctttctttgagttgaccgtctgtgcaggccctgtagtacggcacagggctctgaactggactggccccggtgctggcatatggtggagcggacccactccccttacattacacaggcccattggactcacttttgttacaaactcctaccaacactgaccaataaaaaaaaatgtgggttatatatatagtaaaaaataaaataa

SEQ ID NO: 711331 - DNA, 152 bp, Homo sapiens
gagaggcaagtagaccgaacagacggtactagacagtaagggacaccgctattgtagaaatagtggaggttatagtagagcgcaaactacgagcttgtgtagttggtgtcaagtagatttagtaacttaatttgcaaagacctctaattcct

SEQ ID NO: 711332 - DNA, 170 bp, Homo sapiens
attaaaaggcatttggcaggtctaaaaataatcaatacagaacatgctgggcgcagtggctcacgcctgtgatcccagcactttgggaggccgaggcaggcagatcaccagaggtcaggagctcaagatcagcctggccaaaatggcaaaaccccgtctctactaaaaat

SEQ ID NO: 711333 - DNA, 945 bp, Homo sapiens
  misc_feature (945)..(945): n is a, c, g, or t
ggagagagagagagagaatagtctcgggtggcgggaagaggaggcgcgagaatggagtgtggaggccgtctgtggtgtgtgcgcgggcgagggatggacggcccaggactctgacccatggcaccatgccgttcagcaagggccaccccgtgcagcgccggccactacgaacgtgccagtggggttgacacaacatatacggccatgatacagccgtgaattgaaagttgtcagggaatgaatgacagccgatggagcacgagctagcaaggtcttatgcaacggagaacgcgacactgtgcaccgaacattcagtcaatatggcggggccacatccaaggaaaccgagccaacagacgcaccaaggcgacattctgttgactctgagacaccggtgacaccatgaattggtgcacacagaatacttcaacgagcactgccactggtttggcgacaaccatcaacactggacgtttcagcacttcgtactcagacggggacacttacggaccgaggatatgcgtcggcacgacgaaaacatacccacactccaaacaccaattgatagacggcgatccacaacccaacacagacccgacatccacacatacgtaaacccgccgaagtacgcgcccgcggaccaaattaaaagacagaagacatacgaaggtatacattaggtgaaattagaataggccaacgaaacactgcatgagtaggagacactagcaatgtgggggcaggcaacaccacggccaagagggggccatgatagaacagcagcaacgaacgccccccaatgtgcgagaaagagatgtcctgtagacctaacatacagagaagaggcgcgtcacagagtgctgggcgtgatgagcacgccccgacattctggagctagctagatagagagtctgggcattagcgcaggagacttcacacgcgagn

SEQ ID NO: 711334 - DNA, 1430 bp, Homo sapiens
aatttgagaccagcgaaagtactatgtgactatcattgatggccccatggacacagagacttgatcaaacacatgattacagggaactatctcaggctgactgatgctgtcctgatatgtatgcctgctgggtgttcggttgaagtttgacagcatggatagtcgtccaacgcaatgcggcatgacccgagaatgccatgaccgcatctctggccttacgaacacgtgtggttgatgacatgcatgcgtacattgatcgagcagtgaatcgcagacaatggatatctcaccgtgaggcctacctcgtaacagaccaacacacgagattatgtgacggaacactaggctgaacgtgacatgtcacgcgagcgtaaaccagtttagagcaaaaaatggtgtctaccaaccgcgccgacactacgtaggcagtattcgtggccacaattgtctggggtgtgggcacacttgagtgatcgcaccaagtgtctcgtgagcccgaaggtggcgtagaccattgtcgctctgcgatttgcaacagagagtactagggagaaggctccaagcccccgataaagcggacttgggctcacattgacgcagggctcggaaaccccaaacgtcattgccatttgaagcgcctacagtgtgtcactgtgcattcccataagccatcacaaaactttctgctccaccaagggcgttagaatcacatgtcgcacatttgtccgtcgcatgtgtcgcattcgttccgcaagtgcaattggtttcataagcaacacgcagttagggcatagagatcaagcttagggataatccattcggcttagccgcactaagggttctagaggcagcctgtaggacgtttgtggaacgcacaccatttgggtctctgttttcccattacaatacatcgccaccagtagcaagtctggtgataggggttccaaaccatcgtgttcaggttctatccctatagttccagattcgtgtttctgaaccaaccggtcgaacaggtcacatatactttcatatagcacacgaaagattagacaatgcacattggaaaaggtctattcttatcacatgagaaatcatcctttacccttgggccggcgaaccactaaacggttgggagaacggttacgatattgttctcaaagaaacagtgctgtgcatggactaacgtggaataggttctacatcattggttcgtaccactccgctattatatctaggattatgcttacaccacaatcatttagtaccctaacctcaactgtgtattccacccgttggtggttattcaccatgcgtcacgcgtcggagttaatcaccggatagcaccacccgacgcagcaaattatactacggtagtaccccgtatatgtgtaattataaacacaggcatcaataagataaacacatatgaa

SEQ ID NO: 711335 - DNA, 254 bp, Homo sapiens; identical to SEQ ID NO: 636686

SEQ ID NO: 711336 - DNA, 1019 bp, Homo sapiens
  misc_feature (25)..(25): n is a, c, g, or t
  misc_feature (118)..(118): n is a, c, g, or t
  misc_feature (316)..(316): n is a, c, g, or t
  misc_feature (324)..(324): n is a, c, g, or t
  misc_feature (340)..(340): n is a, c, g, or t
  misc_feature (361)..(361): n is a, c, g, or t
  misc_feature (369)..(369): n is a, c, g, or t
  misc_feature (378)..(378): n is a, c, g, or t
  misc_feature (411)..(412): n is a, c, g, or t
  misc_feature (464)..(464): n is a, c, g, or t
  misc_feature (721)..(721): n is a, c, g, or t
  misc_feature (819)..(819): n is a, c, g, or t
  misc_feature (845)..(845): n is a, c, g, or t
  misc_feature (959)..(959): n is a, c, g, or t
cctagaattgtaatgtgtgggatanaaattagtttgtataattctcttaaaaatcaaagatgatctctatcacttagccacctgtttgatgtgcagtggaaactggttaagccaaaanttcatacttcctttacaaatataaagatagctgtttaggatattttgttacatttttgtaaatttttgaaatgctagtaatgtgttttcaccagcaagtatttgttgcaaacttaatgtcattttccttaagatggtcacagctatgtaacccgtattattctggacggacttattaaaatacaaacagacaaaaaanaaaacaanacttgagttctatttnccttgcacattttttgttgtnacagtganaaaaatggnccaagaaaatgtttgccatttttgcattgtttnntttttaactggaacatttagaaagaaggaaatgaatgtgcattttattaatnccttaggggcaaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcccccctttctcatgtttttataaataggtaataaaaaatnttttgcctgccaattgaatgatttcgtagctgaagtagaaacatttaggtttctgtagcattaaattgtgaagacaactggagtggtacttactgaanaaactctctgtatgtcctagaataanaagcaatgatgtgctgcttttgatttttcttgcattttaaattttcagccaacctacagccatgatttttagcacagtgatatccccatgacttcacagacatggtttagaatntgtacccttacccccatatgaagaataaaattgattaaaggtttttttggtgagccttta

SEQ ID NO: 711337 - DNA, 128 bp, Homo sapiens
gcagcagcagcagcagcagagacggcgcaaccacgttgatggttccagcaagcctgcggtgctggcggccccgtctggcctggagcgctacggcctaggcgctgcggccgccgccgccaccgccgccg

SEQ ID NO: 711338 - DNA, 1061 bp, Homo sapiens
  misc_feature (25)..(25): n is a, c, g, or t
  misc_feature (118)..(118): n is a, c, g, or t
  misc_feature (316)..(316): n is a, c, g, or t
  misc_feature (324)..(324): n is a, c, g, or t
  misc_feature (340)..(340): n is a, c, g, or t
  misc_feature (361)..(361): n is a, c, g, or t
  misc_feature (369)..(369): n is a, c, g, or t
  misc_feature (378)..(378): n is a, c, g, or t
  misc_feature (411)..(412): n is a, c, g, or t
  misc_feature (464)..(464): n is a, c, g, or t
  misc_feature (763)..(763): n is a, c, g, or t
  misc_feature (861)..(861): n is a, c, g, or t
  misc_feature (887)..(887): n is a, c, g, or t
  misc_feature (1001)..(1001): n is a, c, g, or t
cctagaattgtaatgtgtgggatanaaattagtttgtataattctcttaaaaatcaaagatgatctctatcacttagccacctgtttgatgtgcagtggaaactggttaagccaaaanttcatacttcctttacaaatataaagatagctgtttaggatattttgttacatttttgtaaatttttgaaatgctagtaatgtgttttcaccagcaagtatttgttgcaaacttaatgtcattttccttaagatggtcacagctatgtaacccgtattattctggacggacttattaaaatacaaacagacaaaaaanaaaacaanacttgagttctatttnccttgcacattttttgttgtnacagtganaaaaatggnccaagaaaatgtttgccatttttgcattgtttnntttttaactggaacatttagaaagaaggaaatgaatgtgcattttattaatnccttaggggcacaaggaggacaataatagctgatcccccgaaatttgaaaaacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcccccctttctcatgtttttataaataggtaataaaaaatnttttgcctgccaattgaatgatttcgtagctgaagtagaaacatttaggtttctgtagcattaaattgtgaagacaactggagtggtacttactgaanaaactctctgtatgtcctagaataanaagcaatgatgtgctgcttttgatttttcttgcattttaaattttcagccaacctacagccatgatttttagcacagtgatatccccatgacttcacagacatggtttagaatntgtacccttacccccatatgaagaataaaattgattaaaggtttttttggtgagccttta

SEQ ID NO: 711339 - DNA, 132 bp, Homo sapiens
actcttacttatacttcatatcccggctgaagtattaagcgtgaggaagtataaagcgtcgagaagtataaagcgttgagacgtctaacagcgttgagaagtataaagcgttgagaagtataaagcgttgag

SEQ ID NO: 711340 - DNA, 699 bp, Homo sapiens
  misc_feature (505)..(505): n is a, c, g, or t
  misc_feature (524)..(524): n is a, c, g, or t
  misc_feature (582)..(582): n is a, c, g, or t
  misc_feature (699)..(699): n is a, c, g, or t
gagagagagaagacagtaggtgttgtggtaagtcagggactccaaacggagggactggctgaagccatgacataagaacgtggattgtgatgatttcatggacatttattagttcccccaaattaatacttttgtaatttcttatgcctgtctttactacagtctctaaacataagttgtgaatatttcatggacacttatcacttccccagtcaatacccttgtgatttcctatgcctgtctttactttaatctcttaatcctgtcagctgagggggatgtatgttgcctcatgaccctgtaataattgcattaactgcacaaattgtacagcatgtgtgtttgcgcaatatgaaatctgagcaccttgaaaaaagaacagggtaacagcaattgttcagggaataagagagataaccttaaactctgaccactggtgagtcgggcggaacagagccatatttctcttctttcgcaaatgggagaaatatcgctgaattctttntctcagcatggaacatccnctgagaaagagaatgcacacctgggggtgggtctctgaactggcccccctcccccggnggcgtggtcgtctcttatggtcgaggctgcagagatgaaataaacttcagtctcccatagcgctcccagctttataggaagaagtttccgcttacatttggtcagccggttgtcttn

SEQ ID NO: 711341 - DNA, 173 bp, Homo sapiens
cggcacgagaaaatacaaaaagtagccaggatggtggcacttgcctgcagtcccagctactcaggaggctaaagtggggggaccatttgagcccagcaggaggccgaggctgcagtggtgagccatgatcatgccactgcaatctagcatggacaacagtcagacctgtctca

SEQ ID NO: 711342 - DNA, 241 bp, Homo sapiens
ttttttttccccccccgttccccggggggcccccccccccttttttttcccccctttaaagcccccggggccgtccccccccccgggtttttccttgggcccgggggggggttccctttttcccccgggacccctttttcccctttggccttttttggggcccctttttccccgttttttcccaaaaaccgggggggggcgggccggggttttccggggttttttcccccccccggcccca

SEQ ID NO: 711343 - DNA, 349 bp, Homo sapiens
gcgtcgacacagaatcagaaactgtggcacagcagtctgtggtgttctttgaaatagggtttcacagccaagcgcagtggctcatgcctgtaatcccagcactttgggaggccaaggcaggcagatcatgaggtcagaagttcaagaccagcctgaccaatgtggtgaaactccgtctctactaaaaatacaaaaattagctgggcgtggtggtgcgtgtctgtagtcccagctactcgggagcctgaggcaagagaatctcttgaacctgggaggcggaggttgcagtgagccgagatcgtgccactgcaactcctgcctgggcaacagagtctcgctctggtcgacg

SEQ ID NO: 711344 - DNA, 397 bp, Homo sapiens
aaaaaaaatgtggcccctttccattttcaaaagagatggaattaatgatggatggcccctggagggaatctccccagccgacttccactggggtgacagactttgctgcccacaggggaacgatgtttttttcttttttcatgatcagacataaacttagctttttaatggaagaaaaatgaggggaacttcaattatgatttattaaagccaatttttattacccccccctttatgccaagggacctttttaggggtaaaagtaaaaactttcccaccccttttttttttttgttggcccaacattgaggccttaaaccctgaggctcctgggcctgatggaattcttgtaacaaacccttgtgtatcaaataaaaaaccccctctgtttttttta

SEQ ID NO: 711345 - DNA, 474 bp, Homo sapiens
acacaaggcaggagccaggtgagagctgatgaggagggcacacagaaggacccaggcaagctgggcggatcaaaatgaccatatgtattagttccctagacctgctctaacaaaaataccacaagtaggtgacttaaaacagaaacggattgtgtcacaattctggcggctagaagtctgaagccaaggtgtcagaagggctgtgctctcttggaaggctcttgggatgggggtggggagggcaggattcttccgcgcttcctcctagctcctggtatttgctggtaatctttggtgttgcttggcttatggcggcacaactccaatctctgcctctattttcacgtgaccttataaggacaccagtcattggattaaggcctgtcctaatccagtatgacctcatttgaactcgactatgtctgcaaagaccctgtttccaaataaagtcacattcacaggtaaaaaaaaaaa

SEQ ID NO: 711346 - DNA, 765 bp, Homo sapiens
  misc_feature (4)..(4): n is a, c, g, or t
  misc_feature (8)..(8): n is a, c, g, or t
  misc_feature (19)..(19): n is a, c, g, or t
  misc_feature (584)..(584): n is a, c, g, or t
  misc_feature (587)..(587): n is a, c, g, or t
  misc_feature (695)..(695): n is a, c, g, or t
  misc_feature (711)..(711): n is a, c, g, or t
  misc_feature (720)..(721): n is a, c, g, or t
gcanctgntgcctgagtcnctctgaggatccccggtgcgggggattgttgctgctggaggtttgtggaaatttgaacttcagagagatgatttagggtatctggcggatgaaatttctaagcaataaaacattcaagaggtgacttgggtgctgttaaaggcattcaattttaaaaaggaaatagaggctgggtgcggtggctcatgcctgtaatcccagcactctgggaggccgaggtgggtggatcacaaggtcaggagatcgagaccatcctggttaacacggtgaaaccctgtctctactaaaaatacaaaaacaaaattagctgggcgcagtggtgggcacctgtagtcccagctactcagcaggctgaggcaggagaatggcgtaaacgcgggaggtggagcttgcagtgagcccagactgcgccactgcactccaacctgggtgacagagtgagactctgtcttaaaagaaaagggaaatagagcataaaaatatggaaaaattgcagcctgacatgtgatagagaagaaaatcctattttctgaggagaattcaaactgctgcaaaatctgcacangtnatgaagaccgaatgttatcccaagacatggggaaaatgtcttccagcatgtcagagacctttgtggctgcccttcagtcagcaacaatcccccaccggtaccgactcnatcgaatatggcatantgttcctgnngaaatggtatccctccattccacacatcgacccgaactaatgga

SEQ ID NO: 711347 - DNA, 175 bp, Homo sapiens
agggaggccaagaaggttctagtgggtggaggaggacatgaggtgttggttataaggagcagcgagagtcgggtgaggtcagagcccccacccccaccccaggaatcctccttcggagggagtaggcccactgtggacaaggctgccactcctgaacttcggcatcgactgcgct

SEQ ID NO: 711348 - DNA, 292 bp, Homo sapiens
tctgaggctgggaagtggaggttgcagtgagcggagatctcgccactgcactcaagcctgggcgacagagtgagactctatcaaaaaaaaaaaaagggccccccgggggccgggaaaaatttggtaaaaagccccccccggattaaaacggaagggcccctgttggaaaaaaaattttttgggccccctaaccggggaaaaaccgggggggggaaaccgggggctattttcaaggttgggggggcggccaggttttagggcggccatttttccgggcccaaaaaaaaccaaa

SEQ ID NO: 711349 - DNA, 633 bp, Homo sapiens
tgaattttttctacaaaactagtgctccccacactattattctcaccacaacatcactatagcggagtgtcttgtacaacaacaccacctctcctcctctagtagctattcttccgcagaagtactctacagcagagcacaactactccccccccctgctgtaggtgtgtgtacaacacgcagcgccacccctcctactacttttgtataacaatccaaaatagttgttccctttcattgaatgccctgcctttttttggttgtccgacctacccggcgactgtttattataggagattttcctcctctctacgcgctcggtgatgctgctgagcgatctcgtctcgtcgcccgcgcgcgtgcatatatctccgcgcgcccgcgcggttatctctactatttgtgatcgatctcgccataagtgatctgcctcgccctccctttctctcttcgagatagcgcccacacccagatatataaggcgccctcttgtctctctccatgcccgccctctctctccccgctcatatatcgagaataactctgtctctctctactcttatatagatatatatatatctccccacctcgcccccccatgaactccgcgggctataacaaataacaaaaaac

SEQ ID NO: 711350 - DNA, 745 bp, Homo sapiens
gaccgcacgttgacacacacagtgcgcgagaccatggcgacctgatgtcgaacagatgctcacggtctgttcgtgtgtccgaaaatgtcgcggtgacattcactctgggagctttcctagccggatgggaatctcggccccttcgagatggttgagaaaaaatgacacctcgttagaatggaataccgtagtggccgtggttgacctcgcgatctagcgctactgtcattgcagtctcaccagttatcgtacaatagcatatgtcgccacgtagctatgatgagcgcaagtattgtcctcgtgattctttaagggtgtacacgaactgactggacaatatggccgaagactcagaaagaccatggctcctatgaatagacgttgatgggggtatctgtcggtgcgatcctactgtctcataaggccttactacttagtgtgatcaagacataaaatggtcgctttcagtgacaaagctaacgaatttcacgatgtgaacgtgtgaagttgtcgcagtacatcagttggattcccactttagccatctgtgccgtggcataaatacaccgaagaaagaatggtggtttgggccacatgaacatcgcactcttgtcagacttgaactaagcagatttcccgagactacggtgtgctgttaagaaggttctggtctcgcactaagaggtctcttcaataatggacccaatggagtccatcaagcatttgagcgtcaacgatctcccgg

SEQ ID NO: 711351 - DNA, 799 bp, Homo sapiens
  misc_feature (124)..(124): n is a, c, g, or t
  misc_feature (126)..(126): n is a, c, g, or t
  misc_feature (137)..(137): n is a, c, g, or t
  misc_feature (169)..(169): n is a, c, g, or t
  misc_feature (214)..(214): n is a, c, g, or t
  misc_feature (394)..(394): n is a, c, g, or t
  misc_feature (488)..(488): n is a, c, g, or t
catgatacaggcatcctgaagagtacctctcacaatgtcctattctcattgctgaggggaggcctgaactcgctgtgtcgaggattagacagtggattgttatgtgtgtaggagaacagcttantntgtctgtccangtctgaacttattgcagaaattgaaaagtacnaagaagtggaagaagaccaagacccatcatgccccaggtaacttngagcaattatggatgcttaattctgtgttgacacctggagatgccaggtccagggaaaacaagagtgtgttcaatttcatgttttcaacgaaggttgaattactcctactgacatggctgttggttttcattgcagtagatgtttaggtttccatttcttcctccccttatcatttactnacttactataggttgaccatacctcaaaggctgtatggcaactgcatggaatcttgagcaagtttatggaaaattattgagcccactcttttcntgatcactgttcgctgtgtgtcccgagggcactaactcagagtgtcctttgaccccttcatcagtgtgtcacccggccaactcgctgagctcactttctcctctctctctctctctctctctctttctccctgtctttctctttcattcttctctacctggccctggtctatcccaacataaaggcaataattcattacctcattaatggatctgtcctttttctttttaaacagttccttatgttagccatgaaatctagctggggctgtgtggtttctgattccccctggctaacataaggaactgttt

SEQ ID NO: 711352 - DNA, 365 bp, Homo sapiens
gcgtaccgctgatcgcttagggggaatggactttcagtagaatatagatctgggaatcaactgcatggaggaggtagttataggtgatgagatgtctcaagcacaaagtttggtagaaggagaaaagatactaggctggtacaaaaataattgctgtttttgccattacttttaacagcaaaatccacaattacttttgcaccaacctaataggatgcaaactggagccatctgcatcagagggtttgatgaagatcaacaaagtttgggaacacaggaaaggagcggggagggtaatgacttgagggcataacagggatgatcaaggtttttcttgttagcatgtggagacttaagcggatcag

SEQ ID NO: 711353 - DNA, 799 bp, Homo sapiens
gccgtccgtgccgctagggagccgagactgccggaaagaggagcggcaggagggggcgtggttgtgcagccccacccccgggaggggctttaggcactgggaaggaaagtcctgttggaggagttcggtggctgttcacacccgcctcgctgtcttggagtcttgatctgtcgtcggcgggtcgctggcacaggactaaacatggctgaggctgggctccagccagatctggctggggacagcaccgcgtgggcccaggatccacccagagcaggcaggccttgctggggccccagtcaagtccacttccagtgaggagagccagccgggaggtcagtgccagagctctggtggagcccagaccctgccttccctgagggccgcccctgtcgccgccctggggtccctgtcctcctatcctgactcctgccccagggccaccacccctgaactgtgccctggggcccccaccctccacctggccgactccagttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctggggaaaaaaaaaa

SEQ ID NO: 711354 - DNA, 1346 bp, Homo sapiens
gctgggttcgagcggcagcacagcctacccagttcgacacatccctattgggctgcctggctgcaacagcatccaagtggtggtcactggggtgtgtcgaagctggagttcgagcggcagcacagccgtacgcacagttctgagcactcttgtgggcatgatggaggcgctcgtaccagatcccaccgacagtcctcgcgcgcagcagctagccgcaccaacagcgcgtcccccagccaggtgaacgcgctcgagtagcgcagaggtcccatgcatcggcctcctgggacgtaggtggagccaacagacacgcagtgcgccatcacgcgcgggataacatctgctgtcgcagcggcctccatcagatcagcagacaccatcgccatggaacacagctctagtaccagacttccagcgccatcatgaaccagagctccaggctgctcaccacaacagcgcccgacctggtagccccgtcgcagcgcccaccccaaaagcaagctcatagatcccagagcgtcacagacgcacgcataccgcgtacgcaaaggacaatacaagacgacctggcaagccaacccatagacagcaacgacacagacagcagagaccaccctgggtgacacaccacgacaaagaccatcatggaccaacacatggaaaaagaaccatgagaatacccacctgaagcacactcggacaacaccacaacgcaggaaagacaacgcaagacaccacagaaggacgcgatgaaacccaaagggacccgatcaagagagaccggaccaccaagagaggagagcatccggccagcacgagaagcaaaagcaacacgcacccctgcagcacaccaaagtacgactcacacaccgccacggaccaatccaggaacatcacaaacaacaggcgaacaaactcacccgcgaccaaacgaggatgcaccggcgccaacacaccagccaaactacgctgcggacgacaggatgcacccacaacaaagaaaccggcgaagcaggcgcaaacgaacccaacaagcaagcgggcaccctcaaccacaaaagggagcacaagcacggaccacccggaaacaagagaacaacgcacagccaccgaaataaactgccacacaacagagccgacagacccagacccacgcgcaccaccccagcccgggacgacaaccaggcgacactcagagacgccaacagatggacaccaacatacaactagcgtgagaactgaacagtacaaacacaaccacgacgatacactcaaatcaaaaacacagccacgacacgcctcaaccaacccataccagcacatccaacgaacgaaaggacaacaaa

SEQ ID NO: 711355 - DNA, 566 bp, Homo sapiens
aggtccggtatgagtgcaaaaacgtacttctatactaaaagcttattacctctttgtgatatattctaaataatgaaaaaaatgcgatggacagttgtgaacctaattctgtgttttgcatattgagttgcagtacctaccccagctaactggcagcagcatccttccagcttaggataataagaagtactactgtgataccaagaaacttaactaccgttttccaaacatttaaaggagctaggagacatgattttaaaaaaggcaatcaatagatgctttgaagaaaataaaacttatacagttgattgaaaacaattacaatgttgaaaacacaccaggagaaaacataagcaagaaactgggaggccaactggcaacatatgaagggaaattccagatccagtcttccatgcttgatgatggtgtccagaaaagaaaaaacctgtttggagttgcacttgtatttcagtttatgtaagtagccgaacttatggacagaatatgaactgtccatacctctgggaaaactagatgatatcaaacagatttatgcttcagttgga

SEQ ID NO: 711356 - DNA, 636 bp, Homo sapiens
aagatttaagaaataaacgcgctggatttttttacacccagtctacaattatttggggaagtatggaataatcggctgtcgtgaaagcacataagggaccaaggccaagtcataaaattaaaaggccctactcacaccagtaataattttggcgcatggatatgttcagaatgagtattttttcaaatcactaaaaccatagctgaattcagaaacgagagcacaacagcagcaggtaaagtacatgtggaatacaatcatggggcctaattttcataaccacagctttcagagaataccaccacccatgccaggtgcccagacgatcccattgtctgttttagccgtgtaggggccgctgtagtatacaccattcaggtttgcagagtgacacctgttaaaccaccagccagagtgatcttcttctgcgcagttcccttcatagttgtcatgatctctgtcccacgtgataagtttcattctttggtgacgagcccgccactgcacctcaggatgaaaattccccgcaagggaatctccagctgttccagaatatccctcaatatcgcactcgtagaatctctctacatctcacactctgaatctctcacactgtgtatcacgctaactctctcc

SEQ ID NO: 711357 - DNA, 2014 bp, Homo sapiens
gccgtccgtgccgctagggagccgagactgccggaaagaggagcggcaggagggggcgtggttgtgcagccccacccccgggaggggctttaggcactgggaaggaaagtcctgttggaggagttcggtggctgttcacacccgcctcgctgtcttggagtcttgatctgtcgtcggcgggtcgctggcacaggactaaacatggctgaggctgggctccagccagatctggctggggacagcaccgcgtgggcccaggatccacccagagcaggcaggccttgctggggccccagtcaagtccacttccagtgaggagagccagccgggaggtcagtgccagagctctggtggagcccagaccctgccttccctgagggccgcccctgtcgccgccctggggtccctgtcctcctatcctgactcctgccccagggccaccacccctgaactgtgccctggggcccccaccctccacctggccgactccagctctgggcctgtcagtccacctgggtcctctctgggccctgagtgcctggaccctctgtgccaagcaccagcaagcaaaggggatgaccttgggcacccccaaggtgctgagactacagccagtgagcccctgctgggggccaaagccatggagggtgcctgggcccttccaacctggaaggaggaggggagagagcaggcagcagggcagggggaagaggaggagtgcccgatctgcacagagccctacgggcccagagagcgccgcctggccctgctgaactgtagccacggcctgtgtgtgggctgcctgcacaggctgctgggctcggcctccagtgccgacctgggccgggtgcgctgcccgctgtgccgccagaagacgcccgtgctggagtgggagatctgccggctacaggaggagctgctacaggccgacgggccctcacgccagccccgccgagaggcccctgcatcctatcaccgcaaccctgggccctggggctccctggagcaccgctaccagctgcgcttcctggcagggcccgtgggcggccggggctgcctgcccttcctgccctgtccaccctgcctgggtgcccggctctggaccctgcgggagcggggaccctgtgcccgccgcctggcgctgctgagcctgctggcccttgagcttctggggctgctgctggtcttcacgccgctcctgctgctgggactgctcttcgtgctcctggaccgctctggccgctgagcagagcccaggacagacccgccgccaacaggccagggggcccagactggcccacgtacccatgcctgggtgctgtgaggcctgatgaccaggctggaaaaacccaaggttgggtccagggcagtggccttcaatcaagacctcccattgctgaacccacaaccagggctacccagaggcctgaccctgccagagtccatggctgcactgctgcccagacactagctgaacccaaggacaccagcgcccaaggacagctcctggaggaggccagcccagcaggaaagtctgtgagcaggaccccattcaccctgcggcagacgggcaccgtactggccacgggctgacgccggccacacttcccctccgagggccagctgagcacagcaggcatgaaagcaaacagagatacagcagtgagtcagttccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctggggaaaaaaaaaa

SEQ ID NO: 711358 - DNA, 349 bp, Homo sapiens
  misc_feature (13)..(13): n is a, c, g, or t
  misc_feature (23)..(23): n is a, c, g, or t
  misc_feature (39)..(39): n is a, c, g, or t
  misc_feature (56)..(56): n is a, c, g, or t
tataaaacccttnattgaaaagnatcctaagaaaatttnaatggaaaacacattgncccttattaatcctataaatatagttttaattaaaaattcccaatagggggccccaggtacggtgggtatgcccagtatttcccagcacattgggaggcccaaggtgggaggattgcttgagccctgggagttctgaccaacatggtgaaaccctattgctaaaaaaagacaaaaaaattagccaggcgtagaggtgtgtgactgtagtcccagctactcaagaggctcagttgggagaatcgcttgagcccagaagtcgaggctgcagtgaactgtgatctcaccactgtac

SEQ ID NO: 711359 - DNA, 404 bp, Homo sapiens
  misc_feature (40)..(40): n is a, c, g, or t
tgctcttcgtgtggctcgttgcgtggctcattggggggcncctcgtgtggctcttggcggggcccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctggggaaaaaaaaaa

SEQ ID NO: 711360 - DNA, 583 bp, Homo sapiens
gattctgaagtcgtgtgatgagcacagcaattaaatgtggttgtgtggaacgaaagttgtaaaatcttttactttttggcccctctggaggcttttaacccgtaaatggtgtctgatgtatcgggaggcttaggtgtgcaattctgtgccaaagagagggagatgaatgagatgtctcatggcctcattctagcgcttaaagagtgtgaccatttacgagtgaccttttagtgggctccaaagaggttctttgaaagccatttctttcccaaaggccccccctttaaagaaaccttttttgtggcacccaacgggaacaacacaggggggttaagcttcagagcaattcgtctactttttcccggtggacggtacctcgcagggaaggtccacagccaagtgtacttagcagctgatcattaaggctccttcaagtgcagggctacagatccataattctcgaatgagccactaggggggcacagccttgggttgtatatgcccagctttgtctcttcccccaataccttaaccttttcccctttcatgggtgttaccctttaaggcccaaacccttgggttc

SEQ ID NO: 711361 - DNA, 837 bp, Homo sapiens
  misc_feature (600)..(600): n is a, c, g, or t
  misc_feature (634)..(634): n is a, c, g, or t
agaaggtgggtgtgggacccttataagaggaaaaccctgggggcctcccgtgcctggcggaagaaaggccaagccaacccgcctgttttgggtgctgttttaaaaactattgagggtggagaacatctgggcaaaattccacaggatacatcttcgctcaagtgttgaaggcaaacctttattttgagctatgtaatggccacgtgttggagccagaaactgtgacggtaaacccaaaggaaccaatccagtgttaccttaaaaattaaactttgcaccgcaaagaatccaagtacagccgggcaaggcaaagatgtatttttgactcaccgtaagatctccagcacggacgcattgtgaggcattttttcccttccctcatcacaaatcagggttattaatcgtgtcctttcatgttgcaatgcacggccagtttctagcgcaaagttccacaccatgctatttttgttatagccagctcaagttcttataaacgagacgtttcgaccatagatgaccagccaatagctggtgacacttaataaccagattcacaaggtcaggcatgtccagttcacctgcaacatatggtcattaatntcttgtggagacatgatgagcctttcctggccgnaagccgttgctggtgtgtacccacactaagtaaggtctatgaactcagtcagtttctcaccagtaggtcgataaacattggactttagaggcatcattaatttaggcggcctcggcagcaattgacagattagaatcatgttccatgaagatatcttaccataaccccgatgtctctgttccaaaataaccctagcaatgcag

SEQ ID NO: 711362 - DNA, 788 bp, Homo sapiens
  misc_feature (788)..(788): n is a, c, g, or t
ccttgtgatccgcccgcctcagcctcccaaagtgctgggattacagtgcgtgagccaccgcgcccggcttcctctggtaatcttacacctttacagaataaactggtggctcataaatgatattaaaaacaaaaaaaaaaaatctgggatgcaggtgggctcattcccttattagtcccaggcaacttaggggaaggccaacggacgaggaaggcatcatcttgaagcccagtgaatatgggaggagctgatagtgtgaaactatgaatcagtacaatgtgtcagtccctagaccgtggggtgaaccaagagtgtgaacaccccgtgatcgctcgataaaagcgaagacgaactccaaggcccagcgcagcagagccacacgcgtttgtgtattatcgccccctgtgcacaagccctcttcggcgcaaagggcccgagacgaccaccgccaggtattgcgccaagggtagaaaacgtccgtaggaaaatattaacgttgttaggaccacacgactaaacagcttgcacgtgcgtacacaactgtgggggccacacgaattaagtggcaagttccagtttccggagcccgaggtgtcgaattggagtacgtggcatcgtcgagaagagaaaggggcccctttatgataatataaaatgtagaaagtcgggccactggggcgaaagcacacgtacagtggggacagcaggaaacattttcggagcggaacactgatgacaaagttgtggaggcagcgtgctttagagagtcccccgctgttgtaaggccn

SEQ ID NO: 711363 - DNA, 115 bp, Homo sapiens
cccgtatggactcacagagtatctctgggttcgcctgccgggtagttcaccatactttctgggtcctaacacgtgtgcgcgtgtccacctccccgccgtaacgggggtgttgccg

SEQ ID NO: 711364 - DNA, 410 bp, Homo sapiens
gcctgctgaggggggattacactttcttttcttttttctttctaagacagggtctcactctgtcacccaggctggagtgcagtggcacaatcttggctcactgtagtgtagacttcccaggctcaagggatttctcccaccccagactcccaagtagctggaactacgggtgtgcaccaccaccacacctggctaatgtctcttttttttggtagacacagagtctcactatttagcactgattggtctccaactcctggcctcaagcgatcctcctgcctaggcttcccaaattgctgggattacaggcatgagccacaatgcctggcctctgctagttccgtattctctagagttgtctttactttgtgctagtgtgtccctcattgtgctgatcctctgtaaaaatt

SEQ ID NO: 711365 - DNA, 242 bp, Homo sapiens
cactaagtgagtgagtggtgcaatcatggctcactgcagctccatcttgtggctcaagcaatcttccaatctgtagctgggactacagatgtgtgccaccattcctggctaatttttttttttttttttggagatggagtcttgctctgtcacccaggctggagtgtaagggcttgatctctgctcaccacaacctctgcctccgggtgtcaagcaattctcctgcctcttatgtctatttt

SEQ ID NO: 711366 - DNA, 100 bp, Homo sapiens
agggagaaggctctgcaagagtccagtggcaatacccccttgtgtaagggctttgtgtgcgacagggaggaagtttcaataaagcagcaacaagcaaaaa

SEQ ID NO: 711367 - DNA, 140 bp, Homo sapiens
ccttagagaaaatgaaaggacactccagagctggcctcctctcaccgctccccttcaccgaggccctggccctgggaggctgtttgcatagcctatgatgttcctctctcttcaaattcctgctctttccttgtaccagg

SEQ ID NO: 711368 - DNA, 195 bp, Homo sapiens
ggcaacttagcaggctgaggtgagaggattgcttacgccaggagtttgaggtcggctggggaacatagcaagacccttctctacataaatacataataataattatctgggtatggtggtgtgagcctgtggtttccacctactcaggaggctgaggggggaggattgcattacgccaggagttagaggctgcag

SEQ ID NO: 711369 - DNA, 363 bp, Homo sapiens
gcgctgtacgtgccacgcgggcctacacacggccgcttgtgctctagacacgtgtctagagagacctgtgaagagccacaatatattgcgagagctcaacacacaacatatgatgtggccgcgggtggccacagctgggtttgaacttctggccttaatggcaactggccacttgggccttccaaagtgcttggaatacacagcctgagccactgggaacgggccaaaggtaaactcttgtggaaccggttatatctggaaagggtgtgggcccaagatatgctcaagtggtgtgtaggaaagcgcacattggcctcaccaagagaggccgagaactcacatgggatgtggcacgtgagcacc

SEQ ID NO: 711370 - DNA, 194 bp, Homo sapiens
agatcccacactggtttcgagttctggcggctgcttcctgagggttcaccctgcctgggacgtacagtccgcatctgtgttctcagccacttgagatcattctgtggttttgctaccaagctgataacacagttgggctgactcattttagcttttagggtaactttttaaaaatctgttttttgttttttttt

SEQ ID NO: 711371 - DNA, 134 bp, Homo sapiens
aatcaactgccatccacgtccaacataatatcacacgtcaataataaatgacagagctcaagacgacatcagtcccatttgtcttaagtcctggtgttgtgtggatgacaagcagaagccagtcgtgatgacag

SEQ ID NO: 711372 - DNA, 1373 bp, Homo sapiens
  misc_feature (353)..(353): n is a, c, g, or t
ggcatcagtaggaggccgaggtgcgaattccgttagagtcgtcgcgtaatccgggtgcatctcgaacatcggtcgtggtcgagccgagtggcggcgaaggttcgactcacaagggatcactcaagagggggtagtacactgaggatgcagacggaagggtggacagctacgggtggccaggttcgtgacccaggacgccggcaagactgcgagcgccgcgtggggtctttgtgctcccagaaacacagagctgtgggctggaatcgtatctattgggccgggaggaagagagggggtggagcatgtcagatgggcccttggaaggggaattgacgaggtggagatagcggtgnaacgcgagtgtgctatgaagaccagaagtatggcgcgcatggatgtgacggcgatggttcgccctttctcgttgtcccctatctggacgcacggtgaactcgatttctatataaggcctctttcaaaggaggaagaactccaacgcgaaccgaagggatccagggagacactgtatacacgcgaggacacacaaagcactttaccacggcagcacagtgcgggaaagtagttcagcgtctctgtgcactgaagaactctgagtccacgcgagtgtgacaatcgggacgagaaaatcgcgggacaagcccgcgagtgcgcgtgttgagtgcccaagccaggagagcgtcctcctgggaagaacgcgaggtgtgacacacaggcagaagtctcctggcggggaactgtgcccgcgaggatctaaagcggggggcggcggtgggtctcaacactcctgtttgagaagtgtggtggggccgggtccctaattctcccgtgctaatttgtacattacttccaaatccctgtaacttggtacacgaagttccaataacccacatggcttggtggttgggtcttctggtttggcgaacaagtgtgggcgccccatgaggccccacacggttggtgaacatttgccaccccgacaccacggggtggagacacacagcgccatttttttatcgaacacttcacaacaacgcggggaaagttcccaaggttgtattgggaaacgaaaatagccttcggcggttgtggaggacccttctggctttctgcccggcaactgcttggccattcccccaagaaagtcgaccacagggtctgggcgcgcctcaaccaaagggatccaaaactgggttgggcagcgtaataaacacccccgggcgaaaacttctcttttgggagccccaggaaaattattgtggcacccacaagagtgggacgccctttggcacccagagagcctataatcactctatgatgagacacaacacccttccgatttcccttatatcacc

SEQ ID NO: 711373 - DNA, 764 bp, Homo sapiens
ggaaggtcctctacttatccgcctgtcactagacaaggacgagggcacctacacgtgtgcactccaccactctggccattccccacccatctcctcccagaacgtcacagtgctcagagacaagactggtcaagtgtgatgggcatcagcctgtcatggctcgaggaacacctgcggtggctgctgtcgtgctcctggctcgtccctctccctcgctcgcaggccacggatttgcatgtccctgtgagtggatggggcccactggaggagacaggaatgccctcaagttaccagtgctacgagatcgcctacttctctgagatcatgcgtgagccccctcacccgcgagatcccatcaaaccttgaggaggaagatggggatcgcccattgccctcagtcaggagtttccaggtggctgcatgcgattgagtctagccccacggtccgacgcgggcacctcaccctctccgtgacagccgtctggcgtgtgcgttttggtgctttctggttccagagtctgtcttctgtctggttcatttaggtgtgatccgttccttttcttggagagttcgtgaagagggaagccaggatgggggagcctgattggaggagtgacgagctactgtgagggcgtagtgggctggtgggcgtctcagccagatggatgggcgttcgatccgtgctcgcatcggggaccctgagaatctgggaagagagcttggcatgacgcactgagttgtcctgtgcctgggtctaactgggc

SEQ ID NO: 711374 - DNA, 399 bp, Homo sapiens
agtctgagataatatgggatataccattatgtataaagtcctagaaacaatgtcgaaaagcattatattgtatgttatctgggatgggagaggagagaatctacagatttgcgttcagttaaaaatcaaaactccagcataggaaataggcagttcacatagccggtcaacgatgtgaggtatcatcagggtgagacaaggtcccggtcggtgcctataggcctagctgacgctaacaaaatgggaggcttatggctctgcacagcaaattccagcaggacaagatgactttaagcccgtattcagagccctagaagcagggcactactgagtacgtagtatttagaggtgaaaatagtgcaagagcccctgatggtgcccccctacctgctttgtcca

SEQ ID NO: 711375 - DNA, 150 bp, Homo sapiens
gccgtttatacaccccacccaaagaaatcaaatccagatactcaagtctcatataaacggcatggtattttgccatataacctatgcacatccttctgtatattttaaatcctctctagattatagtacctaatacaaagtaaatggttt

SEQ ID NO: 711376 - DNA, 197 bp, Homo sapiens
tagcggagattgcagtgagctgagattgggccactgcactccaccctgggcgacagagtgagactcggtctcagaaaaaaaaaaaaaaagacctgctccacttttaaatgtctatagctagtaccctggccctttattgtttaattggaatagatttttctttttcccgtgaccaatctgcgccttaggggtaccga

SEQ ID NO: 711377 - DNA, 937 bp, Homo sapiens
cgagcgattactgcgcgaggacgcggtgggaagggcgcaggtgatgccgacaagtggcacagccggattgggccggaatgccgtaatggggagccgccgtcctaggctggctggaacgtggggggatcccccgcggcgggaaaatagggcgggttttacgcgccgggcaaaacgggttctgggcgacagtttggcaaaatctcccggggtgggccgccaagtcggccccgctgtagatggcccgcggcccgagatgaccccggggcgttccaagggacgccacttaccaggggcaggcactaattcacaaggacccacagctgtttagtaggagaaagtatctagccccacggaattttggctgtgcgccttaaaaaaccgggggaaaggtcccgtgcgagcgaagacgacgtcaaggcgtgctttcatccggagattgatgcgagtcccaggatgtgctagcagaaccacagaaggagggggagtgatcgccttttccccaccaccgccaatagtggaagtatagatggggaacgcccataaagctaggtggggcgccccagcttgacagcggcgcggaaatgattattgcccccaagaaacaaagtgggagggcgccccgctaggcgataacccgcactgttggtggaaaggtactatatcgagaacgtgggcaacacgggcaaagcacactttttgtcggagaaaaggagaatatggtctatgcaactgatgcggggttacgccgaaagaaagtcaatctgttggattggtgtgcaattgttgcctctaagaagaggggattatagacacgtttttctttgtaataacacttcggtgtggagaagacgtcgatagatacgcgatcccggtagacagatagctctaggctgagaggtatactccccaattttttcaaattaaacagccacaaaac

SEQ ID NO: 711378 - DNA, 263 bp, Homo sapiens
gtatgttgttgtttcagtttttgttttcgacagagtttcgctccgtcacccagggctggagtgcagtggcatgatttcggctcactgctgtctccgcctcctgggttcaacgcagttctcctgcttcagcctccgcagtagttgggattacaggcgtaagcgaccatgcccagcctgcatcctcattttggatgctgtactgtaggaatcaaaaggtgtaaagcgggtggactggaattgtgttagtactgaccaaagcttga

SEQ ID NO: 711379 - DNA, 209 bp, Homo sapiens
catccaatcaagtatgcaagtaaataataaacatgtaagcacactcccatatatatgcacatggtccatataattaacattgggggaactcaaaaacatactgtcaagtataaaacaaattataagcaaaaaactgcattcataaatctcaaaggtgtagaaaaatgaaatagtaacataaatactgcctatagctgtcacttaaactt

SEQ ID NO: 711380 - DNA, 178 bp, Homo sapiens
ggatgcctcgcgcagcactgcatgggtctgatcacatatgtggattccataagatatttcggcacgagaagaattggcggggctgagaatttgtttgaggatggccaaggatacttaaaggaggaaggatatcccggaaggcccaatgatagggtttattgccttggttggcaagggt

SEQ ID NO: 711381 - DNA, 102 bp, Homo sapiens
gggcgtatggaggatcactcaagttcaggaattataggctgcagtgagcccgtgatcattgccactgcaccccagtctgggtgaaagagaaaggtcctgtct

SEQ ID NO: 711382 - DNA, 113 bp, Homo sapiens
tatcagactcttcacagattacacatgcaagcatccccataccagtgagttcaccctataaatcaccacgatcaaaagggacaatgcatcaagcacgcagctaatgaagctgt

SEQ ID NO: 711383 - DNA, 319 bp, Homo sapiens
ataaattatcttggttaggagagtgtggagaatagactagtgagttcaggcatgtgcactcttggagatgaatcatcaacgaaaatgcaatacttctgtcatggctatttaggtgtttagttcagctgctgaggcggtgagaagttttcatgtcagacgtacaggtagcattttaccccactttcctctgtccaaagcgacatacaagtaacaggcctgcttcgtgctgccattcagaacaggcataaaaagcaactcatttactttccggaaacagagtccagctgcacagaggaaagtggggtaaaatgctacctgt

SEQ ID NO: 711384 - DNA, 230 bp, Homo sapiens
  misc_feature (113)..(113): n is a, c, g, or t
  misc_feature (118)..(118): n is a, c, g, or t
  misc_feature (160)..(160): n is a, c, g, or t
  misc_feature (168)..(168): n is a, c, g, or t
  misc_feature (194)..(194): n is a, c, g, or t
  misc_feature (227)..(227): n is a, c, g, or t
attcagtgaattttaaaatttcagatcttggccaagcacagtggctcacgcctgcaatcccagcaccctgagaggctgagactacaggcgtgacaccacgcccagccagatcntgtgnttgttagacctaaaattcccatttggctcatttaaacatgtntcctcgcngagatttccggcactttgttcattangcgtgcattccccctcaaaccgaaaaaaagaanaaa

SEQ ID NO: 711385 - DNA, 525 bp, Homo sapiens
cgacctgagttctcatatagccccgggtcgtcagtcagatccccctgggtgtgtctcatgatactgattcacgtgcaggtaccagatagattggattagggtctatcctaacggcctgacgtttaacctggtcacctcctcaaatgtccttgtcttccggtcttagttttttccttggttaaaaggaggttgggacttcaacctaggacactgggaggaccacagttcagtctattacccagactttctgatatctgaagccagtttcttgtttccttttctgtggtcactttgggtggggcaggagggtaggacagaaggtggtgggagagatgaagggaggtcatggagatcctggaagtcgcctcggacagaactgtcagcgcccaccaggccttctctggtttcctgctcgcagcacacggttctcagtgctggccttggcatgggattaactactgcgacctcgctggaaggggactccaaatgaagccggaagtgctcaaagacactttgcatccagag

SEQ ID NO: 711386 - DNA, 273 bp, Homo sapiens
tagaggatcacctgatatatctggatcatgttttgctgatagtctatccacttagaacattttagcctgtcagctgtcatctataggcaatgattgtaacgtctatattgtacccttcaaggaaaatgacaattccggtatgaatagtcctccagcttctcctaaacattctcataaaggcatccacacttgtaatcaatatttggaacacatccaaactttgttggatgtgtcttctcaagttgatcctcaaatttggcttacaataaaact

SEQ ID NO: 711387 - DNA, 137 bp, Homo sapiens
ccaaggatctcgagcttagtctgaaccctgaagaagatgggacagagacttatgatttcacacacatttcaggaaccttgtttttgatttattataggcaggaagtgtttttgctaccgtgaaacctttacgggtac

SEQ ID NO: 711388 - DNA, 306 bp, Homo sapiens
  misc_feature (87)..(87): n is a, c, g, or t
ccctttccctggaagaggaatccagtgaatgttcctgtttgatgggacaggaatttccccgggcattgtttcccccccctggggccngcaggccccccagggaccccgggggaggaggtgaaccctcccgaacccgcccaaaaggaaggagccagccccccgccccctcatcgcaggggtcatgattttttccaaattatgttttaattccaagggtttttgtttcaaggaaggaggaaaaagttttattgaaaatgggggaactttatttaaaatgatttttaccattatgagagacggccccga

SEQ ID NO: 711389 - DNA, 868 bp, Homo sapiens
  misc_feature (868)..(868): n is a, c, g, or t
gctctacagctgtgtgtaggcctgggggcgagggtcttcggaacgtagcgctggctgcggcccgcccggctacccagcgggccgtccggcagacggatcgcgccgctccgcgctctgtctggggccagccacctggcgggccgctccggtgcgcctgcccgcgcttttcactgacaggcgctgttccccacagccagcgccgcccgccacgtcccagctctcggccaacggagctgcgcgggggtgacctttccgagcccagcgcgatgacggctccttgctccccagccggcgcagcttcctggacgccgccagctcgggctggtgcccgttcccgccgcgccgcggggacgccgttgtgtggctgtgatgtgatgatggccgcgtgggccgggcgcggtgggagagcggagacctggagttgttgacttagtgaaggaggtgcagctcaattctaccagttcctcggaggtgcagaggatgcatcatcctgagacatcagaaaagcatattgtaagctttaataatttaattccagacaggaataagatgacaatgcggaaactcagtttagacaaatgctgggcatttatgaagtttaaaggatgatgaacgaaggcagaggtatgatgatattctgatccaggggacttccagattgggacagctgtattccactaagggggggagaaaaaggagatgtgagtggattatctgtcatattctcagggggacataagaggggtgggaatcaactggaaacagggtgagttaggcaaaaagaaagaaaaattgggggcgccagatctaacacggggggcgggaaagagtgcgagggaaggtgcaaaccggcgaacagggtattggn

SEQ ID NO: 711390 - DNA, 881 bp, Homo sapiens
  misc_feature (539)..(539): n is a, c, g, or t
caaactaggctagtacgaggctggtgtgctgggacgcccggcccctgaacgctttgcgtccgatgcccgaggtcctcgcgtgtgcgcaccgtttgcgacttggtacttggagaaatggacaggattgtgaaatgtaaactgcatccacactggacagccctttggggaatgctggtagctgtctggttgtgagcaggtctgccgaaataagctcctgggcaggggacgtctgcagctgaatgccgtggatgggtcccagcccccgctgcggttctcggaaggtccgggagcccctgtatgcggtgcacgagcctggctgaatgcctatttccaccagcccgaggctatcgaagagttccccgtgtcggctcttcaccatcccgttttccatccaagagtcgttcaccagacaggtgttatggaatgctgctgaaggttgtgcacaattcggaggacagtgactttcttaccatgcatattagcatgccctggcagtgccaccctcagaagccgcgcgcagcagtgggaggagctagatngagcagtgcgaatcctgtccccgatccctcattcccgtgccacgacagtgttctgcacgcaggcggtacgccggtggtgcaactaactccgtagtgacttggccgtcattaaaggggtccttggcccttggggccaccggttgggtccaccaggcttgtaggggcccaagtctttgccagggccctggccaagggacccgggacctcaacctcgggcttccccggcctggtggccgaaacttgagttatgtgcccggtaagatggatgttttgagccgacacacaccgtttaacactgctcggatgcggggcgtggaggcccgctgtataaggaagtgcgcg

SEQ ID NO: 711391 - DNA, 419 bp, Homo sapiens
gcgtcagcctcatccccgaccgcagctcttactcgtgtgccgatatctgccctccatcccattatgtgccggcccttccttcccgtacccaggagacacctccggcccagatgtatggcttcctcaatcgttaacacgagtgggaggcccacaatacgaaagcctcaagcaggtcctggaacaaagtatatagtgtcataaataaccaagaaatgggtttctacaaagaatgcaaagactgctgcatctggaattccctaccacagcgaggtccctgtgaattagaaagaagctgtctgcgaagtggcccttgcattaccaaaagaagaaacacgtatacaaactaagactacatgatggccatgagtacctctaccaagccaaagacgatgaggcaatgaacacatggatccaggcta

SEQ ID NO: 711392 - DNA, 115 bp, Homo sapiens
atgtaaaactttccgatgcctgaaagataacccatttccttgattgtgctcggaacttgctggacgcacattagagaataaagcaccctactaaaactccaaaaaattagctggg

SEQ ID NO: 711393 - DNA, 108 bp, Homo sapiens
gaaaccctaatatacggcacttacggttatacccctttgcaataccctactgtgggtaacgacttcatatacatcccttgctaactagcagtggctgctacggtttac

SEQ ID NO: 711394 - DNA, 340 bp, Homo sapiens
gctcgactgaccctacaggagctggattttaatggaatatgcctttgtcacaggtgctactggcctgctcggaaataatctggttcatgcgcttttaaaacgaaatatcaaggtaaaagcgctggtccgttccgtagaaaaagccaagaaacaattcggcaatctgcctgtcgagtttgtccaaggcgacatgctcaatgtcgacgccttcagccatgccctgcgaggctgcgacgccttgtttcatacggctgcctatttccgcgacagttacaaaggcggaaagcactggcaaaaactgcatgacaccaatgtgaccggaaccgagcgcttattgcag

SEQ ID NO: 711395 - DNA, 928 bp, Homo sapiens
  misc_feature (598)..(599): n is a, c, g, or t
  misc_feature (622)..(622): n is a, c, g, or t
  misc_feature (627)..(627): n is a, c, g, or t
  misc_feature (635)..(635): n is a, c, g, or t
  misc_feature (646)..(646): n is a, c, g, or t
  misc_feature (659)..(659): n is a, c, g, or t
  misc_feature (671)..(671): n is a, c, g, or t
  misc_feature (675)..(675): n is a, c, g, or t
  misc_feature (813)..(813): n is a, c, g, or t
  misc_feature (821)..(821): n is a, c, g, or t
  misc_feature (827)..(828): n is a, c, g, or t
  misc_feature (843)..(843): n is a, c, g, or t
  misc_feature (864)..(864): n is a, c, g, or t
  misc_feature (869)..(869): n is a, c, g, or t
cctttgtccctcctcactgttctttttttctcggacaccgcccctggtgctgaatgctccgtgtgtgccggggaatgtacctccggccccccggggtgatccccggtggtgctcatgccgccccggccacaggttgtctcttgggaggaccctcggttgtgtgacttttcccacagagtcgacgcccttgtatagaaaccctcattggagttctgccccctcggacaagggccccacgccgcttttttctcggggcacacccctccacggctttattaagtgcccacctttccccccgccccttataaagttttcttctcgtgtgtggtggttcctcggggggacccacacgcacagcactctcgtggagcgagaggctataagcgccccctcgggatattctccccccaccacgtggaacacatctgagagggccctctgtataaaatcctccaccacaagaatatataaaaccgtgggttcacacagagaagccttggccccaagagatgcattgaaatgcgcgttgttgtggccctcaagagaatcttctggaagtccagacacgagttccccggatcctcggcccacggtttannatataggcacggaaaggttcccntcccngctcacancaccacacganaaacactggtggnccacaagtggantganggtgaagtccaccacatcacagttgcccaatgaacgaaggtgttaagttctggctgtaggctgttggtcacacctgaagatgaccacgacgatgagcttggtgtataacacatcaccctcggctgtcaaatttttggngtccttgntcacannaaaactggcagaatntccgggccttatatatccagngcccnctgggcaagcccccgcgcctatattaaggcacatttgaataaattttattacccgttta

SEQ ID NO: 711396 - DNA, 127 bp, Homo sapiens
  misc_feature (12)..(12): n is a, c, g, or t
  misc_feature (19)..(19): n is a, c, g, or t
  misc_feature (72)..(72): n is a, c, g, or t
  misc_feature (111)..(111): n is a, c, g, or t
tttattcttcgnacaaatnttttacagttttatttttaaattatttacacatattcatacaaaggaaaattnatttcaggatggaatcctgggaccatggtagtttaaaanaaaaatctctctgatc

SEQ ID NO: 711397 - DNA, 205 bp, Homo sapiens
tagggtagaatcgtaactgcagccactgacctacaccacagctcatggcaacactgcatccttaacccactgagcgaggcatgggtgaaccagagtcctcatggatactagtcagattcgtttctgctgcaccaggacgggaactcccccactcagtcacttttaaagctaggaaacacgttcaccagtcaatccatcccacttc

SEQ ID NO: 711398 - DNA, 148 bp, Homo sapiens
  misc_feature (71)..(71): n is a, c, g, or t
  misc_feature (84)..(85): n is a, c, g, or t
  misc_feature (89)..(90): n is a, c, g, or t
  misc_feature (96)..(96): n is a, c, g, or t
  misc_feature (143)..(143): n is a, c, g, or t
ggagtctcagtccgtcgcccaggctggagtgcaagactcttggaagagaaatgaggttctcatagggtcanagtagaatgcatnnaganncaagancagctctagacctctaccctgaagatgggagtggagagggaggtatncaacc

SEQ ID NO: 711399 - DNA, 311 bp, Homo sapiens
  misc_feature (87)..(87): n is a, c, g, or t
  misc_feature (135)..(136): n is a, c, g, or t
aaaaaaaaaaaaagttttttttttgaaaaagaaaaaatttaagaatcacattatgtggggcccccaagaatgttgtgtaataacttnctaagaaatgattctaagaactaatgtaatgtttaaaaattaactttnnttaattgaagtgtacagggtgtcccattttttgacggttaaggcattggtccctttaaaggtcaacatgaacgtttgaatttgcaaaacatttcctatagcccgaacttgtaatatggtggttgcctcccttaataaaacagccctgacccataatgttttattatttaaattta

SEQ ID NO: 711400 - DNA, 423 bp, Homo sapiens
  misc_feature (53)..(53): n is a, c, g, or t
  misc_feature (62)..(62): n is a, c, g, or t
  misc_feature (339)..(339): n is a, c, g, or t
  misc_feature (377)..(377): n is a, c, g, or t
  misc_feature (384)..(384): n is a, c, g, or t
gaaccccctgaaatataaacctatggtgaatatggtttggcctgtgttccccnaccccaaanctcacccttgaattgtaataaaccccccatgtgtccaagggtggggcccaagtggagataattgaatcatgggggtggtttcccacccatattgttcttgtggtagtaagtctcacgagatctaacggttttataaatgggagttctcctgcacaagctcttttcttgcctgctgccgtgtaagacatgcctttgcttctcctttgccttccaccatgattctgaggcctccccagccatgtggaactgtgaatcaattagacttctttgctttatnaattacccagtctcaggtatgtctttattagcagcatnaaaacanacagacgcatatgggaatctaaagtcaagggccaagaaa

SEQ ID NO: 711401 - DNA, 1188 bp, Homo sapiens
  misc_feature (246)..(246): n is a, c, g, or t
  misc_feature (290)..(290): n is a, c, g, or t
gtgccgactgggagagctagactaagttggtcatgattgcataagctactcaaatgctcgtcggcttgtacctggactcttgctctcatcctggttctgaaatccctctagttgtcgaccaggttatcctacgggagagcagcctaggtgaccgatagtgtgtgtgcagcgtgcaaatccaagtcaccagttagttctgcaggatacctgagctttgaaggcaaaacaggcaccaatgcttcgganacttacttccatggttggaatcgcgatcacaagatcactcccgnacatgggacgaacctggaacacttatagtcctaaagtacgccagaaatgccaaggtacgttgtaatacgtttatccttgccacgacatatatactgataggaacttacctgcgtgggattcgaggacttgcggtctccccggagcgtccgaggccttcgtgggatcgagaggattcctggtgggcaggtgtgcgttcctaaaacggtgtagatatgggagacagcgcatttacgcaacttcatgttaatggaccgcacatagttgcattgcttttcccatagaacgaaccgttcagagtctcttttggacctagtgtaaatcgttgccgctccagaactaggcccattggacttatagtggtccaaccaatagcgcaattttaaggacaaggagcgcatttctcaattgcttcacatcaagcacaacgcaggggaattttttccgcgcgaagcgcgtttgaaacaacccaagaggggcccaaaatggatcagattttgcacgcccattaattggcttaattggtaaccccgaatggcggtttaattcattcggaattttacaattccttttggggggcacccaacagaggcacaattttctcgtcattcacggcaagaacaagtttctctctccacaacaccaaattccgttggaagaacacggcgatggaaaagcttttcaacaagtttttttgtggaagattccaattcgcgttttatacacactgttggtccttcccatggcaagactttcccccttcggaacaacaagggcacatttcattggcctttttacagatgggcgttggctttacttccttaattcttttcattgggtttcctttgggaaaagaacattaccccttgggccactttattagaagaggggggttagttc

SEQ ID NO: 711402 - DNA, 199 bp, Homo sapiens
  misc_feature (164)..(164): n is a, c, g, or t
gggtagtattggctgtatagtggcgggtggatcagtggaacttcagcagtcccggtggagggggagattcaattgtctggtgtacatgtgatgtggacgcgtgtctatggcatctcacgtggtacattgaggctgtgacccaggcatgtacgggctgtcccggncctggtacttcccactgcagaagtcctactggctg

SEQ ID NO: 711403 - DNA, 148 bp, Homo sapiens
acctgaccttgggatcctgcccagcttggcctcccaaagtgctgggattacagtgcatgagtcaccgcgcccagccgatatgctatattgcggtatgcctggccgcaccgtaggctggggtacaccaatgtcaccacaaacaagtgag

SEQ ID NO: 711404 - DNA, 343 bp, Homo sapiens
tttctggccacgactcggctgcagcaggagctggacgacctgctgtggacctggaccaccagcgcagagcgcgtgaaccctggagaagaagcagaagaagtttgaccagctccgtggcggaggagaagaccatctctgccaagatatgcagaggagcgcgaccgggctgaggcgggaggcccgagagaaggagaccaaggctctgtcgctggcccgggccctggaggaagccatggagcagaaggcggagatggagcggcttcaacaagcagtttccgcagggcgatggagggcacttaatgagctcaaaggatgatgtgggcaagagttgtccacaagctgg

SEQ ID NO: 711405 - DNA, 236 bp, Homo sapiens
  misc_feature (14)..(14): n is a, c, g, or t
  misc_feature (60)..(60): n is a, c, g, or t
  misc_feature (95)..(95): n is a, c, g, or t
  misc_feature (129)..(129): n is a, c, g, or t
gaagagacaggtangctccttaccctgtgcccaccttgctctagccagtggttctcagcncaggggtggggcataccccgacaacccccaagatnttgggcaatatctggaaacagggttgtcacaatntgggggtaaggatggatgtgctactggcatctggtgggcggatcttgaggtcgggagatcgagaccatcccggtaacgcggtgaaacctcgtctctactaaaaatac

SEQ ID NO: 711406 - DNA, 235 bp, Homo sapiens
  misc_feature (12)..(12): n is a, c, g, or t
gcaaagctctgnagagggtttttacagggccgtgttagagccttcacccatggaacagtacaagacatgatgctactccgagaataccgacagctccaggaacagcagtccctactacccagcctctccccccaaccatcgcccctatccagcaagaagcagccagaggacaacggcgcccctcttctattacctattaaaaggctgggaatgttagggaacaagttgcaccaga

SEQ ID NO: 711407 - DNA, 227 bp, Homo sapiens
cgtggtgaaggtcaacgtcagaccaggtcacggctctgtcgctctttcctccttagccccactccccatcagtaggaaaaaataagtgacaagtcgctcgtgtgggcccataaagaggcaggataaagtattctttgttttccttccttaaaggcctctcacttttattacaggtaacttattaaaatattttcctgatagcagttcttgtcctaaaggagagtgtc

SEQ ID NO: 711408 - DNA, 408 bp, Homo sapiens
  misc_feature (217)..(217): n is a, c, g, or t
  misc_feature (299)..(299): n is a, c, g, or t
gagagagagagagagagagagagagagagagagagagagagagagagagagagagagagagagagagagagagagagagagagagagagagagagagagagagagagagagagagagagagagagagagagagagagagagagagaggaaaaacccaccccagacgagagcggccacgacccgacacccccgcccgcaggcccaaccaccaaaaacncaccacagacgcaaacacccccacagcacccgagccacacacgggcccacacccaccccaaccaggagccccacaaacaacnaacccgccccaaaccgaaacgccaccccaccacaaaccaacacaccagccccaaaccagcgccacgagcgaaaccaaaaggacagaccgaacccgaaaaaggcccccgc

SEQ ID NO: 711409 - DNA, 197 bp, Homo sapiens
tccgtatgctgtctcatgtacgggcatagtaggtcggagagtgtagtgaggaataaaatcttttccttagaaaaatattcaatcaggtggacaggcaggtggttggccggctctgtgcattaccttggaccgggtggggttccacttcatattataatgtcttgtgtccagaaaaagtttgggcaacagggtgtggc

SEQ ID NO: 711410 - DNA, 560 bp, Homo sapiens
cagcgcctgcatccacctgtgcttgagtgatgatgtggtgttggagccaccacagtgatgttgaaggagaagctggctgagctgaggaatgctgtgccaatggtgctgttttttctgggtaggatgtgagctgcaagaatgtggccctgaactggctgtctgccctcagataatctcctcaacgcattcccagcatgttcgctcaatgtgtgtgtgccctgtgctctatcccatgagagtggaccatgatcgttcacttgatggtgtgagattgacaactgttatgagaaatgtcatcagatgatgaccttgggccttggaatgaactgcaacatcttggcctgagcatgtgctaaggcttgccctggccacatgatgaatgccgtgttgtttgctactcataaatgaacatttgaatgctacagattgatgtgccactgtgacctgacgatggttgcgagtatcttgctcatataagtgccagagtttaccaatgcccctgtgcccctgtgcctaatgtgacaatgaattgggaccctgtgtgcagagccaaccccgtc

SEQ ID NO: 711411 - DNA, 154 bp, Homo sapiens
cctaaatatacttttagggcaagaggagcaccaaagaagacaatcacttccaaaaaacttgcttgtggtctatttccacattaggtatctgcacatcaccttcctttattgacaatcattgatttttaaataaaagaaataaaacaatatccat

SEQ ID NO: 711412 - DNA, 421 bp, Homo sapiens
ccaacctgggtgatagagcaaaaaaccaaaagaaagaagaagaatgtaatcccagctattcgggaggctgaggcaggaggattgcttgaacccatagtgaaacctcatctcaaaaaatttttaaaataatgggagaggccaggcgtggtggctcacgcctgtaatcccagcactttgggaggccgaggcagatggatcacctgaggttaggagttcgagaccagcctggccaacatggtgaaaccccatttctactaaaaaatacaaaaattagccaggcatggtggtgggcacctgtaatcacagctacttgggaggttgaggtgggaagatcgcttgagcccaggatatttgaggctgcagtgagctatgattacacaactgcactctatcctgagcaacagagtgaggccctgactca

SEQ ID NO: 711413 - DNA, 4696 bp, Homo sapiens
atttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctttagataatgacagaaattccactgttgaaaatatttttcaagaagacctaccaaatgataaaaggacatctgtatctgatgtccttttatcatttggtaggtcttcttgaaaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctgtaaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttgcgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttat

SEQ ID NO: 711414 - DNA, 142 bp, Homo sapiens
tctgaccacctgatccggctgctcggctcccaaagtgctgggattacaggcgtgagccaccatgcgccgccaacaggaggataaatagtccgtttgaggtgttggttgatatagacagcaggacggtgggtcagaacatcag

SEQ ID NO: 711415 - DNA, 401 bp, Homo sapiens
  misc_feature (31)..(31): n is a, c, g, or t
  misc_feature (44)..(44): n is a, c, g, or t
  misc_feature (50)..(50): n is a, c, g, or t
  misc_feature (54)..(54): n is a, c, g, or t
  misc_feature (138)..(138): n is a, c, g, or t
  misc_feature (175)..(175): n is a, c, g, or t
  misc_feature (237)..(237): n is a, c, g, or t
ccctcgtcgactgttgcttgctggtcgcagntccctgacccctncctcancctncctaacctcggtgccaccggattgccttcttttcctgttgcccagccagccctagtgtcagggcgggggctggagcagccgagncactgcagcagaagagagaaaagacaacgacgacccntcagctcgccagtccggtcgctggcttcgcgccgccatggaatgagacagacgccgctcacntgctctggccacacgcgaccccgtggttgatttggccttcagtggcatcacgccttatgggtatttcttaatcagcgcttgcaaagatggtaaacctatgctacgccagggagatacaggagactggattggaacatttttgggtcataaaggtgctgtttggg

SEQ ID NO: 711416 - DNA, 668 bp, Homo sapiens
  misc_feature (16)..(16): n is a, c, g, or t
  misc_feature (67)..(67): n is a, c, g, or t
  misc_feature (122)..(122): n is a, c, g, or t
  misc_feature (125)..(125): n is a, c, g, or t
  misc_feature (127)..(128): n is a, c, g, or t
  misc_feature (136)..(136): n is a, c, g, or t
  misc_feature (142)..(142): n is a, c, g, or t
  misc_feature (151)..(151): n is a, c, g, or t
  misc_feature (159)..(160): n is a, c, g, or t
  misc_feature (221)..(221): n is a, c, g, or t
  misc_feature (226)..(226): n is a, c, g, or t
  misc_feature (228)..(228): n is a, c, g, or t
  misc_feature (233)..(233): n is a, c, g, or t
  misc_feature (246)..(246): n is a, c, g, or t
  misc_feature (250)..(250): n is a, c, g, or t
  misc_feature (262)..(262): n is a, c, g, or t
  misc_feature (266)..(266): n is a, c, g, or t
  misc_feature (273)..(273): n is a, c, g, or t
  misc_feature (297)..(298): n is a, c, g, or t
  misc_feature (301)..(302): n is a, c, g, or t
  misc_feature (307)..(307): n is a, c, g, or t
  misc_feature (316)..(316): n is a, c, g, or t
  misc_feature (330)..(330): n is a, c, g, or t
  misc_feature (334)..(334): n is a, c, g, or t
  misc_feature (338)..(338): n is a, c, g, or t
  misc_feature (340)..(340): n is a, c, g, or t
  misc_feature (348)..(348): n is a, c, g, or t
  misc_feature (357)..(357): n is a, c, g, or t
  misc_feature (359)..(359): n is a, c, g, or t
  misc_feature (361)..(361): n is a, c, g, or t
  misc_feature (364)..(364): n is a, c, g, or t
  misc_feature (366)..(366): n is a, c, g, or t
  misc_feature (369)..(370): n is a, c, g, or t
  misc_feature (373)..(373): n is a, c, g, or t
  misc_feature (378)..(378): n is a, c, g, or t
  misc_feature (380)..(380): n is a, c, g, or t
  misc_feature (388)..(388): n is a, c, g, or t
  misc_feature (392)..(394): n is a, c, g, or t
  misc_feature (425)..(425): n is a, c, g, or t
  misc_feature (430)..(430): n is a, c, g, or t
  misc_feature (445)..(445): n is a, c, g, or t
  misc_feature (453)..(453): n is a, c, g, or t
  misc_feature (459)..(459): n is a, c, g, or t
  misc_feature (464)..(466): n is a, c, g, or t
  misc_feature (469)..(469): n is a, c, g, or t
ttgcccaggggaagtnggagagaaagctcgcccgtgtgcatgtttgatataggctgtgtgtgtaggnagggagtgggctagaggaccctggacaccttggccagcctcctaggcagtgagtnagngnnaagtggantaggtnttgcacctntgtcatanntcgggatccagacagaccaggcagcgtgttaatattggtgttctgcatggtggacccaagntaaantnttgtntgtagccaagtgnctgngcacggaccatntttnatcagcncagggcccaggcaaagggccaatnnttnnggatngtggacacngtgttcccattttnagcncggntntagaaggnactgttttntngnttntnatnnctnttgtntnggcagggnctgnnnaggtataggtggtgctgggtcttcagttggnagaanttgtttttgttgganaacgggtngtcatnctcannncanaggtggtcgagcagggtccccaggccgtgctccattctgggcaggggacaccagggggcagggaagagacaaggccagaaaactggggtccttgggctggaaggggctgggtccccagtccccctccttggccgcacacccactcagggcagcacttgcccaggacctcgaccctcctggggtgggggcagtcccagct

SEQ ID NO: 711417 - DNA, 1622 bp, Homo sapiens
  misc_feature (1622)..(1622): n is a, c, g, or t
agctgggtcgtgctcctggctgcgtgctgctgctgctggctgccctgcgctccgtgtgctgctcctgcctcctgtgccctgcctgctggaggctgcaagtcttgctgctgccctgcctgtgctgccctcaagctccgttttcctgagccctgcctgcgatggtgatgctgctgctgtgtgtgatcccctgtgcatgatccctgcctggttgccctctgctcagctgtccttgcttgctttgcctgcttgcttggtgctgtgtacccatggatcaagcccatttgtctttccagtcaactgccatggcctggtaccttcccctatttgaagttgcacgttgccatgtggtgctgcctgtgtggctgcttgcatatctggcttgttggaggtgtcttgatgtggcgtccctggtgtggctccctgtggtagcagttgcttgtaacgtggcgcatttgcttcctgagatggttgtgtgcgcacccattgttccccaatgggaacaacctagtgagggctgtgctggtatatcgtggcacccaattcgtggcgatgccatgagcgctttgaaaggcctatttagccacggacagttggttgtgaacccctgggggcgttggcaagggggaaccttcatgtgggccaacgcccgtatatcgccaagggtttggattgtttgggccattcagtgtgaattttgaatttggtccagctgttgtgggacggaacactgacaacgtgccccctggagaatgggttggcacgaaagacatggcccgagtcacccgtttttaccaaatccagactacacaaagacgttgggtcacggtatttggatcgtggccacacagtgatccgcactgtggttggaggtacccgatcgggagataggcctacgtcccacaggaacaccgatcccggtggaacacaggtcgtgtgggaacgaaattcacccgatagggcgacagagcagaactggaaaaccgcaccagaggtgtagtgtgcccaaaccaaacgcagtgagtgccgagggtaagtagggcaccaagccacagttttttcgcaacttttgctggtggtcaatgacgcccgcagtacctggtggggccgacccaagcagcgcataacagcgcgcacagaatttggtgagttcataccgcatcagcaatggcaatttcgtggcggggagcgcgacccggccgacgttagtgtaccttttggcatatgggtgtacgcaagcgatacggcgagagcgcgtacgaatagcccaatgaggaatcaagtggtgagacgtagccaagaacgtgtggaagtgtgcgatggagaacacaccagtaggaagcctgatgacctacatcaagagtgggaccacagagcagttggtggggttgacgcatcgtgaagtttgcgaagtaaacatggttgtgggtgcgacgttggtgacaatcttggcacgcgtttgcgatgatgaggaggggcaccatctgaaaagatgagttgaagagcatgtatataattagcagggagacacatgcgtgagtcatgatatgggctgcagagcgaagagtgaggacagtcagtgagaagagcgagtttatgcaacagctccaagtattgtgtgaagn

SEQ ID NO: 711418 - DNA, 101 bp, Homo sapiens
ggcatcatctgtgcaagctctcatcgtcccgtgcgcgaggtactgcgggaacaagatcggcaagccccacactgttccttgcaatgtgacaggttaagggc

SEQ ID NO: 711419 - DNA, 156 bp, Homo sapiens
ccgcacctgatgatggacgacagcgaagcgccgcaagcggtggtgcacagcctggaactgcgcgaggtgcgctacagcccgccgccggtggaaggcagcgaaccgttccacctgggcccgatcaacctgaacatcaagcagggcgacatcgtcttc

SEQ ID NO: 711420 - DNA, 785 bp, Homo sapiens
tgctataatatgaaatgttttatgtttgtaataaaatcagttaacacggttaacaaaaaaaaaaaaaaaaaaaaaaaaaaaaaaaaaaaaaaaaaaaaaaaaaaaaaagaagagaagaaaagaaaaagaagagagagagagagaacagagaaagagagaaaaaaaaaaaaagaagaaaaaaaaaaaaagagagaaaaaggagaggacgcaaaaaaaaagaagggcgccgatcaagagagcagcacacacgaacacagacaaaaaaagacaaactaaaaaaaaaaaaaaacaagaaaaaacagaaaaaaaaaaaaaaaagaaacaaaaaaaacaacaagacacaacatacaagcgggaaagcaaaaagacacagaagaagacaaaaacaacacaacaacaaaaagaacacacaagaacagaacgaagataaacaacgcaaagaaaggcgaccagaaagaaacaacacagcgaccagccaagaaagacacacgacagaaacaaagaaaatggagaaaacatagaggtaccacatagataggacaaaatgaagaaggaacagaataatgaagaaaaagaagcaggcaccacgcagacagaacgaaacaacgacgcggggagagcgcagacaacgcacatccaccgacggaggagaagacacccaggcacgaaaaaagcacgaatacacaacgaaaacagcgcaccaacagaacaaaagacgagacaaacacaaggaagaggaaagacgagacaacaaaacaaaaaacacacaacaaagagacggagcc

SEQ ID NO: 711421 - DNA, 200 bp, Homo sapiens
  misc_feature (39)..(39): n is a, c, g, or t
gggagggagagagagagagagaaagaaagaaagaaagangaaagaaagaaagaaagaaagaaagaaagaaggaaagaaagaagagaagaaagaaagaaaatagaatgtaagggtcaagaagcaatatctgcctcacaactcaacagggaaagcctagggaaccagcggagtctacgtgacctgagagagcaaaaaaaaaa

SEQ ID NO: 711422 - DNA, 218 bp, Homo sapiens
ttgagatggagtcccgctgtgtcgcccagactggagtggagcgcagtggcgtgagtcttagtcactgcaacctctgactcctgctcccgggttcaagcgactctcatgcctcggcctcccgagtagctgggaccacaggtgtgcaccaccatgcccggctaattttttgtatttttaatagagacggggcttcaccacatcggccaggctggtcccga

SEQ ID NO: 711423 - DNA, 202 bp, Homo sapiens
  misc_feature (64)..(64): n is a, c, g, or t
ggattatcacgtgcgaatataggccgaactgttatggacccccaaatactagagagttcctgcncacacgaatactgctgttgacactccagtggaattcccagcagccttgttacagtgcacttgaacgtgggagaatgctgaccctgatgacttgtactgatacctgagccttaacactgtgctcttaccttctgtataa

SEQ ID NO: 711424 - DNA, 440 bp, Homo sapiens
  misc_feature (124)..(124): n is a, c, g, or t
  misc_feature (235)..(235): n is a, c, g, or t
  misc_feature (244)..(244): n is a, c, g, or t
  misc_feature (374)..(374): n is a, c, g, or t
ggcttacagctatttggttacaaattaagtgtctagcagaaggaggagacctgaattccttggaattcaaatcacttacagactcattaaatgatatcaaggagtacaatacgacgcttctacnatatcagctgtgctttcagcacataaatgtacgaaattccagtgtgtgcacatttattccagacgctggcctaggagccccagattgcggacaacctttacattggccctntgtgccacngcaaagttaacagcccaacaggagcactgacgtacacagatttccattatttccaaactgcacggggaccatggttttcggggacagttccttttccctttactatacgcgccttcccaaaagaccgaanatttaagccctaaagctgggctggcgcaacacaccacaggggcgacaactcttcaaagttcgtcac

SEQ ID NO: 711425 - DNA, 474 bp, Homo sapiens
ttaaggtgacagaatgtgtacgttagcactgtaaaaagcagctaattggtagcagaacgtgctagctgagaatacgttgtattctacatcactgataatgatctgaagtgtacaagtcatcagtatcagatctatgagagtttttgtagttttgctctaacataaatttctctttgccacctccaaagttattatattaatagtaaaagtaatgctttggagagggtggaagggggtatgccctagcctccacagctcctgccacaaactgcccaggtaagcaggacctgagtgtgttgaaaggctgagttgaagagcagattgacacaggagggctggaatgaacgttggctagagcaggtgtgtccaatcttttggtttccctgggccacactggaagaagaaaattgtcttcagccacacataaaatacactaacactaacaatagctgatgagctaaaaaaaaaaaaaaa

SEQ ID NO: 711426 - DNA, 415 bp, Homo sapiens
  misc_feature (166)..(166): n is a, c, g, or t
  misc_feature (170)..(170): n is a, c, g, or t
  misc_feature (173)..(173): n is a, c, g, or t
  misc_feature (182)..(182): n is a, c, g, or t
  misc_feature (184)..(184): n is a, c, g, or t
  misc_feature (204)..(204): n is a, c, g, or t
  misc_feature (217)..(218): n is a, c, g, or t
  misc_feature (221)..(221): n is a, c, g, or t
  misc_feature (248)..(248): n is a, c, g, or t
  misc_feature (262)..(262): n is a, c, g, or t
  misc_feature (270)..(270): n is a, c, g, or t
  misc_feature (274)..(274): n is a, c, g, or t
  misc_feature (281)..(281): n is a, c, g, or t
  misc_feature (284)..(284): n is a, c, g, or t
  misc_feature (294)..(294): n is a, c, g, or t
  misc_feature (309)..(309): n is a, c, g, or t
  misc_feature (326)..(326): n is a, c, g, or t
  misc_feature (344)..(344): n is a, c, g, or t
  misc_feature (352)..(352): n is a, c, g, or t
  misc_feature (361)..(361): n is a, c, g, or t
aaataaatttttccccccctaaaccagtttttgagtgattgcagtatgactccatttccctggggcattcaaataatagttcccctggtgaaaccaatgaagattatttacaatgcccccctgctttttttggtgtcctgaacctggaagttgggctttttaagtnttanaangtaatcagngngatttcccttcctgaatttngatgaattttaanncangggcaagatcgggttgtaagccctttnagatttaaggccangccctggntcanggtgaanttnccaaagcaancaatgcctgtgaaanggtcctgcagcacccanccagtgaatttttttggngacatccngtttttgtngtaaaactttatattcctataaatccattaaggccccaataaagtttgttttta

SEQ ID NO: 711427 - DNA, 208 bp, Homo sapiens
accaaggcccaggcttgagccccagctttagtttcagcttagggttcccaaaggtcccagggcccttcaaaaggtttaaagtagatatttttttccaccttaggaataaaaggttggtgtgatcccccccccccgcccctggggtaccatttttatgggggtggggttctcctttggtatttgttcaaataaacctggggccggtgta

SEQ ID NO: 711428 - DNA, 1029 bp, Homo sapiens
aggacggaggcctgccccacccccttccctttcctccaaacgccctaactccctccagacacccatgggcaataccctctgccccacaggattgaatgacgtgcttggcagtcctcccaatcccacacctccgtgtttgccaggggaaagaacctaaatgacttcgtgtgattgggacgggtggcagacagtgaagaaaacatgtccatggcccctggtctccatagatgaatgtgttgcttatgtccaatgacaacgtatgagttgctgattctccgggaggccgttccaatgggtcgaggtttgatgggaagacttccttcccaaagaacatagatcctaccatgcaggatctaggagagtgactgggtgtgccaaaatatgcccagggtcctgccctcagcactagatttaatggggccaagagggtccaaacccctggctgaccataccacttctaggtctaactccttcacctttccagcccttcgaggcgggaccatgagaacagaaatgaccttatgaaaagctacttctgttcctgctttcacctctcacgtattgacggtagattgtcttcggacctccagagggtgaacctcttcaactcttgcgctgccagccttctcaggggacttggccctcctaagcagagcagcgctatgaggtagctggctgactggcaaaccatggagagccaattaccaccctctggtgctcacagcagcgtacccctggcactaacagctcttaatagacccatacccagagagacttccattgacaccaggggaccctcacccaaaagagaacacacgataacaggacgagaatggaacaggggcaaccggcacacgagtaaccaacgcgtgcaaacaccgtatgagcaccaaggacggcagaaccccgcggggccacatcaacacaagcagcgcacacacagcgctcacgagacacacacgaagcaacaatcatggcgacgcccgcgcgacccacaaggtcacacagcgctgggacaccacaaaagga

SEQ ID NO: 711429 - DNA, 260 bp, Homo sapiens
cagcactttgggaggccgaggtgggtggatcacgaggtcaggagatcgagaccatcctggctaacacagtgaaacgtgttgttactaaaagtacaaaaaactagctgggcgtggtggcaggaccctgtagtcccagctactcgggaggctgaggcgggagaattgcttgaaccgcgggatggaagaaggtggcaggtgagccgacgattagtgccactgtacctccagcctgcatgccgagagtgagacacatgtgtact

SEQ ID NO: 711430 - DNA, 507 bp, Homo sapiens
cactaagggtcaactgccttgggttcctaaagagctgggattacaggcatgagccactgtgactgacaggttttatgtgtgcatatgtgtgcagacaggtcttcctgtgttgtccaggctggctcgaacttctgggctcaagtgatcctcccaccacagcctcaagttttgggattacaggcatgagccactacacctgagtattgttctctatagtggctgtactaatttacattcccatcaactgcatacaaggattatcttttcaccacatcctcatcagtatttgttattccctgtctataaaagccaccctatgaggtgagatgacatctcattgtggtaatgtgtgatttgtatttctttgatgtttagccatgttgagcattttttccgtatacctgttggccatttgtatgtcgttttttgagaaacaagtattctgacctttggccaattttttgatcggattttttttttttttttgggctatcagttgaatccctt

SEQ ID NO: 711431 - DNA, 308 bp, Homo sapiens
ggctgtagatcccctgagacaaacattataattgtgatggatgtggcagctctttattcaggagcaatacctggcattgccattgatgggatgtcacactggtggagaaaaccttacaagtgtaaagagtgtggcaagacctccagtcaggagtcatcccttacctgccatcgtagactccatacggaagtaaacggtgacaatggtaatggagtgtgggcaagaatcttgggtcaaattccagcccttctatttggatagggcaatggatcacgggagaaattccttacaggtgtatggatgtgggg

SEQ ID NO: 711432 - DNA, 255 bp, Homo sapiens
tgaacttcaagttgtaactacagtatccatctactcctgcttatcttaccagaagaacactgattttgctcagcgtgcaataatggactatcctcaaatctccaaggttctggaagacagagacgatcctatgacgtagtactcggtccataagttgtcatatttgagatgacttgcgctgagttttagaaagctccttgactaggggcaagctaaggtgatcattgtaactcagggtacccaggagccgggtat

SEQ ID NO: 711433 - DNA, 286 bp, Homo sapiens
  misc_feature (90)..(90): n is a, c, g, or t
  misc_feature (142)..(142): n is a, c, g, or t
aagctctgtccccatgaaacactcactctccatccatcccctccccaactcctggcacccaccattctactttctgtccctatgaatgtnatggctctagggacctcctctgagtggaatcagacagcattttccttttttnactggcttatttcactgagccaagtgcggtggcacacgcctgttaatcccaaaactttgggagaccgaggcgggcgcatcacctgaggtcaggagttcgagaccagcccggccaacatggtgaaaccccatctttggtaaaaat

SEQ ID NO: 711434 - DNA, 375 bp, Homo sapiens
ctggaatggaaaaaggcccttaggtacccaactaaaaaaatttgaggcccggcccagtggctcatgtttgtaatcccacccctttgggggattgaaccaggcggatcccttgagccccggagtttgagcccaggttaggcaccatggcaaaaccccgtctctccaaaaaaatacataaattaccccgggggggtggggcatccctgtagtcccacctgcccagaaggctaaggtgggaggatcccctgagtgagcctggggaggtcaaggctccggtgacccatgttcccccccctgccctctagcctgggccccaaagtgagatcccgtttcaaaaaaaaaaaaatttgaataaactatggcctttagttaata

SEQ ID NO: 711435 - DNA, 943 bp, Homo sapiens
  misc_feature (748)..(748): n is a, c, g, or t
ggctgtgcgaagggacgcggtgcgcatgcgctgatggctgcggccaggcccagaatgtccgtccttgtatgtaaaagctcccatggagccttccttcctattcaagatgcaatttaatacggcactcgcgagaatgacatttaaaaacacgtctcatctcgaaaggaacaagtgtttgtatcacaattatgagaaatcgatgctggggaacaaccgtaactgattgaagccttccagccagccagtgatctcttttgacccattaccttggattctccatcagagtgtggatcacctcccaccttgaggggtccccaatgatttttgacacatgttcctccaggtgatcctttaacagagaagagacccttctcaaaacaaaccgcagcattttgaatataccctgcgcccaatggctcttctaggataggcaccagaattatcaggtgaaagactcttttacagtggtctcagcgggctaccgtgtaaagcattatttactatgggcttgagagtaaaactcctagaaccagttcctgtttctgtaaccagggatgttcctttaaggagtcatgagaacacacacaagctaaaaattcatgcgggggaccatccttgaagtcttgaaaagaagaacctgaagatgccttctgtgttgtggaatagcactgattgttttacccaagagacttgtgcaagtttgtctttggacaggccttcttgacagatggtggtggcaaattcagcnttgcaggatggagggatttataggatgacaataaaggccagtgagaaggctagaaattttggtgagtattcatctggcaacatatttccaaaaacagttgtcacatgcctgtgaataaccgggacggcatttgttgacgccggtgttctttaggcacagagagaagggccaatacattgtaccgggggggtcaaa

SEQ ID NO: 711436 - DNA, 146 bp, Homo sapiens
cgtagccctttgtcccgctttcctttgagcttcttttcagtcacggttccaaggaggaggcaaattttagtggtctggagcgttaaagacaaaggttttgggtttaaggggtgccgctttacacaagcattgttaaccaagggtta

SEQ ID NO: 711437 - DNA, 148 bp, Homo sapiens
acagataggcaagaagaggcggactcgagagacaccctacacgattttattctacagccacaagcgcccggtgggcggggtctggaccagtggcaactcaggtggccgagggctccacgcacccaccccccttttctaggggagagag

SEQ ID NO: 711438 - DNA, 847 bp, Homo sapiens
  misc_feature (1)..(1): n is a, c, g, or t
  misc_feature (165)..(165): n is a, c, g, or t
  misc_feature (183)..(183): n is a, c, g, or t
  misc_feature (200)..(200): n is a, c, g, or t
  misc_feature (207)..(207): n is a, c, g, or t
  misc_feature (236)..(236): n is a, c, g, or t
  misc_feature (238)..(238): n is a, c, g, or t
  misc_feature (685)..(685): n is a, c, g, or t
  misc_feature (706)..(706): n is a, c, g, or t
  misc_feature (717)..(717): n is a, c, g, or t
  misc_feature (726)..(726): n is a, c, g, or t
  misc_feature (729)..(729): n is a, c, g, or t
ngttatgggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccaccnccaacacaggccaaccancaggcgccgacagctgnggcgcgngggggggggggcgggaggtgtgtgaaacngnggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctccttagctgctaagcctgccttgcccaggggtgggatggcactgaaggccagcagacaggcctaggctggggcagggtcacggctggcctttacctgctcaggcccccatctctggggtgtttgggggtcagggagcagggacactngccgtgtctacagcggtgtantcagaagttanctggcccanggnagtatgccctgctgggtctgcatgcctgacctgaacttagacggcaccacttggtggaattcatgtcttttaccctattggactttggtttgaaacaatggaattaataagcttggat

SEQ ID NO: 711439 - DNA, 158 bp, Homo sapiens
agagttcccttcacatgtttatgaaaaagacatgaataaaagtcattcttattttctttacatctttctcttgcattacctagagtatgcccagggcactgataggggaatttagggaaatgagctatccttaggatataaccacagattcaataaag

SEQ ID NO: 711440 - DNA, 695 bp, Homo sapiens
  misc_feature (84)..(84): n is a, c, g, or t
  misc_feature (86)..(86): n is a, c, g, or t
  misc_feature (533)..(533): n is a, c, g, or t
  misc_feature (554)..(554): n is a, c, g, or t
  misc_feature (565)..(565): n is a, c, g, or t
  misc_feature (574)..(574): n is a, c, g, or t
  misc_feature (577)..(577): n is a, c, g, or t
ggacatcggatacccaaggagacgaagctgaagcaggcgctgacagctgctgacctgaacctggtgctgtatgtgtgtgaaacngnggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctccttagctgctaagcctgccttgcccaggggtgggatggcactgaaggccagcagacaggcctaggctggggcagggtcacggctggcctttacctgctcaggcccccatctctggggtgtttgggggtcagggagcagggacactngccgtgtctacagcggtgtantcagaagttanctggcccanggnagtatgccctgctgggtctgcatgcctgacctgaacttagacggcaccacttggtggaattcatgtcttttaccctattggactttggtttgaaacaatggaattaataagcttggat

SEQ ID NO: 711441 - DNA, 337 bp, Homo sapiens
ataagacaactcagtacatgcccaaaccaagatgatcagatatgacatattagaaacatgtgacacagtctttatgggaaccattatgaaaatgcttcaaaaagcaatataagccaggcacagtggctcacacctgtaatcccagcactttaggaagctgaggcaggcagatcacttgaggtcagaagttcgagaccagcctggccaacacggagaaacccccatctctactaaaaatacaaaaactagccaggcatggagtcacacacctgtagtcccagctatttggtaggctgaggcaggagaattgcttgaacccgggaggaagaggttgcaa

SEQ ID NO: 711442 - DNA, 918 bp, Homo sapiens
aactgaatgcgtaaacgaggacgactgatcgaaagtgtgacgccatagacggtagaccactctagtctaagcatggtcgagcttcatctatcgacagggacactccggcgcaacttaacggcagtatctaagaaactcgatatcttcttcttgcctacccccggttctctgtggcgactattgtctgaatttggagcattgagtttgtgcggagctggatgttgagcgaagacgcttcagcatctaaaacaacgaatttggcaagcattcagatattccaactacattgaacaggagtcctcgtcttccgaatagataacattcacctgtagtcagtagatatgaggtaatatgtggtaacatttcctatgtggcgacggatgaaaagtcttggtcggtgtgggggcatattctctaggtgagaggttttgggccagatagagtgtcagtggggcgtggtatgtgcattacaaggagttgttgtccaacggatcggggtaatggtggacttaagaaggactcctgctcgcgtggggttaggatgggtaccatggagaaggactcggcaagaactggatagtgggccaggcgttgagaggatgttttcactccggctgggataggatagtcgagaaggattgggtccttgggaaaatattcaaggggctttgataaacgattatggcacggggtcgattgtcccgggttccttccttttaggacttgggaagtgatgattttaaacgaggattaaggcatggatggggactgaactatgttggccaagacagatgtgtctgttcctgcggcataatggcagggcatgctggacgtgaaacagtcacgctggttttcgaagaacctgggtgatgtaaaagtgtgttgattgccaggatgacaggggggacgcagattgaa

SEQ ID NO: 711443 - DNA, 298 bp, Homo sapiens
  misc_feature (7)..(7): n is a, c, g, or t
cctttcnccttttttcccaaaaaaatggatttccccaattttcctttttaggggttaaaaaccaaaaaccctttaatttttttcccctttggggttttccgcccaagaaaggggtttttgggccaattattttttcccggttttaaggggggggggggcccccccccgcccctttttttttggggggggggggaaaattccattttggcccccagggggcgggctttttttttgggtatttttggttttttggggtttttggggaaaaaccgggaattacccccccaatgttgcccca

SEQ ID NO: 711444 - DNA, 883 bp, Homo sapiens
gcactccatccagcctgggcaacagagtgagactctgtctccaaaaaaaaaaaaaaaaaaaaaaaaaaaaaaaaatttttggggaaaatttattctttgtccctcattaccctttttaaaaattattttttattttatattcttataacactacgtgtctttatagaaaatttctggaacaagaagagaagaaaaatttgcctgcaattccatgaattacacctgatagttattttttctgactgcaaattctggtcatttaacaaagatacacattcttacctattcttagcatgtattatcttatatattcttcatattctgtgtactcacattacccacaatcataaaattttccttgtgttttcccctttttctacgttgttttcccaaatgtgggcagcattgttctttaaagttttttcccgtgctctcacggcaaattggtgacaggtttcacgcagccaggtggctttaccacagtgtcgggccttgttgtagtgtcagtaaattgagagccagtttattatgacggtcatcccctcagcattctgcggggatgggttcctagacccccggggttttccaaaccccttggttgctcaggtccctgattttacgggggttgctcattgggccttttaagcctgtgcagctttcctcccagtgttccttacatcctctctagattagctttataatcctaataacacggtacgcgcatgttgccttgttgctcccctgcttgggttttccctggatcaatcccgtggcgtgtgggccccccattttccatgacccgggtggacacctgcgggcaccccgggttgagcaccgtctttactcccactatgagaccccggggccaggttcccgcgggtct

SEQ ID NO: 711445 - DNA, 825 bp, Homo sapiens
cctgtttgaatgattaagaattggtaaaatgatgatacaagtatattgtactaagaagtaattgaccaaaaacaccgttttaatgttctgctatacgggtactattttcccttcaagtggtctgacaaaggtcaaatggtacttctctgtacacagactgttaaaacacaacttaatccctaacactgttgcttacaaacaattatttccctgtgggatacctcctacttctatggtatttctttcaatggcctttgaaaaaacttctgcaacgggtttacatcccaaaaatccaacatttgtttataagaccattattttttgacgacagaaaaaaaaatgtaacctttcaaagttattccaagcccttgtttaaacatttttcccagtggaacgaaatttcgggttgacagggacaataaattaggtaataataaggttttaaacggttatttgggaccaaagaatcttttgggcacaaaggttttccttttcttttaaccaatgtggggcacaaaattaccttccaaaataattcgttaacacttcccaagaggttccagagcgccactgtggcaggcacttactcccacggatatttttaaaaccccacttggggcgcatttcgttctcacacatgagtctgcaaatcaattctctaaattaacagttggtgttccaaaaacatttgggcaaacggcatttacagcaacttttttcaccattactttttgggtcccaccaatggtgtgttttcaaccacacaaagcgggtacaacctttctttaacatttataacattaacaggactcttttttccaccca

SEQ ID NO: 711446 - DNA, 211 bp, Homo sapiens
  misc_feature (11)..(11): n is a, c, g, or t
  misc_feature (24)..(24): n is a, c, g, or t
  misc_feature (34)..(34): n is a, c, g, or t
tacgtttgcangacatagaataanctaatgttcntcaacagaggaatggataaagatgtgttatatatttacaatggaatattactcagccataaaaaacaatcttgacgtttgtgacaaaagggatggatcctagatggtgttatgataagtgagagaagttagaccagagaaagacaaatacggtacagtgtcactgatatgttgaaac

SEQ ID NO: 711447 - DNA, 384 bp, Homo sapiens
  misc_feature (52)..(52): n is a, c, g, or t
  misc_feature (130)..(130): n is a, c, g, or t
  misc_feature (343)..(343): n is a, c, g, or t
  misc_feature (350)..(350): n is a, c, g, or t
  misc_feature (352)..(352): n is a, c, g, or t
ttaaggtagagaatgggggtttccgcccatggttagcccaggctggtctggnaaagcatttttaaaacccaaaaggtttggtatttaacttaccttactaagattattgtattccgccagatgcgggtgncacgcctgtaatcccagcacttcgggaggccaaggtgggcgaatcactagagccccaggagtttgaggccagcctgagaaacatagtgacaccctctctctacaaaatataaaaaaattatccaggtgtggtggtgaatgcctggagtcccaactgttcaggagtctgaggtgggacaattgatactgggaggtcaaggctgcagtgagcccnggaatgncnaccgcactccagtctgagcaacagagactctg

SEQ ID NO: 711448 - DNA, 644 bp, Homo sapiens
  misc_feature (288)..(289): n is a, c, g, or t
ggtgctagcagccttttctctcataagaaatacctagaatatagtatagtgcaagaattggtattgtggcctttagcctgtaagattttactatgatgaagacatctccttatatataccagaagcatattggggtaaggcttacagaccttgcaagtcagtatagtgaaatattcacttctccgttgcctccgtcttctgccattataatggatcaccagtacagtctcttacttctagagccatgttgaagctttcttccccagaagttgtaatgtccttcttttnnttgtgtcgtgtcctaaaatcctactctttggtacaagatgaaggtatatgaagagataatgaaggaaacaaattcaatgtgtttgccaagaacacagtcttttaaataactcttaaagggttcgtttaaaacagtgtaataaattgtggtaatctagtacacaaagctagtaggaacctcgtttattaataatatttcaacattgagcaggatagtgctgccctctactgctcaatgttgaaatattattaataaacgaggttcctactagctttgtgtactagagggcagcactatccttcttttgcaaaatgttgagcactcttgagaaggaaaataaaggcaaagctcctga

SEQ ID NO: 711449 - DNA, 150 bp, Homo sapiens
gcaaatgccgtcttgggaaaacacccgaacgcttggtgcgaacacctgtttgccccccagtggagtgtccccgtcatgggtgccgtgccgaggcgccaagggcgcgcccacgaccggggcggggtcccttggtcgggcccgtccggttgt

SEQ ID NO: 711450 - DNA, 239 bp, Homo sapiens
  misc_feature (13)..(13): n is a, c, g, or t
ccaaggtgggagnattgcttgagctcaggaatttgagacccagcccgggtaacatagtgaaacccccatctctacaaaaaataaacccacattagttgggtttggtgatgggtgcctatagcagcagctacttgggaggctgaggctggaggatcacttgagcccagaaggttgaggcttcagtgagccatgattgagctactgcaatccagtctgggtgacagagtgagaccctgtct

SEQ ID NO: 711451 - DNA, 104 bp, Homo sapiens
ctctttcttttatagatacaacctgattctttatgaattcgttccaatgtttcatgattattgatacgtgttgttagaaaaggtcatagttaaaaatggaaacg

SEQ ID NO: 711452 - DNA, 359 bp, Homo sapiens
  misc_feature (40)..(40): n is a, c, g, or t
cctcggcctcccaaagtgctgggattacaggcatgagccnccgcgcctggctgaaaagtggaaattattaaaaagaaaaaccttgtaagttgagttcagtaccaatatgaaggaccaatgattctttttctttcttttccttttttttttttttttttgagacagtctcactccggcccggacaacaggagtgaaactccatctcaaaagaaaaaaaaaaaaaaaagaaaatttaggccaggggcagtggcttacgcctgtaatccaagcacttttggaggccaaggtgggaggaccacttgagtccaggagttggagactagcctgggcaacacagcgagacctcatatctaaaagtg

SEQ ID NO: 711453 - DNA, 1430 bp, Homo sapiens
  misc_feature (915)..(915): n is a, c, g, or t
  misc_feature (1155)..(1155): n is a, c, g, or t
ttcgctgccctcacctctagtgtattgtgtgcgaccgccctgccttcgctcgtcttgtgtgggttgcgacccttcgagagtgatgaatttgggtgggacagcatctgactggctcgttcgatttagttagtgtctcccgcaatgcgtcccgatattccgcacgggagttttttttggtgcgccttaatggcgacggggtgtgcccccgacaagttttctcacatcgtcggtgctctccgatggggtgcacttttttgtcgccctacttgggcagcctccttgtcctcagggggtgtgacccgcgggtcgtcgcccacagtggggttaaagctcgtgttgggacgccattattctcgtggtgtggccccccaccagggtttttttgtcagttgagagctctcctctgccccccactgggtggtgtccaaccagatccctcctcgttaacagagagggattctgggtgttttttgggccacacgcagggcacctcgtaagagaggtgcaaattttgtttgtgccggccctttagttcgcaaggagtggtgttcccactgccctccccacagaataggggtccgcacaccctgtgtttggccgccttcacagggggcacaccgcgccgttgctccggagagcacgatagagatgggcgcccaccgtcacggcgctgtttcacagagggttctccacgtagagagagaggttggtgaagcctcgccctactctggcccacggggagtggtcccccaggtattccacggacctatcttttaaatatgccaatataaaaagggtattatacccctctttcccacggttttctattttcccccccaagaagagtaatttggtgaaaaacaatccccacttccacacaccacagtaacgctcggtgggtttcccgcgcgcttntatatatgcacgcccacttattctcccaaagatggttccacaaccgcgttattggcacaccacaccccccaatgttcccacattccaccacgcactgtagattatagaccactgtaaggtgtgtttctcggtcccacaaccacacatgggaataattaatttgggccactataaaaaggaaagggcaatttctgaacgccacatgtcccaccacgccctcgaggtgtagatttcctcccncacaatatttatcgcctatagtgtaagagacgcccactcccgacgtttattgtgaaaatgtcccgcaatatggccaaatctgtgtaatcacgagacccaagcaccacattggtggttgcccggtatctgtgaaggaagagatgacaagaggcactgaccacgcttaaccgggagcgggctttttttgtgaaagatgatgtaaattttggaatggatggttgccccactttgtggaaataatagaaaccccatggatttaaaactttgggagctga

SEQ ID NO: 711454 - DNA, 365 bp, Homo sapiens
gtgagatatgatagattctacacgcgctagataggctcccgttgccctacacatcgcagtaattatatcagtgcgcaatacccgtagtgctcagctgcagatttctagtactcatgtctcctacctgctccaagaactatcgataactcctggagccaaggaacttaactatgacatacgcttacacaaatcagcttatatactgtaaacgatactctcttatcacggacctccactttatgcactcctctaaatgcccatgtacgaacgcccccaatacgctggagtcaataggtacattgcacgcagtaactcttaaaaaactagcgcggcctactggtactaatatcgtcctcagcactaca

SEQ ID NO: 711455 - DNA, 369 bp, Homo sapiens
agcccttgccctgtttcagttgaaaattacaaaaacttttagaattgatttctttggcccatgttatttaaataatcaaactaaatcaactctagcctgggaattccctactggggagtcgaggatgaaatgagaggatgcttttgaaaaccctttaacaagaggtggttatttatttaaaaaatttgttttgaatattccagttgttatgagcccacccttgttggggaggggctataaaaactaatttttaatgaaacataggggtaataaggcagccattaagaaaaatataaatcccaccccttgaaaaaagctggtattatagatttttaaaaaggccttcaataaattacaaactggccatta

SEQ ID NO: 711456 - DNA, 343 bp, Homo sapiens
ttttttttttaactttttattagcctttatttaagtaataaaatcactaactccttgaaaaaagtatatttatgaataaatttatctcatataaaaccattccttggcttcgatttacaattgttctattatctccttggttttactaaccacatcctcaaagaatatgaatatcctttctttacatagtctacattttagtgttttttaatcttatccacctaaatatcaataaacagcccttaaaacatttacacaaaagtcttgagggcataaataccacatttggcagttatttcctctggtgggtgaggctgagaggaagagggaggatatgtccact

SEQ ID NO: 711457 - DNA, 995 bp, Homo sapiens
  misc_feature (376)..(376): n is a, c, g, or t
ataaacttcgccttatattttaattattcaacaccctcctagccttactactaataattattacatttttggatctaaccataattcaactggctaccattatgaacataaatccagccccttacgatttgcggctttcgaccctactatcccccgtaccgcgttcacctttctccactacatacatttctctctttagttaggctactaatccgttcttactaagttctgattctaggacaaagttgccgctccttttgagcgcccttaccattgagtccgctatcaaatcatactaaacactgtcctagcgtaattagattatgtcatctccatcttattacttcatgcatccgtatgccctaagtctggcctnatgagtgtactacaaacacaggagttagatgtgtaacgaaggaaaaccacaataacatcttagcaatacaacgagcaacacaaccctatctagcggcgtgagattctcatgtgaggccattcgatgagcacttcttaacctaatagacacttaatagcgatagagtgcgagagcggaggagaacctcattttgaggcttggttgcgccccatgaggcgttatataccgttcgtgaaccctccgggagagaatatcgcggcgggactgccactaaaatagcgtgagtgttgaagggtcttgacctacacttgattcaccataaaaaacaactcccagtgggggaaaagccacagacgggtctgtatttgttaatacacatgttttgccacaccaagtcgtgagtgcaactctgagagaggggcgaccactcatggagggcgggcctcacttaattacactcaggagtggctgtgcccctaaggagagaatcctctcccttataaatttcaaatatatcaattgcccagcaggttctgtatggggggaaactaagttccattacttgtatactaatagcctcacttaccggaaaagccaaagagtctaatgacgccgagac

SEQ ID NO: 711458 - DNA, 231 bp, Homo sapiens
taggctcggaccgatctcgcggcgctgggcttacagggatcacaacagcctggctaattttgtattttcagtagagatggggtttcaccatgttagccaggctggtcttgaactcttgacttcaggtgatccgccctcttcggcctcccaaagtgctgggattacaggtgtgaaccactgcacctggcctaccttgccatttgactttacaaggcagcgacagggaggctg

SEQ ID NO: 711459 - DNA, 183 bp, Homo sapiens
aggctcccgactgccaaggaggcggggaagcctgacttggacagacacagccccctgggctgccttgcccgttgggcatctgtgcccactgcctccctgtgctgtccacctcctctgtgctgtccagtgctgtccacctcctctgtgctgtccacctcctctgtgctgtccacctcctctggc

SEQ ID NO: 711460 - DNA, 2096 bp, Homo sapiens
  misc_feature (2096)..(2096): n is a, c, g, or t
tcaacttgctgctgacaacacaggagccacaaacctgtatatcatctccgctgaaggggatcaatgggacggcctgaacagacttcccgctgctggtgtgggtgaccatggtgatggccacagtcaagaaaggcaaaccagcagctcagaaaaaaggtacatccagcagcggtcacttcgatcaacgacaagtcataccgatagaaaacgactggcgctggtcactctcttatcctcggacacgataatgcagcgagatcaatagctgcaaccaactcaaacgggcgacgcatgacaacgcgtacatggcccactaaacacgcgacccacgctaagccaaacagcgagctgccggcaaagaacatctgctagagacccccgggcacttggccaattccgaaagtgcactgggcccacgccaaataggccaattggcatcaccgtcacgtagcctcactaagtcaccagtccaggagggagacggagttaaatagacagaggacaggagaggcttaaggagaagcggccagaaagtattaacagcgacacacgaaaagacgaagaagcaagcaggaaaagcagacaacgaaagagtgcgacagagcagatgaaaaaacgagacgggcggcgcgggccgccagcgcagaggaccgcaaagaggacgagaggaagcggaacagaagcaacaaacagaggaggtcagcacagcacaaagcaagcacaacccaaagcagagagagcagacagcacacaaagagaagaagacagcagaaaggagcgcatcgcgagcgcaacccaaaaacaccgggaaggggtgagagcacagggggaacaagatcagcgtggagacgagaggacagaggtaggggcagagaaggcatggtagaccggtgaggccccaggaggtagacacagtgaggaagcagaataggaaggacacaacacagatagacacgcggcgagagcgcaacagcacgcagtgacagggcgcacgagacgaagaggcagaagcaccacggccggacgaacaaagaacagaagaggaggagggaacgacaacgcgcagggcaaggaaggaacgagcaaaaagagaggatgccggggaggagagagcggaagagcgggaggggatgaaacaaagagccaacaacacggactggagaaggggaggaggggaggggcagagcgagagcggcgagcacagcgcagggaagggagacacaccggcgaagaagagggacagaagcaccaaatgaaagggaggcgcgagcaggcacgcagtaggaaacacacagtcacagaacggagcgaagcacgcagcaatcgacgcacagaggggacaggaaacagacaggacgaggatcggaagaaaagagacgagacgaatgcactaaatcaggcgaacaggtgactcgaaatgagacggaacagatggaccgggcagggaggagaggggagcaacaaggaagcgaagggggagaagaaaggaggcacgcaagataggacgcacgcaatcagcagaaaggagcaacgggcgcgagcgagacgacgcgggagagagaggcagcagaggagggtgaaagacaagggcaggacgtaagaggcaggagaaagcaagcccaagtaagacacgccgcaagagcgcacgatgagagaggcgaaggcggacacgcgagcacaacaggcggcaagcaaggacggacgagcgaagacacagacaagggagtgacaagagagaagaacagcacagaaggagagaaagcacaggcgacagacgtctgcagagagagaagggagtggaatgagagcagaggcgggcgtggcgagacgaccggccagaacgtgtagacatagcgtaacgggagcacgcgaagacggaaaacccgcagtgcgagacacatgagccgagacacgtaagaccggacacacagagaagaacggagaacggcacgggaggcatacgcactcgagacgaagacaccggagtcgagagacgcacagggcagaatcgcgccatgaagaccagcagagaagaagtgatgtgagaccagcaagtaggcacgagtacaatcggccgggactagcagtgcagagcn

SEQ ID NO: 711461 - DNA, 488 bp, Homo sapiens
ccctgggcagcgctgggaagggcagagctactgcggataacctgcgaacatcggagcagccagaggtaccgaacgcagaggcacaacggacgcagtgcctcatatggaacatatctggacaccaactagtatccttgacagtgaatacccatgggcacctgaattacggcagaaagccacacattgtgcactatgcctcacctattcccactgaagttgagcacaggaaaagcagtcagtaactcacttgaccctagaacgatacacgtgccacacggcgagaacatgtgagcctgcctcactcacaaccccacatgccgttacaaacccacccaccaagtctgcccacaacgcacggaatgagagctacggcgaaacccctgagtaagtgcccagagcacatccgcgtggccacatattccataaaacaagaacaatcacctgacaagaaaaaccactaacacattgatgagaagtattggcacacc

SEQ ID NO: 711462 - DNA, 515 bp, Homo sapiens
actctagaggatctctcaccgcaatctggatggagttggagatcattattctaagtgaagtaactcagaaatggaaaaccaaacattgtatgttctcagtcataagtgtgagctaagctatgagtatgcaaaggcataagaatcatacaatggactttagtaactccagggaaaggctgggaggggagtgagggataaaagaatacaaattgggtacagtgtatgctgctcaagtgacaggtgcaccaacatcttagaaatcaccactagataatttattcatgtacaaacaccgcaatctaaagaaaagaaaactggaggctgtgcgcagtggctcacgcctataatcccagaggctgaggcagggcggatcacctgaggtcgggagttcgggatcggcctgaccaacatggagaaaacctactggaaatgcagagttagccgggcatggtggtgcatgcctgtagtcccaggctgctcaggagactggcaacaagagcaaaagtccagctcaa

SEQ ID NO: 711463 - DNA, 343 bp, Homo sapiens
aagcgtcccttcttcagaatcgcggtctcccctgaaattctccatcaagctcaaaggtggcctccttcgtagcatcggagcagagtgtccagcgtagggggtatctagttgagcgataccacctagtctgctcccacaacttcctcaagagcctggccctgtctacattcaccccatgtgtccccaggcaccacaatttagggccttgcgcatgtacggaatagcttaagtaaattgtataccacactaaataggacgcaacatctatctcagatggaagtagaagtacgatgatcaacttcccatgctcagacaccaattatgtatcttgtagtctggaccc

SEQ ID NO: 711464 - DNA, 124 bp, Homo sapiens
gcctgctcgcagtaattcatgctgttgctgctgacctgatggtgctgtgaccggctgtggaagccacacgtgtccgctgtggtgcgtgcctcgaacctgcccatgtcagtatcattgtgggtgc

SEQ ID NO: 711465 - DNA, 371 bp, Homo sapiens
  misc_feature (16)..(16): n is a, c, g, or t
  misc_feature (320)..(320): n is a, c, g, or t
tccagcctgcaggttncgcatttagcccaggaatcgtaagctgctgccctcacccagggctgaccagggatggacggaatcatgggccaagggtggaactgacccttcccacagtggaggacgagccccccccgaaaacagcccttttccaacacatcagcagagatgggctccctctgaggccttctccttgcagctgccagcccgtccatcccagataaaagcagacaacctctgccaagagggctgggcacattctccagaacctgaaccactggaccaggcttggagggtggggatgacgtctgggggttgaaaanttgtgagctgtccctacggtggcagttcagagtttacagttttatgctggg

SEQ ID NO: 711466 - DNA, 404 bp, Homo sapiens
ttctccgtatccccggcatcagggcgagcgtgctactcctttgtgacatgggatcatgtctcggttcgtctctcgttatggctgcattccaagggggtggagtacatccctttctatgcaggttccctgggtgcctttctccgggatctggagaactccttctcacactgtctacagtgtgtcgcttcgtcatctttcagccatgcgtgattctacaatgccagggtcattcaacgcaggtcacattaccttccttctctccctcggcgagctccccacaaggtccaaatctagaagtcaaggtttctcccaactcagttcccaacaaaaccagggcaaatcctattcttcaggcccggcaccagacccagactcaaactcaaactcagctgcaacaaaagacg

SEQ ID NO: 711467 - DNA, 205 bp, Homo sapiens
cgcacgaggctgcggcgccaggttcctcctgcactggatcatctcggctccatgctcttcagtcttcttctcgttctctttggcctgtgccaggatctcctcacgagaggcgcgcggtgtcatccacgctcgcgcatgcagtccttcatcatgggcctgcagcttccgcagctctttgatggcttcgtcccggttcttgttgggc

SEQ ID NO: 711468 - DNA, 279 bp, Homo sapiens
gtcgaccaaaggtcacttaagattttctgtaagtttttggctgggcacagtggctcacgcctgtaattccagcaatttgggaggccgaggcaggcagatctcttgaggtcagcagttcgagacgagcctggtcaacagggtgaaaccgcatctctgctaaagatacaaaaattagctgggtgtgttggtgaattgcttgaactggggaggcagagactgcagtgagcctagatcacaccactgccctccagcctgggtgacagagcaagactctctctc

SEQ ID NO: 711469 - DNA, 254 bp, Homo sapiens
ttattagaaaaaaaaagacagaatctagcacagtatataagatgtaacacatacacacacacagtcatgtgtcaccatggagtgtacttacaaaaacctaaatggtagagcccactgcacacttaggctacatggtatggcttattactcctaggctacacacctgtacagcattttactgtaccgaatactggaggcaactgtagcacgatggtctctgtgtacctaaagatttttttttttttttgaaacag

SEQ ID NO: 711470 - DNA, 158 bp, Homo sapiens
  misc_feature (19)..(19): n is a, c, g, or t
  misc_feature (114)..(114): n is a, c, g, or t
agcagctgaagcaggtggnggaggagccgtccccccagctcccagccgaccgtttatcccccgagtttgtggacttcactgctcagtgcctgaggaagaaccccgcagaggtantgagctacctggagctgatggagcaccccttcttcaccttgcac

SEQ ID NO: 711471 - DNA, 785 bp, Homo sapiens
agcgggtagaggagaacggacggggatggcaacgatggctgcaaatacagatggtgatgcggagggtgtggtggagatgggggggtgactgaagatatatgagccagcagtcatcgatggaggactgtgagtggcctgaacaggctcagtggatgaccagatagaaaatctgtgcgagatgttggagccgagtaacagtacgacatgcgatggccggtgcagtaaaagcttggctttcgttgttcgagaagaaaagctactggctatggatcaagttgtggacggcaatatcggtgcactggacggggaccaatagatgtccatcgagcgttccacgtggcatcgtatcgagcgaatagcccttcagatctattcaaagattgagatacatactggcagtcctcgatggattggaactgtgtgtaaagggggaaggatgtctgtagcctgaatcacaagacatgggtgcctaggtatttacacttgtggtcacgtgtggatataggtcatatagcagtgagtcaggaacacacctatgtgatagtgcgagggatcagtagaaagcatgggcaatgaatttcatagaaggtcggacaatgtacccgagtagaattgatgattgtgcaggaacaatgataagatcaacatttgatgatggtcgagattcaatccgattacagattcgtattgggcttaattttgcagccaaagatcatggaagccggtttgtcggttggagggacaaggaagatactcggcttttgggtcaaagaaatcatgaaaag

SEQ ID NO: 711472 - DNA, 314 bp, Homo sapiens
ccttagttccttgatgttcaactttctttgttgtgtcatacaggccctgagttggacatttctcaaacttatatatgtggtgttatatagaccttaagtccatttgtaccctggaacattttggaaattattccatctggagggaattggcagtaggctgaaaatactgactgatgcatagtagaaatctcagataatggacctacacaatgttttgttttccaaggggttataaactattggtcaaaatagttgtgtttatttaccctgtctctaatagtggtattctaatttgatcacaatctagtcaatgc

SEQ ID NO: 711473 - DNA, 171 bp, Homo sapiens
attcgcggccgcgtcgactttttttttatgttttagctcatcagctatcgttagttttactgtattttatgtgtgacctaaggcaattcttccaatgtggcctggggaagccaaaggattggacatccctgcaaagtctctgtgcttcagtttctttggctgggatatggg

SEQ ID NO: 711474 - DNA, 109 bp, Homo sapiens
atcgagatcaaggtacggtgggaggtaggtggaggttgagggagatggggtaggtggagttgagggaactgggcagggcacagtcacatccggactggattctatggtg

SEQ ID NO: 711475 - DNA, 273 bp, Homo sapiens
  misc_feature (1)..(1): n is a, c, g, or t
ntaaaaaaaccccccccaagggggggccccccttcttttttgggggggtttcgggggggggggttttttgggcctccccccccccccctttaaaaaaaacccggggggggggggtttttttcccctggaaaaccccgggggccaagcccctttttttttccccccttaaaaaccccggtttccttttggaatttttttttttaaaaaagggttttttttaattttgttccccccccccggttttttaaaggaaaagggggggtttttggggga

SEQ ID NO: 711476 - DNA, 1118 bp, Homo sapiens
cgcaggggcttctgctgagggggcaggcggagcttgacgcgaaaccgcagataagtcttctactctttgcaagatagagattaatacaactacttcaaccacaatatagtcaatacggttactaacgatcatgcttagcgcttaagctcccacaccgtaactctcacactagcttaacgcacttttcccgcacgacaaatatgcacacacttacccacacgagctagcccacttggcacggcacgcacacacaccgcactaaaacaggtcttctcttaacacaccatgaacgcgacgcgtctgacgccatcgacacgccttcctttccacttgggcagcttacaaaccacacactgtaacttccacacacgacaccactcgacgaagccccccggggaccctacccaggaaggccccccgcaactccacactaacccgaactcacgcacacggggccacacttgccgtctcaccacgactctcacccacgtggacaggagctgcacctccacacaccaggctactaacccgatcttctacgtcccccaaccaaacgctcgtaacgggctggacttatacaccaactcacacctcccgccacgtggccccactccgtactatacaaaacaacgcaccacctttcccacccgccgacaacagggtgcactctacacgacacgcacccctttgccccacatccccaatctcaaccgcccaagggccacccaaaattatgccgcgcttcccagtgttaaacacaagcccccactaactaccaacctcgccacttttcacccttaacctcaccgacacacaacccgccaccaacagtggtgcccaaccccatttcacacctgcgcgcaagctgtggtaacacgaacacgcgacaacgcaccctcaggggcaccacacccatgccccaccgccctctgacatccttccacaccaccccgcggcccgcaaccacccacactatccgggccacgcgcgcacacccacaccgcaaacaacgcacactccaccccccccaccaagcaccgaagcccccaccacacccacccgccgccccccaaccgtccccccccacacacataccaaacacaccctccccagcccgc

SEQ ID NO: 711477 - DNA, 871 bp, Homo sapiens
gggattgcttcagggcaaagaaactgttctagaactagcgaatggggggggagcaggacattcctctgtccacgctcagaatggcgctgcttgaagccaccatgctgcaaagccggatgcctcaagattcgtggccttcgcctctcctgcatcttgacataaagcgactgaggggcaaagaggagccattagtgaccaggtgctgtcgggaggcctgttcctgggaccttccattgggactgatattcgcccactggggacttgtcgccatgcaccatgagtaccggagcctctatgcctccatgtcctactgcacctggagtctgggaggtctccatccgaaccaagtgtctgtaaagatgacgtattgaggatctccccagcaaagcactcttcagaactgtatcagacaccagctgaggttagggtcaagggtgcctggggtacgcggtgagtaatcgctgcattgctaaatagagagggtctgtccacctcctctccacgtcccagaactggccccagctgcaggcactaagaagctcctcacctgagacaagtgaggggtaatcggtgaaaggcagatggacaaggggctcagggctgctgccgttccatgtacctctggatgagaagcgcgcagcaaggctgacggctgcacccttcctctcctgcaggactcactgccttgccctccatcctggccctcaggaaaggccaaagatctcaggtgactgccctcattctgttcattgtaaatacacaaccgtgcattggtacagtgggacctgctcaagcgaaatcacataccatggttcatagacctagctaacatggtacttcaaccctaccctaccccgagaagggcagagac

SEQ ID NO: 711478 - DNA, 285 bp, Homo sapiens
ggcccgcccgctccgacactgtcacacagtgtcagacagctggtcagggatatggcgtctggtggatcgtgtccgttttgatgtatacatgacggagcttggagtgggtatagctttgcgtatatatgggcgccatggtcaagccagcattgtatcatcatttgtgatggttccaatctcactataaaatctgagagccttttgaatactacacagttgtcttgtatccctgggtagagatgttggagacgtagatgccacagctgatgtggagacaatgggctg

SEQ ID NO: 711479 - DNA, 445 bp, Homo sapiens
taccaaaaaataaagaataaaaaattagcctggcatggtgatgtgcacccttagtcccagctacttggtggtttaggtgggaggatcacgggaggccatgaagttgaggctgcagggtgccgtgtcattgcgagtgtactccagcctggatgacggtgagagcatgtctcaaaacgcgcgcctgcacacacactcacacacacacacacacacacacacacacacacacacacacacacatctatctatctatctacaactagaagggagaaatgggaaatataaatataggcacaaatctcatatatgctaagcacttaacaaatatctcatttaaatcttataatacgcccctgagagaatcactgttgtcccattgtgtggaagaaagtgtgtcttagagaagtcctatatgttgcccaagggtacgcacccaagtgggagg

SEQ ID NO: 711480 - DNA, 657 bp, Homo sapiens
ccagagactgtcagtggagtggggagtgaggaggcggcggcggcgaatggcaggcgtctggggcctgtctccagggctcctgctctgccattcctgaactggtccctcgtccccgtgactctggcatcagggaagcgaactgttaggcgagaggaggaggcagccagaaccatatccccttcttcctcggggcggggtgcctgtgccaggcctggctgagcctgggggagggctccgtggagggagtgcctggccaggccggctgtctgccgcgatggatgacagtaaggtggttggaggcaaaaggtaacagaagcccggtaaacgtggtcggaagccaagccaaaatttgacttgacagcaaaaacttgagaggagccggccagaggtgcaagagactgcctgagcccgacaaacagctgagatatcagtatctggaagacgttggtatccagtcgagacacgagctatacttgtgccctcagcaggacggagcctgggaccattgtacaacgccagtgggtgccttggcacatggcgaccaacgggcagaatccctttcttgaaacttaagggccctactcacctgggagaagaagcagaacagattctcacccgaagtccaagccgcgcttaccaaggtgggaaccacccgac

SEQ ID NO: 711481 - DNA, 144 bp, Homo sapiens
gaaaaagtttcactgtgtagagaacatatatgcataaacataggtcaattatatgtctcattagacaaataatattgggcaaccatgttctaggaccttaggttacaaaaataatttcaagggtgaaatctctaatatttatta

SEQ ID NO: 711482 - DNA, 107 bp, Homo sapiens
cctggggctaaaactaatcaagatttggttcttctgtacacttaaaagtggttaaaatggtcaattttatgttacgtatattttaccacaatttaaaataaatttga

SEQ ID NO: 711483 - DNA, 428 bp, Homo sapiens
ctcgaaggagcagtgaaatcgaaacgttggccatttttatttgtattatctggggccaccttctggcgttcagagaacaaaccagccagtttgcctcatcagtggcaggttgggtgctcaggaaacttctcacggagcctctctaccctacccttccttcaacaagtacatctctttttctcttactcactctcgctctctgtttacaaatccgtttgcctagcgaatacgttttatcaattctctcttgtgatttatcttataggagttatgtttaccgtgcttcccgtttacatcaccctgggtgtgcgtgtcactgtgcgcccagagacatgatctcgtcgtcaagcagggaatctgtggcactgggctgctcatggctggcctgctcgccatggcgggtgggcgttcctgggtagggagtcttc

SEQ ID NO: 711484 - DNA, 240 bp, Homo sapiens
ctactctagaggatctcgcgaatctctctctctctcgggacaagaaaacaccagaggcaaacaaaagggctcaaaccaacaggaagtcagccccaccgcaagcctggactacaactaaatcgtgctctccacgctcaggggtgaaagccaaggctgtgccaggccttgccaagggccaagcagggattgacagcaaaccgcatacttgaacggtgtagccaatcagggtcccccttgtaa

SEQ ID NO: 711485 - DNA, 779 bp, Homo sapiens
tcccagccatacacttgcctttatttaaatcagtttttttcaaaatgcagccaaatctttatgattgggacagcccaaagtacccagccctattccatctgatttagtttcccccacagcagttaaaacccaggtgctggtttgtggtctcctgtggcccatgtggtgtgggacagcgtgaaggtgatggagggcctctagcacaaggaggtgctgagttgccaccggcaggtgcttctgcagacagcctagagcaaggataagcaggagcactcgcttcagaaccgaggcggctcggaccaaaggcaggcacttttcctccacatgtggcaaagggacaagggttgtgttctctcctacctcatggctttactaaggggtcaggctaggcattgaccgattcaaggagtgggtagggggtaaaagtggaggaggaccattgactgattgaggtgcctggaaacctgtaggggtgtaggctgcggggcccttggaggtaaagggcttgggaaatagcagggtgacacctgaatccctgagtgaccctgcagtggtttgggatgaggccagccggttctcaggcatacttggtgagctgcagccccttccagaaaggttggcttgatgataccatctccatcctgtgtcaatgcttgaaagtctgaaattccctcagctaaggaaggagagaatgtccaagcattcttgttttggtcgtccccggaattgccaacgcgttgaggggacctccggaaggtaacattataaagggcaagtgt

SEQ ID NO: 711486 - DNA, 826 bp, Homo sapiens
agcgtgctggggcaggagaatggtgtgaacccgggaggcggagcttgcattgagcagagatcgcgccactgcactccagcctgggtgacagagtgagactctgtctcgaagaaaacgaaaaaagaagtagccctcttggccaggcatggtggctcacacctctaattcccaacaacttgtgggaggctcaagcaggaagatcacttgaggccagagtttcgacaccaagccttgggcagcaatggttaggacccctatctctacaaaaggtttaagaaagtgggcaaggcatggttggcacattgcctttgagaggctgagtgcaggaagatcactgttgagttgtgccactgcacctccagcctgggcgacacagcaagaccctgtctctgaaaattaaagggggcctcttgtcacatttcttccctatcttcgataaggtagctaccctcacctctttctagttgtggtcccgtggtacttatctccatatttcaaagttaggcctctgtcgactatttcttatttaatcagtttgagatcttcagcttatggagctcgggccatggtacgaagaggatgtagttctcgactttagagcaaaatggactcaatatcttctaaccgaaaggacgttaccaagagtgtccgtggacacatgcatgtgaacacagacagacagaagaaaagtcggggtacgaaattgacgcactttttccgagcacaccgagggaaaactaggggcccctataaggcgcttcccagaacaggggaaaattatacaaccgggggtctaaccactaagtaaaggggttccgagaattcg

SEQ ID NO: 711487 - DNA, 536 bp, Homo sapiens
aatcccagcactttgggagaccaagatcacttaagcccaggagtccaagaccagcttgggcaacatagggagaccccatgtttacaaaaattttttaaaaattcgccggcatggtggcacagacctgtagtcccagttactcaggggactgaggtgggaggatcacctgagcatagaagattgaggctgcagtgagctgtgattgagccattgtacttcagtctcggcaacagagcaagatgctatctctaaaaaatacaaataaactaaaatccttggttcacactaaaaaaaaaatacaaacaaaaaaccagaaccacactaaaaagtatctaatcagcctcttgagtagtggggattacaggcactcgccaaccagaggtccagctcatttaatatttcagtagagacagggttacaccagcctgtgggcaaaattagtgagaccccatctctaaaatttaacaacaacttcgtgtgtttaacacaaatatttactttaagtacacttcatttctttcggtcctcggaaatgc

SEQ ID NO: 711488 - DNA, 355 bp, Homo sapiens
ctgaaaaaaaaccttattggctgctaagcgcaaccatgattaagtgagagatgcatgtggggatgttaacactgtcgtatttactttcccttcagaatgtctcgatgacagaatcgatccaggatactcaagtgtgcttggctcatccttgtcgaagggatctagacaagtgtgatgttgcacatactaatcacaatatggtactaattgtgtttaatttcatatgtatttagccaaagaagtgccctttctagtactaataatctatgttggggataatacattttttcacctaatagtttgagccgctattgtgggtggcttttttacttcctatttgggtaattttgtggcc

SEQ ID NO: 711489 - DNA, 1037 bp, Homo sapiens
  misc_feature (257)..(257): n is a, c, g, or t
  misc_feature (302)..(302): n is a, c, g, or t
catgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcaacattgtagaagggaacactcctgtaggcccactgggtcccttatctagnagaggttgagtgaatttgccttcagttaacatgggaccttctgtntaggcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccagga

SEQ ID NO: 711490 - DNA, 831 bp, Homo sapiens
  misc_feature (96)..(96): n is a, c, g, or t
gaaacccaatatgcggaatttcgtcctccacatgtggaaatgaaacctactaaaaggtgagtgaatttgccttcagttaacatgggaccttctgtntaggcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccagga

SEQ ID NO: 711491 - DNA, 647 bp, Homo sapiens
ctgtcctcaaaaaagaaagggagccctatctcagaacttaaagagtcctgctcaccctcatattacttctgattttttttcccagctactcaggagggcccagctactcaggaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccagga

SEQ ID NO: 711492 - DNA, 139 bp, Homo sapiens
gttttagagctgcctcctcccgttgacgggtggcaaagttccagaagctccgccactcccgtccttcttgcccccatgtctctgtgaattgggcattccctttcccctgacatgaagaagggaaaaaagttggcggccg

SEQ ID NO: 711493 - DNA, 400 bp, Homo sapiens
gaattccgcggccttccaaacatgccttccttccgtaattcagtcggaaactaacttcacctcctcaagcggtgcgtgcctgctgcttcccagcggcagcaaccggatgcaccggcgcattagactgccagcatggccgccccggacctccgactgagcagctgcgagagccggaagttgccgggcgccgggactgcgagggggccgggagttccccaagaccggaagtgctccgaggccgggagcccgcgggaccccggagcgcgcggggccggaagaggcgggcggccagtggaggtccgcagagtttgggcccaggcgagacggcagggcttaaagttccgggtgaggcgtgggtcccacaaccgcttggaatttgctcccggtccgctctggaagc

SEQ ID NO: 711494 - DNA, 110 bp, Homo sapiens
tggttaaaaccttttttataaagtgggcaaagggcgaatttggcaaaatccccctccacaaaattttcttttttttaaaaaaaaaaggggttccccctatttctttttgg

SEQ ID NO: 711495 - DNA, 174 bp, Homo sapiens
tccccctggaatccacgcatggcatgggagggaacaaggaaaacatggtatcccaaagggaactgtcagcgagagcacaaagattctatcgatactgcgagcaatatgggcgtggagtgggtgctcatcctgagactacagaatgcaatgatctgagtggttaagcataaaaca

SEQ ID NO: 711496 - DNA, 308 bp, Homo sapiens
  misc_feature (5)..(5): n is a, c, g, or t
cctgncgttgggcaaagcagatttcgagaaacccaaagttttcgcctgggaagtcccccctaaggggctgggtttgcccgtcccaaaaagcttccccaggggggggggttagaggggaaagggcccccccctgttcctcagtttcagcctggccccctcccctcctttggcctttgaccctttttccccagggggccccccccttttgggggcccccgggtttttttttccccccccccccccctcccccttgggtttttttttgttaatgttgggggggaatgaataaataaagggattttttgcca

SEQ ID NO: 711497 - DNA, 299 bp, Homo sapiens
ccccgagcactgccccccgcaagtggaaggaagaggacagtgtgggcaccagagggccctggaaacatcttaggggccccccagccatgggccgcccccatgtgcgatacttttaaaacttcaagatgggcacatcatagtcctccttacattttctccatggttgctgtcatctggacctggtttaattttcagtctcgtgtgagtagaagaggcagcggagacctctaagcatttccctcaatctaaaaattatgagttacagggcggggggcgctggctcggcgggggtaccgagc

SEQ ID NO: 711498 - DNA, 764 bp, Homo sapiens
  misc_feature (55)..(55): n is a, c, g, or t
  misc_feature (124)..(124): n is a, c, g, or t
  misc_feature (176)..(176): n is a, c, g, or t
  misc_feature (239)..(239): n is a, c, g, or t
  misc_feature (253)..(253): n is a, c, g, or t
  misc_feature (259)..(259): n is a, c, g, or t
  misc_feature (313)..(313): n is a, c, g, or t
  misc_feature (332)..(332): n is a, c, g, or t
  misc_feature (344)..(344): n is a, c, g, or t
  misc_feature (346)..(346): n is a, c, g, or t
  misc_feature (350)..(350): n is a, c, g, or t
  misc_feature (356)..(356): n is a, c, g, or t
  misc_feature (359)..(359): n is a, c, g, or t
  misc_feature (364)..(364): n is a, c, g, or t
  misc_feature (369)..(369): n is a, c, g, or t
  misc_feature (372)..(372): n is a, c, g, or t
  misc_feature (392)..(392): n is a, c, g, or t
  misc_feature (395)..(395): n is a, c, g, or t
  misc_feature (397)..(397): n is a, c, g, or t
  misc_feature (418)..(418): n is a, c, g, or t
  misc_feature (448)..(448): n is a, c, g, or t
  misc_feature (451)..(451): n is a, c, g, or t
  misc_feature (456)..(456): n is a, c, g, or t
  misc_feature (479)..(479): n is a, c, g, or t
  misc_feature (503)..(504): n is a, c, g, or t
  misc_feature (540)..(540): n is a, c, g, or t
  misc_feature (577)..(577): n is a, c, g, or t
  misc_feature (593)..(593): n is a, c, g, or t
  misc_feature (595)..(595): n is a, c, g, or t
  misc_feature (623)..(623): n is a, c, g, or t
  misc_feature (626)..(626): n is a, c, g, or t
  misc_feature (634)..(634): n is a, c, g, or t
  misc_feature (643)..(643): n is a, c, g, or t
  misc_feature (666)..(666): n is a, c, g, or t
  misc_feature (675)..(676): n is a, c, g, or t
  misc_feature (730)..(730): n is a, c, g, or t
ttttttaattttcttccaaatactactttctgctcctttctttattgtaatagtnatctgaaagtacacaaaaattaacaaattgcttttactatgcaactctgaaatatcaagtctgcctccnattaaaaaaaaacagtaactacttttataacattaaggtcaagtcatttgtnaagataatatcaactgagactttttggcacttacgactaatccattataaacaactgtcagtnttaaaaacacagtnccagtnaacgtgtagttacactgggtacagataagaaaatacaagggcagcatggtagcncatgtctgtcctcccaganctttgggaggcngnggcnggtgantcntatgnggccnggngttcaagaccagcctgaccnacncngcaaaactctgtctctactanaaatacaaaaaaaaaaaaaaaaattcgccnggngtggnggcatttgtccataatcccagcnactcagggggctgggcgcctgggnntcccttgccccccggcagccgtggttgcagtaagcnaagatcgtgctactgcactctagcctgggtgacagancaagcaaggctctgtntnaaaaaaaaaaaaaaaaagaaagaaagtncgngaagctcnctggctgtnctaaaccaaatgaatggaaagcnccaaaagtnnttttataccaagggtccatccatacaaataaacaaaatcctatcctcttctttntatattttttttcttacatttcttatacaaataa

SEQ ID NO: 711499 - DNA, 331 bp, Homo sapiens
cctccccgatttgtagatgtttggggcgccccataggttggggaactctcaaaatagggatccctcaggtgtagaaatacctccaggggggttaggagtaccaggagggctgtgtgtacgcaacttttggagggccaaaaggtttactataggaggaaggatccagtggccctaacagaaaaggaatgtatgctacgggtaccccatagggcgagtacgcacgccttctgtgggaagggcccgagcggttctcccgagacatgcgtgcggacgaggggtcacgagcgccgccttgtcgtgggacgccacttggttcacgtggccgtacgca

SEQ ID NO: 711500 - DNA, 335 bp, Homo sapiens
gttagcttgtgctagtgatgtcgtttgctggtcaatagtcagcagttgttgagttacatcttcaccaaccgcgtgtttaattaataagctgtttttccaattaaatagcatgcgctgtttatcgtctaaatgttctaaatcgacataggttttcaattgctgacttagatgactaattgtgtgtgtttcagagaacgatagctcgtcagttaacgcgtcaaatgttcatgatttcttatcttttcgtcaagattatgttatttagcttgagcgtttctttgcgctctaacttgttgaattaaatcctttacgattttttcttggctgtaatgcct

SEQ ID NO: 711501 - DNA, 256 bp, Homo sapiens
tgtgcttagggacggcgggcatggtggcctacactgtaatactagctactcaggaggctgaggcgggaggattgcttgagtccagaaattccaggctgcactgagctgtgattatgccactccactccagcctgagtgaccagagaaactcctcaaaaataagtaaataaaatttgctttcagaaagcttgttaaccagcttacccagtattaatattagagggtgctatattccttgtcaccttcaccaatgcta

SEQ ID NO: 711502 - DNA, 2455 bp, Homo sapiens
  misc_feature (1804)..(1804): n is a, c, g, or t
  misc_feature (1902)..(1902): n is a, c, g, or t
  misc_feature (1920)..(1920): n is a, c, g, or t
ggacacatgatggtggctccggacggagcccatttgcctgatcaataattagagccaagaatcagaaggagccatggggatgcaagggtgacgctggcggtgacctgggctgaacctcacacgtcatactacccagctctgctccgcatgggaagggagactgagccctgggccacgtgcttgtgcagcagagggaatgcgggaggtaacaaccagaccccagggcatggtgggaacgactggaatctaatgcttggacctgggcggttcctcctcgttctcgtttagacccgggagcctgtctttgattgcctttgcctttgaggctctgtggctgtggggctgagtggcatcatggcggctcagaaagatctctgggacgccattgtgattggggcggggatccagggctgcttcactgcataccacctcgccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctggccaaagcccacctgtgacctctggccagaagcctcccttctgtgcacaggagccagtttcacagatggagaagatgtctcagatgaagggagtgtcccctgagatatcatccttttcttctgcctcgcctgaatcccccataaacaccagatgattgagtctaccttctttccttggcccgctccctttttcttctgcctcacttgaatcccccgtaaacaccagacgattgagtctgaccttcttttcttgtccacctccccattcacaactactttctcgctcccagaaggntgatcagatattctacaatcacagagtagcaaggacgtttgagatgggtatatcagtaagaagagggcacaagaactggctctggagaccaaagcagntgttataaattctctttnctgggggccgggtgtggtggctcacacctgtaatctcggcactttggggggctgagacagacggatcacctgaggccaggaattcctgcagcccgtgaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataaataactgccctgc

SEQ ID NO: 711503 - DNA, 116 bp, Homo sapiens
gctcatatacgatcgcttttgcgatgcatcacgtttttacacgttgttgtcgtgggaattggcaccgaagacgcttgcaattcaaaaagccgaagccacgtaagacataaccgcgg

SEQ ID NO: 711504 - DNA, 1101 bp, Homo sapiens
  misc_feature (614)..(614): n is a, c, g, or t
ccccgctgcgtcgccgatgctgctggcctggaccttgcctccgtgccttgcgcccaggcggcctgccccgcctccgacgacctcaagcagtcggaggggacgcgcacttgcgcccggctctagtgacgagagcgacccctagtatgacaactggtgcgggggcgccggatctggtcgcctggatctcgtggcgcagactctgcccgtatccgtgcccatccaactgggtcaacgccgtgcgtctctcacttgtgtgtggcccctgggcgtgtcgagctcatcctcgtgatgtgctctcccgaatagggcgaggacgggctgatgatagccatcaagcttcgtcttgcgcggtcccctagcccggcgcctgggatggagttccgccggtgggcgatcgttagtgagacgtgtgtcgctagactgcttagtctccgtcgctcgtagcttgcgaggtgcagtgtgatgcgacttgctgggtcgtcctcatctgcacgtttctcgactaagatagtgccaagagtctccgcgtcacctcaatggctcattcccttggtgggctctgcatcgcggggggcccctcgatagaacccaaggcaggtagcgagctgcttttngccctggtgccccctcgcgtagacatcctccgtgcaaataatcaggctttctggtgctacctttccaatcgaaataacaaacgcccgaaaatcacccaggggagggtgcgcactttccggagcgaattactaatgcagttgaggagctcgatgccttggtggggccgccgcaattccggccgggtattgaaacgacggggtggcccccaatgaaagaaaaggttcgccacaataacaagttgagcccggccccttgtgagcggcagcagttcagacagaaacaatgtcgttggtaccaacttggggggcagacagggggggcatgacgtgagggaagcacgatgggggaagaagacaagcaaccggaagaatccaacaaggattggtgccagaaaactgtgcgtccaaggcgttgtaccgcctgggcagtgtataaaccggttgcgaagggcaaagcaagaagaatggcatgtggagggtgtaacat

SEQ ID NO: 711505 - DNA, 877 bp, Homo sapiens
ggagcgcagagcggttgggtcgtcggtgggcggtgctggttttcgctcgtggatgcggtcttcctctgggcatgctgagaagcgggcgcgcggggtcgggagaagggtggcctaaaaactttctgcgcgtgggggtggaaagaaaagtggcccggaacacagggcaggatgggttcgtaaaggttcccacccgtgtggtgggaaaaagggccccccgggaaaaaccaggttgggccacgagaaaaggcccggcccagggaaaaaaaggggggcttccctcttctttaacgcggagggggggggtgaaaaagaaaaaggcacttcaatgtcggggcattaagaggggggccccgggggagcaaccgtggtggggggggccttttgcagaagagaaaggaaattccggggacggggttatacttacaaggaaagtgtgttggaccgcggggaaggtttgggctgtcaaatttcacgggagaaagaggttgtgtgcccttttttcccaaaagaagggtgtttcgggtggttgggaagggggcagaaagaacttcggggaggaccaagggagtgatttttcacagaagaagaaagcggaggaaccactgtaggagggggtttatccaaagaagaatggctggcacacggccataattttggggtgtgtatggccagtgtttggaaaggtagggagaggggcgcataaagggcaagaacagaggggaggtgtgaacccccttgggggtggggggacgacatcatgtgggatgtcccagaaaagaattatatcttacccaaaaatctctgtggggtggtgttgcgaccataattcaagagtggcgtactataaaaggaagggaagggtttcaaccactatgtg

SEQ ID NO: 711506 - DNA, 489 bp, Homo sapiens
cccatatttgattataattatgatggccattttgatgctccagatgaaattaccaacatttagccaacactgatgttcccatcccaacacactactttgtggtgctgaccagttgtaaaacaagagccacacccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctccctgggcttgacttctatcaggataaagtgcagcctgtctctgaaattttgcaactaaagacatatttaccaacatttgaaacccctatttaacttaataatgtctacttaatatataatttactgtataaagtaattttggcaaaatataagtgatttttttctggagaattgtaaaataaagttttctatttttcctta

SEQ ID NO: 711507 - DNA, 1271 bp, Homo sapiens
gccacacgacaagtccttcagcgctggagtgtgctgccgtgcgcttacgggagcaggataccggacgggatacgcaagcgttctggccctcgaacgctggctgtgctgccgcgtagtcggggatcttgctatcgctctctctacagcctaatagttctatcaagagaagatgtagtctatgtaagcacgaagatgattgtaatcaggaccgtctggaaaacagtaagtcaggacgtcctaggcaagcggtccactactcgtaggaggtctagtcattgagcatcaaagcaggtttgacaacaccgtttatttggaccagttgacatctagcgagtcgtctatcgagtcaaggaacacttgcgctttgttgaggagcgttcgaaagcccagattcgttgtactagcacttaccacgacctacctagccaagaaaccacctttgaatagtctggagttctcctaggacgcacccttccgacggtgggcgattccaacgaagaaagcacgaacaagtatatggacactagcagaggcattacgtttccacttgcattgaaggacgttacactttgtatcatcaaaccgacgtccgacgaaagtacggagttcgcatcgcaataggggccgcaaatcgaacagagggaacatatcacacggggttacttaaagcaataaaggcttgggctcctccggcgcggttggctaaggattgtgagataaggcaccgatattcccttaggggcacctatatacccgggaacgcatcccaaggacaaacggcccgagttggaaaggttttcctttgtctacaaagcattctacaatttcacggttgcaaattgggcgaaaagaactctaaagagccgacatcaaagggcccggtagtatacggacttcaccgccaaggtacattaatcggttggcgcgccagacaggaggccggtgggacgcggccaaatgatgcaggaaccagcttttcgccttatccatacacccattgcggcgaaggaggcggcggcaggggctacacgtgtgggcggcttgataggcacttcgaaagcaagtttagggcacacaccacaatctgtggggcgacacaatttgagcagaacgcgttcccacacagagtgcatcagttgggcccacttggagtagccagaagatcgaaagggaatggacccaacgcaaacattcctttgcttcctttccagagaacaatgaaagagaaccaacacatacatattatgagaggcaaaacaatcaaacacaaa

SEQ ID NO: 711508 - DNA, 160 bp, Homo sapiens
cttaacggagcacaaaagggacccgatgcagactcaggccacagggcatgccatcggtgctgggacctgtgagcactacaggaggaaacgcgagacgtgatgaggacttggctccagagcacacagtgcgacgggcaacgaaggttggaacacgcaagcc

SEQ ID NO: 711509 - DNA, 777 bp, Homo sapiens
  misc_feature (445)..(445): n is a, c, g, or t
actagctgctcggggagccgggcatcaccgagtcttgggggccggaggcatacactccagacggggaaagccgataagtttccactggagatcactatcatggccgtgcagtttgacgggggcgtggttctgggggcggactccagtaatcaaccattgggtcctacatcgccaatcggagtgactgacaagcgtgacactctattcacgaccgtagtttctcttggttgtcagcctcagggcgtctaggcttggctgattactccatggctagtagcattgattgcctgtcgagtctaccgaggcttcgggtttccaacagcgatttgaaagcgtggaatagaggcctccacttggtctcacacaagctaggcacagccttcctttgaaggagatgtgttgacgcgataccagggaagacctggatggcagtgcgcaatcatcnatcgcgaggcttgggacccctcgaaggaagcgacgggcaggttgtacgtcagattgccgtatagggagggtattgcatgggtacacggcagtccttttggccattggatgtgctccgggggaggcctcccgtagcattccgtatcgggcttatggtgtgactggcttacgctaacccgggcgtaagctcaatggatcccagaggcaatgaaaggtgtacttgccagagtgtccaacttgtcccagattgcctcctcgacttttatgggccccattcggaggccggggaatggggcttccccagtgggcaaggcaggttgaattcctggcctg

SEQ ID NO: 711510 - DNA, 214 bp, Homo sapiens
gaagtaggcacaaatgagctgttcgctactccctgacaggagtgagctcacagggtcgcgtagagatgcagtctcacaggatccccaatggacggatgtcatgaacagagcagcacacttagcccatgtgtaaataaaatctaactctcatttgacaagcagagaaagaaaagctaacttcgcagagaagcctttgatttgtggattgtatgca

SEQ ID NO: 711511 - DNA, 1639 bp, Homo sapiens
tggaaaaggttaaataaatcatttataatttaaaaaagggcgggccctatctttatctggaaaaggtggacaaggttctggggggtttttaaaggtgggcaagagatttctattttgggtgtggagccttagaagacaaaacaagggaatctggtgaacaggtttccgccattttctcttaaaactggagatgtacactctattttataaaatatacatctttacactattttttcaaatatttgccaatatttatcagcacaacaccgtcccctaatatcacaaatataactaaagagagtggcgaatacggttataaatattaaagaatgtttgggcgacaccacactattatattacccaacacattattacaccttttttatatgtgtgtgacacacgctttttgagatacatatgggtgagaaatatatattttcttcacaccaacacgtgggtgtgtatataaacatgtgtgcggtggagaagtccacatatcctacacgcgggtgcgcgatgtgtgtgcgagcgccgtgtgtgcacacttcgggtgctcccacaccagaagttatatgtggggcgcctacaacagagcaccacacaacacacttactgagacaaaacacaccaacacgtgtggtgcccacacattattagacgcagacgtcttacaacccaaaagcaccactagttctcgttcacaactatttttcaccaacaacaaatcacacaacacaaaacaacaacaagagcagcggcgtttctatactctcgacgtctgggcaacgcgaggcgtctcacactgtgtggcgccacacgtaccaggatacaagacgacggccagttcttgtcgcctaaacctcttgtcgtcgtccccaccacaaccaagagaagcaaacaactcttcctcccacaacaacattttggtggcgccgccgatgacgacagttctgtgggggcaagaatattacaataattcccgcccacacatctgtttagttaatattttactattggtaactggttacaaaacaacaacaccaaaatttttgtctgtgggtgcttctacaaacaataacagaatatgacatcgtccaaacagtacgaggaccccagcagataattaggtttcattccccggggggggcaagctcaccaaaaaaaacatggcttcttcactgatgtaaaacaagaagggagcaggaagggaggcggccaacaaaacaaaacaacaaagtgggcgcgcacggggagacaacacccaccgccggcaaccatacaatcctctctaaaaccacccacgcaagcaaacagacgcatcgaccacaccgcacgcaggcaccgcaaacacaacacatacatgaggcggccacgcgcgagcaccacaccccagcacaccaaacacagggggcgggcaccgaaagccccacatacaaacccccgcgtcgctcctttttcaaacaaccatcggtcgcaacaacacagctgctacttaaacaaaaaaacacaacgcgcggcgtccaacagcggggcgtcccccacacgccaccatcttcgacgatacgagaacagaaccgcccccaaccacgagcgagaccagcacaccgcgcgggaagcacacacgcgcgcgaacgacaac

SEQ ID NO: 711512 - DNA, 117 bp, Homo sapiens
tgctgggattacaggcatgagccaccgcgcctggcctatgctttttatttatttatttatttattttaattaaaagcacttcacgccctgtgattgcaagctggagggggccgcgcg

SEQ ID NO: 711513 - DNA, 642 bp, Homo sapiens
  misc_feature (506)..(506): n is a, c, g, or t
catgagccggccctgatatgggcacagaaatcctgtttatcagagttgactggcttattggattctcaagataagcgtaggttgagtttcatcacgaaaagatttgtatcgtttgtagttctacaaacccccaactttattgaattccgctctccggggcatgagtcagtcagaattgttggagacaaaactatgatggtctcttccgttccgccagtcgccgcttcacttatcgccaccaccgaaaatattttgcatatcgcacctgcgtcgagaggctggaaggctgacgcacccagcaacgtagtgtttatccctccgacattaaccaagcaagctctgcttatacagattggacttctgcggccatcaacgatcattgtcgcggaaatttctgtgcccatttcaaggcacagaaatttgcagatgaggaaattgaggcccagaaattaagtaacttgctgaaggacagccaactagaaagtgggagaacaaagactccaccntggcacctgggctccagagttcaccaatgaattttcaaagacagatcaacaccataaacagcactcatatgactccctcagcatcagtcccagccgatgcttctaagcaggtacatgaatttcatgtcccaatatc

SEQ ID NO: 711514 - DNA, 659 bp, Homo sapiens
ccgggttcacaccattctcctgcctcagcctcccgagtagctgggactacaggcgcccaccaccacgcccagctaatttttttttgtatttttagtagagacggggtttcaccgtgtttgccaggatggtctcgatctcctgacctcgtgatccgagcggcgtcggctgcgaaagtgctaggattacaggcgtgagccaccgtgcccgggcgattgtagctcgtttttaagggagtaattaggttagcaatgtagtgcagggacatttgtatatttgggatctgtgctgattattggaatggaataagatgtcaacgggggagaggggtgatggggtggggggtgtgggggggggtttatacgagtggatccttatgactatgaaatgagggaagttggcttggttatagagcgagctggtgagaatcatctgtctgctcttatttggatcatgagtggtgtcattatgcagggcgtgtgcagatgatccagttgattgcctgtagactgtgtggtttattttaggttggtaggaatggtgtccgagctttgggaaggagggagattggcatggcatggctgtgtgatcagtaatgttcgtgctgggtgtgggggtgtgaggtgagtggaggaaccggtggtggtggggggtgtggggg

SEQ ID NO: 711515 - DNA, 481 bp, Homo sapiens
  misc_feature (345)..(345): n is a, c, g, or t
cagtcagccggacccagctctcgacgcaggtgcgatatgcaccatattttcggtggtggcgataagtgaagcggcgactggcggaacggaagagaccatcatagttttgtctccaacaattctggctgacgcacccagcaacgtagtgtttatccctccgacattaaccaagcaagctctgcttatacagattggacttctgcggccatcaacgatcattgtcgcggaaatttctgtgcccatttcaaggcacagaaatttgcagatgaggaaattgaggcccagaaattaagtaacttgctgaaggacagccaactagaaagtgggagaacaaagactccaccntggcacctgggctccagagttcaccaatgaattttcaaagacagatcaacaccataaacagcactcatatgactccctcagcatcagtcccagccgatgcttctaagcaggtacatgaatttcatgtcccaatatc

SEQ ID NO: 711516 - DNA, 103 bp, Homo sapiens
aaaaaaaaaagtaacaacgggaaggttagggtgaccttactaagtaaaggcttttgggggaggattgaaggtggaacccagggtgcagtagggtgaggactgg

SEQ ID NO: 711517 - DNA, 211 bp, Homo sapiens
agacgtcactactctgggggccatccagactgagcttatcttgtctcttcagttcatctcagaatttctcaggatagaatatcgtttacttgtgataatattgagagttacatcatattcttttacttcgcaccatttgcccctttagttgatcctacctttttttttttaaatttcctgaccttcttaaggcacattgttcagcgtttga

SEQ ID NO: 711518 - DNA, 206 bp, Homo sapiens
agtgtcttcaagacaggaagtaaaatatacggctaggttcactaagttggtttgatagtacgaagaaggagaagattggcagcatgttgaaattcccaaagacgtagtgtcctccaccaccatgtttcaaaagccttcagcagcctcgtcccctcaccagcaaccacatgatttcctatccctgctctaatgaaggaactacatac

SEQ ID NO: 711519 - DNA, 130 bp, Homo sapiens
tgcaaaacggtcatcgccattgatgtggggagccaggatgagatggacctcagcacctacgggaacagcctgtccgggtgatggatgctgtggaagcgggctgaatccctgggctgacaaggtacacggt

SEQ ID NO: 711520 - DNA, 139 bp, Homo sapiens
  misc_feature (96)..(96): n is a, c, g, or t
gggaggtagaggctgcaaggggctgagagtgagtgttcggatggtggcaggagaccaggacagcatgtcatcatagaagtcaagacggtaaagggnttcgaggaggaagggcaggagattagcagtgtcagccctgaga

SEQ ID NO: 711521 - DNA, 920 bp, Homo sapiens
gcgctttgctgcatgtcgaggggcgtcaagactacagtgcatcccaggcagttcttagtgtggaccagtgaaatgtgtcctggtttccttctacttcgggcgaatcatgcatgagagcttcactttcgacagagagagctgcacatgtgtagccacagagccacccgcgaggcatcacatgtatggcaagataaagcaccaaagggactgacctcgcgagctcaaagattaaggtggagccaactacagccgttactgacgaacacggtgttctctctaaaggctacgaaggtatatcagttcactgatgaggtacaccattgtgaacactcctcagactcacgatgttcatgcactcacaatatctagtcactgccaaacagttgacttctgactaggacacggactttgtactggaagttctacaaatagccaaccaaaaggtgtcattggagatccatccgtgcaaacatgcgcaaacgttgatagtagaacgctgcgagtgcagcatgcgtgcagtgtacagaacccaaccctgatgagcccgctcatggcgtgaccatatccgtgcagcaatcctacaatataataagccagccttcctcaagaatgccagacagtggacagagaagcatgcaagacagagaacaaaaggctgatgaggaagagatgcttgataatctaccagaggctggtgaactccagagtacacaacgtctaacagcagataaaggaaggccagtcagctagtaggcatagaaaagaaatttcatcctgatgtttaggggactcgtccatggcttcatcttaagttaatgtgttcttagccaaggtgatctaagttgcagtaccagtgaattggtctttctaaatatatttgatgacataatttgctgtgaagactgactttatcttgacag

SEQ ID NO: 711522 - DNA, 126 bp, Homo sapiens
gtgctatagagagaaacaatacaacatcaccagcacttctctggtttagagtgctcttcaaatgcctcagcattgataacactaaatcttttccgttctctgacctacgcaaggatgtgcctctct

SEQ ID NO: 711523 - DNA, 826 bp, Homo sapiens
  misc_feature (109)..(109): n is a, c, g, or t
  misc_feature (298)..(298): n is a, c, g, or t
accacgcgtccggttgtttatcacgacctcaactcagtaaggcctgagattctttcgaaaaggagctttgcttcccatgacgcagagggaagtgtcaactgggatattnctggtaaaactgaaagcaagaaaagcaggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacanaaacagacacaaaaacagagggaaagagcgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaaagaggacacgaagccccagggctgcatgtatctaccaggatgtacaatcaaggagatcgcacaaacccagaagaagctgggaagttgtctttgaacatcattccagcctcatgggaccagaatccgctgggacaggactcctatgttctcatggccagctctcaagcggagatggaggaatggt

SEQ ID NO: 711524 - DNA, 786 bp, Homo sapiens
ccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaaagaggacacgaagccccagggctgcatgtatctaccaggatgtacaatcaaggagatcgcacaaacccagaagaagctgggaagttgtctttgaacatcattccagcctcatgggaccagaatccgctgggacaggactcctatgttctcatggccagctctcaagcggagatggaggaatggt

SEQ ID NO: 711525 - DNA, 981 bp, Homo sapiens
gcccagctccggtcccagccccggtcgcccggcgtcgcttcggagcgcggtggtagctgactgcgccttcacgatcgtgggacccgcgagccccgacgcgttatgaacatccgcaatgcgaggccatgaggacctatagtgaacatgctagcactgcaacctcctctgcctgacccgagaactaccagatgaaatactacttctagcatggcctttcctggccccagctctcttacattgctgaggacgagaatgggacgattgtggggatatgtcctggtcaaaactgtgcagatgaggatccagtagtgattgtgccccatggatcgatatcacctcgattggtcagtgaacgcgttcccaccggacgccgtctggtctgtgcctctagaacactgcatggtacctagggcctcctcgtagcccatgtatagtagtaacttcatagtagccaatatatgtctccctgtcatgtctcggaagagtaaccgggtcggcctgcacctcgtattccaacacctctcaactttcagatcagtgaagtggagcccaaattactagtgcatgatggggaggacgcctatgcctatgaagcgggactcacatcagatgggcgacgagctgaggcgggacctgtagctgacagagaagggcaggcacgtggtgcctgggtgccaacgagaacaacgtggagagcaaaggcaagtcacctccgagctcaagagagggctgtcgcgaggagaaggcctggctgccgaggatagtggtggggacagcaaggaacccagcgaggtcaggagatcccagagagcacggctgtccaggacgggtcaaaggcctccgagtacagctcctagaggcgtgcccagttccctccttacccacgaggttctcattgattcgtccgtggcccgcgactacactttgacgctgggctggcattggccttcaagacacttgcaacctctttccgggtgacac

SEQ ID NO: 711526 - DNA, 1194 bp, Homo sapiens
gcccgggctgacagccagagagcacaggggctcagctcctgggagagtgagggttcgaagaaagcgggagggcatggcctgcctgcgcccgctggtctcccattacgtgtcgcgttcctgccacgcggtgccccggcgaggccgttggtcgaacggctcctgcgccgggcagagatcattgtgattggctctcgcgagtgggcgtgcgtgctcctgtcgctctctctatcgcccagagctccgcttctaatccgctgccctgtcggttcacgccactccgatgtgcttgggcgttcgtacctgactcaggttccatccgtggagactggacaggcctatgcaacaaattctgtagccattgcgtttatatccttgagcaggacccgtgttgcgcttatcttgctagtagcatggtggggaaacctgtattcctggtaccacgtgcatccgatatccccagactatcccagagatctggtgacactgatcgccggcggtcgtggggcatcctagcggccttgacgcctgttagtcatttccaacggtaacgcgagaaacgacggggagcgggaagtgcatttggaccgctaagggtcatgaagagccaattccgggaggtttgcaccattgccacggataggccttcagcggcccctggtccgaggtttcccttgaacgagtgccctatattcggcgcttgtggaaaacgtggaaatacccgttcacggcatgcgttgaatcaggtggcgcagggtcgaaccggttagcttgggccttgggtcccaggggtccgctttagtgaagttcaggcgggggatgccctcgtgggcaggcggagccgaaccgcttggtaacgaagtgcccaccaaaatcggaaagggggtccctgtaagctgagaaccaaggctgtgacccttagccctggatagagagcaatcccaattgaaccgtggccggggaagaaatcacagctggaggactcgaaaggggggggcaaacagcggtgttgcaagcgcccaaggtgtttgagcccggtggcgggcggggaggaaaccacgcggggcccacggggctcacacggggtccacccgcccgggggaaacccgagaaacctggagactcgggagggaaaactccccatatgtcacggtggcgccccagaaaaggtgcggcacgtggagactccccgtcaag

SEQ ID NO: 711527 - DNA, 116 bp, Homo sapiens
  misc_feature (48)..(48): n is a, c, g, or t
gtctgcagatgggcagaggtcctcctcactggtgggcaggaggcagcntgctgcctgggcagatgcagaggtcaggtgcgccagcatctgttccacttgggccagctcatcggcac

SEQ ID NO: 711528 - DNA, 274 bp, Homo sapiens
ccagctggtgtagagtatcgctagagtagggagagagaaagaggtgagaccttaggaccgagagcagaggaggtcagggtgggagtaaagatgggaaaagtgattccgctgaggagtgagggagagagaagagaggtgagacctgaggaacgagagcagcaggaggtcagggtggggagggaaggtgggagaagtgattccgcctgagagtgagggagagagaagacaggtgagaccctgaggaccgagagcagcaggaggtcacggtggggag

SEQ ID NO: 711529 - DNA, 709 bp, Homo sapiens
  misc_feature (709)..(709): n is a, c, g, or t
cgacgcaggcctgattttggagaaatctgcgagactgagtttttcaccgcaagcgagatggagagattgcgcagggccatgatcgaccaaggtactcccggctcatcaagatcaagtcactgcctatgacggaatcatcgaccatggctagcaatgtacgagcctccatcgactatgcactagtagtcatagtgcaccagcaggatcagacgctgatgcgagagctgactcagaccctgctaaacgatgatatcagagtcaacagtgtttctcgtgacagtgggtgacaatggctccatagacatggagcgcgactgctgcatagtagtcaacatgggcacgcgctaaaccatcctggtgcgcaaagtctacagcaggcccaagagcctgatgccccgcactatcccatgaagggtgcgggccgttacagttctgcgctgcaaggacccagcggttcaccaattgaagctgcaattggttcacccagttggcctaacatgctgttcaaactgtttagtcaccgacctgtggttcacctcaagaattcgggaaacctacaacctaggcaagtttggcacagcacccttggaatattgcctaggccacatttgtcacacctcagactcttaagaaacggtctcaacttcatgatacgagataacgacaactccttaagggcgtactgtcgccccgctagaccagttctccn

SEQ ID NO: 711530 - DNA, 394 bp, Homo sapiens
tcatcgagctcggaccagtctgttctaccatgatgatcccgatcctgtgttgaatcacgctaatgtgtgtgtttgcgttctttgttttctttttttgaggcggagtctctaacccaggttggactgcggtggcgtgatcttggctcactgcaaccttcgcctccccaggttcaagcgattctcctgccacggcctcctgagtggctgggactacaggcatgcgccaccacgcccggctaatttttgtactttagtagagacggggtttcaccgtgctggccaggctggtctcgaactcctgatgtcaggtgatccacccacctcggcctcccaaagtgctgggattacagggatgagccactgcacccggccttgtgttttaatttttaacaaa

SEQ ID NO: 711531 - DNA, 608 bp, Homo sapiens
gaaaactgacatgatggcaggtgtggttgtgggcacccgcaatcgctacctactcaagaggctgaggcaggagaattgcctgaaccctggcggtggaaatcgcagtgagccgacatcgagtacattgcactccatgcctgaaacactgacacatagaggcacggtacagtgctgagactcacagtagattggcccctatatcctagagctgagcgtttcaacttgtttggaggaggtggcggtggcagggacgtggacggaaagatgaggcataggtgatagcacatggaacataacaggagggactggctcaccttggcccaaacgcagcacagcaggcccggggaaagggtgggggcaggaagcagccggcctccctctgaccctccctgtcgccttggcagggcccagacatccaaatggtcacttcccaacctcttcagaggtcaggaagcggggaggggcaggggagagcggtcatcaccacagagaacttcggcggagggagggcagagcattatgacagaggctgaaatgcaagtctggtggccaacagaacgtagcttcccaacttctcccttcgctggtctctagggtctcacagccac

SEQ ID NO: 711532 - DNA, 677 bp, Homo sapiens
  misc_feature (14)..(14): n is a, c, g, or t
ccgcacgagctcgngctgcatttcttctcgccccttaaaatttagtatgatagcggattttatagatggttttaacgaattaattctgctttctaaatacccccgccacagcttcctaaagacctatagctctcacaagtaaagcacgtccttgtgcaccaaagataagtaaagcactggctctcttgagcgctcataaaaaatgccgcacgcttgagcacccttgtcactccatcctcctcataacagcccataacacccccccctgtggttttcccgaattttcgaaaattcatatggtgccgcgaccacccctgctccaccacttaacaccttttaggcgcccccgcgacaccccctcacctttacactaagttcccccctccctctaaacccccccgaattacccccctccccccccaaagtcccactcttttcccccttttaaaaaccccctgggggagttccaaatttaacccccccgtgggcccccaacccctccccccttaaaaaaccttttcctcccccccccctccctccaaaaaccccccccctttcccgaccccccccccccccctttgccccaaatttctcccctctttaacccccccactttcttttctcccacaccaaacccctcccccctcccaacccccccgccccggcccctcccccct

SEQ ID NO: 711533 - DNA, 854 bp, Homo sapiens
tttcaaaaggggggggtaataacgtgttgttaaacaactatcggtgtgcgcagacaaacgatgggccaatgtccctagcgccctcccctcttggaggtaacgttcaggttcgtttcccccggcgtcaaagctgagccatgggtatggaaaggaggactcccccgttcgtggctagaagcgtggcttccttgttcccaggattatgcctaccgacccttagtttggtatcaggtgtgccaaccccgcagttacaatctggcacactctcatgttgtatataataatacttcgcgcccatcccctgcgctgcgcgcgcacgctcaactcgccacgctagaaaagggctttcaggtgaataaggggttctcttaaaggaagcgcgttacagagaagtggatagtaccaactttttattaattctatggatacacacgctgactgagtgccccgcaccccccccctcctgctctcgatggttctctgtccatatgaattttagattgcttcgcgcgccctctcatctcgcgatgagtggactatattattgatcggagcctttggagtacaccgcccaccccctctcgtggatgtttttatcttcttcgccatcaccctgttattattttggcacacgaacgcttgcgcacgtctgggtgtattgaaacgcgaacctaagaggaccgcgcccctcctatcatgtccctccacgcctcttagtcccaccctccactctctctctcctaccctcgcatatagagaacctcactcgcccgcacattttcattgaagaaaaaacaacaataacgaaatgaagagacattaatatcaaaaacgaaccaataattagacacaaa

SEQ ID NO: 711534 - DNA, 849 bp, Homo sapiens
aggcaagcgacagaaaagggggcggtcggatctcggattctggaccaaggggcgcgccgggggtgcccgagagaagcgcccaggggcgacgccctcatgggcagagcaggcttgggagggaccgcagccgtggggcaacaatttcaaaggggcaggggaccacatgaactgccccccaaaggtggggcgaggcacaccccccccggaccagagacccgagatcttggggagaacccgtgttccccagggaacgcagacaaagcagtcgaaatcatggctgtgggagatcaccgggaattcttctggaggatagaccactcttgaggcgtcgtgcaccatgttagagtccccccgaggtgttttcctccggctcccaaggtggagtgagaactgtacgccacgttttacaggcgtctactctctctccccaggaaggagctcgccccacgaaaggtgggcgcgcctttgctgctcgctacctgtcttagagcacgggagacacgaggttcctaaacggcccaagtagcccccctactgggaatcccaactaccaaggtgtttagagaactttcctagctttttcctatggagcctcccaccacccaaaggagttacccacattgccaaattaataaggtgaacttttgtatcaacgaaggtcacaattatgaaagcaccctcagaatttttcaacattaaagacgaaaaaattttttggggtttctctgccccacaccaagttaacatttttttttattttggggtttattatttttccccccaaaaattggttttatttgaggaccccaagtttacgtttccccaaaaaaaaaaaaaatttcccacata

SEQ ID NO: 711535 - DNA, 106 bp, Homo sapiens
aacgttggaaaaggggtcgggctttggtgattagggagtatttccccttggtcgttcactccaggggtgtataaaccctacaattcattccccaggacttggtgtg

SEQ ID NO: 711536 - DNA, 815 bp, Homo sapiens
  misc_feature (161)..(161): n is a, c, g, or t
  misc_feature (242)..(242): n is a, c, g, or t
  misc_feature (335)..(335): n is a, c, g, or t
actgtgatggtcactcatgatgtgcacatagcgatgtgtagttatcagcttcagtgattctagcatcaccgacgtacatgctactagtctgctgctagtcataacaacagtcgtcatgcagctatacggcatggacatgactagtgacaacgtctctaagntcagccatacacgcagcagcatggtgccagaaggactatatcgcgacagctcattctcgtactgtgcgttgtagacaccanatcatacacatgctactgtagttgagatacatcgggcataggctacctgtaatagctaacagtgtacatcgatgcgagatatatccatcatgntctacgatacacgtccatgcagtcgttacaattaatgtagagactagatagttgcacacatggctctgggctatccatgtcgtagagtgctctatgtactacaattctgatttgtgacagctggcagtgctatctagtaccatacagtctgagtctacatgatctacagcacgtatgcacacacagttcctagagtctgattacgtgtgtcacactgtctgatacctgatacctactggctgatagtacaagacaggacgataatgatacagtatgtagcaggctctctatctgtatcgcgtgtcttatctgacttctacacattcttgtatagtggatgaacgattgtatgcacagtgtcacacgcttcgccagcatcgctcatgacgtcgtcagctattactgatcgtctcgcatcatctcagagtacagatggttgctcatagatgatgttctatgtagctggtacgtgtgtgactt

SEQ ID NO: 711537 - DNA, 102 bp, Homo sapiens
atgggctgccacaccccagggtctgtgcagtatatctaggctgttcagtttcccagcagcagatcttttctttctagctaattgtctgtggatcaccaccca

SEQ ID NO: 711538 - DNA, 706 bp, Homo sapiens
ggttaatactagttgtgaccttagtgtttctagtgcatggtggcaccagcgaagggagtgcgagtatgtgtttgtcgtgtgtgtgtgtgtgtgtgtgtgtgtgcgtgtgtgcacgttatggtgtgtctccctctcactgtctgagagttgacgttgtagcagaggggccacagagagaagctgtggtggtttatacctttgtgcaaaaaggcagtgagtctcgtagaacgcctggaagttggccatgtgtcttaagagtggctggactttgacatgtggctgtgctgaatacagagacaggacaaagggacgggagaaagcatcatgtgctccagtgagtctacgacactctgtctgccaagcaatagatactaatacgcccgcgattgtctctgctttctcttctgcaagtgtagcatcactgctttgagacaagagagaagccttccctctccccacacccctgtgtaacttgggtaggactgggaaccaggggcaccctacaaagattgtcggcgcaagggaagtcacacgcttcaggatggagcggatgggcatataatcgagcacgacatctgagctcatcattctgcctctctttgcgtgctctctccccgtcgtgcccgcaccacaccccgggaattggcacatagttcctcttgggtgtgcacatactgtttgacgaaatacgaggagaagaaagagg

SEQ ID NO: 711539 - DNA, 145 bp, Homo sapiens
gtattccctggcgacctatcgtgatctgcctgcccagcgcattcggagactgccgctttactgatctcggggtgccccgatcagcgctggctgagttgtgcatcagcagttgcacgtagagtgactggttctgggtgtcatcagc

SEQ ID NO: 711540 - DNA, 518 bp, Homo sapiens
  misc_feature (9)..(9): n is a, c, g, or t
  misc_feature (41)..(41): n is a, c, g, or t
  misc_feature (50)..(50): n is a, c, g, or t
aaagacccnaacgaaagcgaaaagttgttctgctaaaaccncacgaagcngggggccaaggaggcgccatttataaggatgggacgggagcacccacaaactgaaagaaaaagcgaaaaaaccgaaaggtcgcggctttggctcccaaaaagggtccccaacgccgatgcctgaagattatgacaacgtggaacaagatggcgatgaacccggaccacaacgctctgttgaaagctggaatctctttgtaactggaatccatgaagaaaccacccgaaaaaacatacacgacaaaattccagaaaaaggggaaaataaaaacattcattctaaccccgacaggcgaacaagataactgaaggggtaaactctagttgaatatgaaacatacaaggaagccccagctgctatggagggacccaatggccaggatttgatgggacagcccaataagtgttgactggggttttgttcggggcccaccaaaaagcaagaagaaaggtggccgaagacgcaac

SEQ ID NO: 711541 - DNA, 172 bp, Homo sapiens
gttattcatagttcgagccctttgctgtacagcgagcagaagaaatgcatctgttacataaatgagagaaagctattatgctgatggagcatgctttttagatcctttaaaaacactcaccatataaacttgcatttagagcttgtgtgttctattgttaatgttagagata

SEQ ID NO: 711542 - DNA, 829 bp, Homo sapiens
gcttagtgctccgtgcgtctgcagtgtgtcgccgagctaaccctgtggctagtgctgagtggtggctggggcggctggcaccatgtctgaggcagtgctgaacctgtggcacctgagagcaagaaaatggtaacttggagctgctgtgacctcggctgggctggggctgaaatttgatgtgctgtacatgtggaatggtgtgccctgtgctgcctgatgctgcggagggtgcgttgtggaaaatgggccttccttgtgatgctctgtgcaagggggtgaatgcctctttgcttggggtcactcctggggggcggttccaagtgcatgcgtagatgggtggaccctgtctgggagcgaatgttcccccctgggagggactgaccccctgccccccaatgggccttgagttgcaaagctcttgtccctaaatgccaagcaaagcaactggactgaggctcttgagcttcttcaaccccttgaacctattgtggttgcccttgggttcagcccgcaggcttatttgtaagatgcgagcctatttgaagaacttgacttgacacgattgtagaaagtaaacaccatggtcttgggaccagacacgactgggggcttttagaccattttggggcaggttccctgggccttgaattttggcaatggattttcctttggggcattcgggggtccagaaaattggttctgggggcaggcgtgcccaattgcacctttttactggtggggcaaaaccttggctgggcttgtgcaactttggccaaatggtttgagctgttcccaaaggaattggtcactttggggccgtcaacttacc

SEQ ID NO: 711543 - DNA, 508 bp, Homo sapiens
  misc_feature (68)..(68): n is a, c, g, or t
tgcacaaagaaagcttagcaagaaaacaattatgggatggacttcaaatgatctccaaatggccatanaatagagatgtagtcaacagagaggcaggagaaaaaaaaattaacaaggttttgtttgctaaaatctaggattcatttgattttaaagctgtgtgacccacttccattctttctcccttccatcagctttctgcacaaaccttttgccaccctcatttttaacatttgtattcctcctctactgcccagagcctttctactctgtgttctccaattcatcctaaaatcaagaccaaggtagaattctcgaacttggcctattctgaaaaaaatggacatggctgggacagagagcttgtgtgaatattcccaattggtaaggaatgagtttgcacactcatttattctgccatcaagcatttactggctgtctggtttgtgcctgaccctatgcacttccttagggaatggaataaaaaaaaatacatgatcttctcctt

SEQ ID NO: 711544 - DNA, 135 bp, Homo sapiens
cacgaggacagtcatcggccggaggtatttctaccacagctcccagactggggtgtaagtggatccagctccattgatgggtggcatgctcgcacgaggtacatcacattggaagtccttcttcaccggaaaacg

SEQ ID NO: 711545 - DNA, 312 bp, Homo sapiens
caggaaagttgaacaggattcaaacctaattacaaaatgtagatattaactgtcattcaaatgttcattagcctctagaatcaacttcatttcagccggatgcggtgggtcgcgcctgtaatccagcactttggtaggctgatgtgtgtggatcacttgagatcatagttcatggccggcctgttgaaaccctctctctactaaaaatacaaaaattggccaattgtggtggggtgcgcctgtggtcccggctactcgggaggctgaggcaagagatttgcctgaacccgggaggcagaggtgcagtgagcc

SEQ ID NO: 711546 - DNA, 479 bp, Homo sapiens
aaatggttaagtagtaaatgtacattgtggttttacatataatttcagtagcaacaaactaaacaggctgactgatatgaagacttatcaaatgagatgtggatatttcaaataaagcaaacgccttttatccataaaataaaagagtcctttaacatgctgttttaagctggggagaaaggaagggaaaaagaagaggaaagtgtgcacagatgaaactattttattattctgtgctattaaatacaatcatttcattctaccctatcctatcctattctatcagcttgtaacatatagtttccttcagcacctgtgggggttagttccaggacccctatgaataccaaaatccatagatactcaagtctcttatatagaatggtaccgtatttgcacatgacttatacatatcctcctgtatgcttaaagtcatttctagattacttataatacctaatacaatgtgaattctatgt

SEQ ID NO: 711547 - DNA, 732 bp, Homo sapiens
gggccttccgagccagctgtgggctgcgccccacgccagcccgcgccccgcatggctgccgccggggccaggcctgtggagctgggcttcgccgagtcggctgccggcgtggcgactgcgcagcgagcagttccccatgcaaggtgggcggtgcgtgccggcatggcctgggcgcgggcggggctgccggggccccaggcccctggccctgcgagcatgtgcgggccgccgctctccattcctgctgccacggctgtatgcgccggctgcccttggacgcccggacgccttcgcaaccggctgcatctttccatcttctggctgcccggtgatgcacgccggtggcatgtgccgggcctggcggaggtccaccaagggacttccaccctaaccccaggggaaaaacagccgattgcctataaccttcagttattgcaggcccacacttacctggaacgaactcggtagccacgcaagcaacaaccagggacgaacatcacgtggttgctcatcccacgctacaaggtacttgcgactgtcttacaattcttcctctgccacgcgggttctatgctggcacatggattaaaggggcccgaccaaaaacaggttgccctcccacgcagttgccccacacaccagggcactacactacacctgcccacgcacaggcgactgcaattcagacccccttaactaccttggcgcgacctatcggggcaccacttaagc

SEQ ID NO: 711548 - DNA, 304 bp, Homo sapiens
  misc_feature (60)..(60): n is a, c, g, or t
tccccgcgcgcctgggcccggccaaccaagcgatcccccgcggtgggcaagcgacgcctncgccatcggcgcctaggggccagtaaccattgacgacggccgttgccacaggccgagagccaatcagcagcgatcgccggggctgtttcaaaaacctaaagcaaacaacgaaaaacgctacatcgttgggggaggggaaagattgagaggacccggggcccctccctgaggcctcacgaccacgctcgcgccccggaggcgtgagccgtacaaaatatacctcacttggggtagaaacacaaca

SEQ ID NO: 711549 - DNA, 226 bp, Homo sapiens
gcgtttacagtgctggttgtagtggcagaggttgtgctcgtggtaggcacagggctgggagtagttccagtgaccagaaggttgtgcatgattgtagtggcagatggttgtgctgcttataggggcagaggttgtgctggtttgtaggagcagaggttgtgctggtgacaacggcctccgttgtcagtgggttatgtatttattctacgttataggtaggacaggg

SEQ ID NO: 711550 - DNA, 405 bp, Homo sapiens
atgtggctggtctagttttagctggatccgctgacttttaaaactgaactaagtcaatctgatatgttagatcaggtaagtaagaatgtaggtactttattatgtaagaaccctaggtaggagtaggtgagtcctctgtgtgaacactggaacagaaacatctttataaaattccttgggttaaaaacttgcctctgaattaaacagcaggtttacagatgtttaacaaaaaacattcccctgtgcttatctgaaccccttctctactgaaatcaaccaatattaggtgggcttcttatggatcctgaggaggttccttgtttagttgggaagtacagaaattggctgtagaatggagtatgacttcaaagaaactaaaacctgttccttattttctttttctga

SEQ ID NO: 711551 - DNA, 1228 bp, Homo sapiens
ggtatagcggagcctggctgggcgtgggaacccgatggccccagagctgtaggtggacaggaggtgagttatggcagtctggagcaaagaagggtcgaagaatagtgggtgcggccagacggattacctggtttggtggaagtcctcgctaggacaaggttgggtcctggtctgagatgcttcgtaactggctgcaactctcctctagacaagaagagtggcacgggttacgcagggcctctggcagagcttgacttgtgatcgacgaagcgagggaggatagccgctgcgagcgtgcatgcaggaatcgctgagaggaatcgctacctggaggggatcgccgcgagctgagtcggtgcacgtcgtgcggatatcgtgcggggcggaaggcccgtgtgggccgtcttcctcgcggaggccgtagcgcggctgatgggggtgcgctcgtagcgcgcaggagcattgcacgtagcgaggcgcgtgggcgtgggccgagggcttcagcctcatagcacgtcgggtagcgctgtattgcaaatcgatgggatgccttgcgtgcggcctgcgttgccagatgacggcatggggaccgtcgtttggcatgcgacgagaaccgtagcgtagggctgcttgatttcttggaggtatcagccggatccttatacccccatggcgagacgcccgtacgcgggcttcccgggtggaagtgacaacgaagaacatggggcttcgaaggcatagggaggggaatagctgctttggtggagatagtctcgacaaggtggccgggcattcgcgggggggccccgggagggggcttggggccagacctggtggcgagagaggtcccgtcgtgtcggaggtcgccctcgcgtttggccaaggcgccccccttgggtttggccctcgtgcttccatgggtccgggcaggggtcggaggaggcacaggtgcggggcgcccggcacagccccaagatcagccactctgttggcgcaaccaagcggaacatattttttcaccttcgggtttggcccacaaggtgggggtaccaaagggcccctggttgattgttgggacaatttccgtgggcatggcattagaaaggccccttggaataaggtgaaacacattggcgaaggaaccggttttccggagaccgccggagcatccttgatgaggggggttccttccaacaactttagctgctcctgccaaactgtgtttgag

SEQ ID NO: 711552 - DNA, 128 bp, Homo sapiens
  misc_feature (8)..(8): n is a, c, g, or t
ggctgacnagaggaccccgttatttccttcttatggtggtgtatggtatcattggtttgaggttagttgattagtcatggtggggtggtgattagtcggtggtggatgagatattgggaggtggggat

SEQ ID NO: 711553 - DNA, 185 bp, Homo sapiens
ttccggactatggccgacgaaacgtgttgtgggaacgaaagttagatttacgccgatgaatatgatagtgaaactggatttctgtgcgtacggtattggtactacgggtgtacgcctgagacataggagaaatcagtgaatgaatgcctcctatgatggccaatacagctcctatttgataggac

SEQ ID NO: 711554 - DNA, 228 bp, Homo sapiens
acgggtcgaccacgcgtcgcctacacacggcatcccggccctttggtgggagtggatagatactcatcaaacatgcatgcagaaaacaagctattctagttcttctgcttatgatttttatggatcgatcggtcatcaggaccggcaaatacacaattaatcattcatatggatggagtgttgctagctcgttgtaaattaccatcatcaggtcatcatcttctctcc

SEQ ID NO: 711555 - DNA, 315 bp, Homo sapiens
aactgggcccccgtagaagcctgacagtgtcgggcccctgtgagcagggcactgtctgtgaaggatgtagagacagaattaaaatgactgaaagaggagttcccgtcatggctcagtgattaaggaacccctctaggagccatgaggttgcgggttcgatccctggcctcgctcagtgggttggggttccggtgttgccatgagctgtggtgtaggtcgcagacgcggcttggatctggcgttgctgtggctgtggtgtagacgggcagctacagctccaattagacctctagcctgggatcaggcttctcgggg

SEQ ID NO: 711556 - DNA, 401 bp, Homo sapiens
  misc_feature (30)..(30): n is a, c, g, or t
  misc_feature (84)..(84): n is a, c, g, or t
  misc_feature (100)..(100): n is a, c, g, or t
  misc_feature (120)..(120): n is a, c, g, or t
  misc_feature (122)..(122): n is a, c, g, or t
  misc_feature (133)..(136): n is a, c, g, or t
  misc_feature (145)..(145): n is a, c, g, or t
  misc_feature (151)..(152): n is a, c, g, or t
  misc_feature (155)..(155): n is a, c, g, or t
  misc_feature (161)..(161): n is a, c, g, or t
  misc_feature (164)..(164): n is a, c, g, or t
  misc_feature (175)..(175): n is a, c, g, or t
  misc_feature (193)..(193): n is a, c, g, or t
  misc_feature (198)..(198): n is a, c, g, or t
  misc_feature (202)..(202): n is a, c, g, or t
  misc_feature (211)..(211): n is a, c, g, or t
  misc_feature (218)..(218): n is a, c, g, or t
  misc_feature (224)..(224): n is a, c, g, or t
  misc_feature (226)..(227): n is a, c, g, or t
  misc_feature (229)..(229): n is a, c, g, or t
  misc_feature (235)..(235): n is a, c, g, or t
  misc_feature (240)..(240): n is a, c, g, or t
  misc_feature (273)..(273): n is a, c, g, or t
  misc_feature (287)..(287): n is a, c, g, or t
  misc_feature (291)..(291): n is a, c, g, or t
  misc_feature (296)..(296): n is a, c, g, or t
  misc_feature (308)..(309): n is a, c, g, or t
  misc_feature (314)..(314): n is a, c, g, or t
  misc_feature (327)..(327): n is a, c, g, or t
catggcctcaccacggggccagcgctcagnttcctgccctgccgatcatccagacatcagaggaaatgagagtattgctcaaangagggagactggagcnttattaaggaaacaaaaaanancagtaagaatnnnnaagagtggntaaaanntcnagaggnagntgtggaatttnttgtttgttccccctctnctgcntgcngcagatgangagacanggggangnntngctggngaggnttctcgcacttaataagggccccgtgggggtgnttctggggcttgcntccnagggngcaggctgaggnnctggngggagggccggtnggcggcggcgcggatgctgctcccttgtggccggcagggggcagcctgcagccactgcgcctctcccgccgcca

SEQ ID NO: 711557 - DNA, 224 bp, Homo sapiens
tcgacttatgaggatcccccatgctatgacaaggacaagttacatgatcgatgtgtcacgattcttcttgtgtaataaatactaaaatacactaacacacactcacacacccttcccataagattgttgttgaagattaaataagataatgtatgttatgtccccaacagctccttaaagcaggagtcagtcaacagaccccatcaaggacatagatagtagct

SEQ ID NO: 711558 - DNA, 109 bp, Homo sapiens
gatatgtccatatctctcgcaagacttgggaggtttttagctattatttcattgtctttttcgtttttcctttacttttgaagcacaatttcacagcatgaagaattct

SEQ ID NO: 711559 - DNA, 348 bp, Homo sapiens
ggggggggggggggccccccttttccccccaaaatttgagggggggaaaaaattttttccccccacccccccccccccctttttttttgggggggggggggggggtccaaacgtttttttttttttgcccccttttttttttgggggaaaagggggggttttttacccccggcttgggaccccccccccgggggggggggggttttttggggcccccctgggttttttttttgggggggggcgggttttaaatttttttttttttaaccccggttttttttgggggcccccctcccccccatttttttccccgttttttggcccccccttaaagggtttttgggggga

SEQ ID NO: 711560 - DNA, 197 bp, Homo sapiens
  misc_feature (31)..(31): n is a, c, g, or t
  misc_feature (44)..(44): n is a, c, g, or t
  misc_feature (116)..(116): n is a, c, g, or t
ggacaacctggtaagacctccgtctctacanaaaaatacaaaanttaaggctgggcacggtggctcactcctgtaaccccagcactttgcgaggtcaaggcaggcggatcacctgnggtcgggagttcgcgaccagcctgaacaacatggagaaaccctggtctctactaaaatacaaaattagccaggcgtggtgg

SEQ ID NO: 711561 - DNA, 127 bp, Homo sapiens
tctgtagttgggactacaggtgcgtgcacacacccagctaattcttcattcttattttttatagagacaaggtctcactatgttgcccaggctggtcttgaactcctagccttaagcaatccacttg

SEQ ID NO: 711562 - DNA, 339 bp, Homo sapiens
gacggcttgaatgtaagcactgagatcttacacgtccgtgctcgccagaaactcgagtctatacaaaagccttgagttctttacaactcagtagccgagtcttgcaaaagatcttctggttctattgaatgagattctggagcaagtaaaagatcggacatgtctgagagctttggagaaaatcaagattcagttagcacaaaaggaaatcaaagcacatttggtgcaccaagctgaagcagcacaggatgccaccttgactacaactactttccaaaatgaagcatgaaaagaataaagaagtatatatgcactccactcaggggtgtaaaagcaacc

SEQ ID NO: 711563 - DNA, 162 bp, Homo sapiens
agaatgatcagctctgcgccggattgccctagcattgtgcgggcaatgaatgaagcgaacagattttcgctcattttggctctcagggtttgttataattttttatttttatgggctttggtgagggaggtaggaggtcttggtatgtgctatctctcacat

SEQ ID NO: 711564 - DNA, 137 bp, Homo sapiens
tgcaacacatttttattacgggggataaagagggtgaggtaaagttcatggaactgagtgttatggactttggcatttccatcgcttaccacagcatgagaggggttaattgcagatcgcatcaccgcaacttaagt

SEQ ID NO: 711565 - DNA, 149 bp, Homo sapiens
agtatcagaatgcttaagtccaggaagattacactgggtgggccacagtactgccaccacacagcaagttcaggttacaagcctctaccagaatccttatgcttcagggaagagaagacaagttggaaatccctagacccaagtccagg

SEQ ID NO: 711566 - DNA, 122 bp, Homo sapiens
agtgtcgtgggtattacggatcctttaacctaatgcgaaggggagcggtgtagtgagtgaagagagggaggttgtatttgtgcatgcttggtagtcaaataattacatttgactgttgaggg

SEQ ID NO: 711567 - DNA, 363 bp, Homo sapiens
  misc_feature (15)..(15): n is a, c, g, or t
  misc_feature (17)..(17): n is a, c, g, or t
  misc_feature (27)..(27): n is a, c, g, or t
  misc_feature (31)..(31): n is a, c, g, or t
  misc_feature (46)..(46): n is a, c, g, or t
  misc_feature (53)..(53): n is a, c, g, or t
  misc_feature (67)..(67): n is a, c, g, or t
  misc_feature (71)..(71): n is a, c, g, or t
  misc_feature (85)..(85): n is a, c, g, or t
  misc_feature (100)..(100): n is a, c, g, or t
  misc_feature (106)..(106): n is a, c, g, or t
  misc_feature (113)..(114): n is a, c, g, or t
  misc_feature (132)..(132): n is a, c, g, or t
  misc_feature (137)..(137): n is a, c, g, or t
  misc_feature (141)..(141): n is a, c, g, or t
  misc_feature (153)..(153): n is a, c, g, or t
  misc_feature (158)..(158): n is a, c, g, or t
  misc_feature (161)..(161): n is a, c, g, or t
  misc_feature (181)..(181): n is a, c, g, or t
  misc_feature (183)..(183): n is a, c, g, or t
  misc_feature (187)..(187): n is a, c, g, or t
  misc_feature (191)..(192): n is a, c, g, or t
  misc_feature (195)..(195): n is a, c, g, or t
  misc_feature (205)..(205): n is a, c, g, or t
  misc_feature (211)..(211): n is a, c, g, or t
  misc_feature (219)..(219): n is a, c, g, or t
  misc_feature (234)..(234): n is a, c, g, or t
  misc_feature (243)..(243): n is a, c, g, or t
  misc_feature (245)..(245): n is a, c, g, or t
  misc_feature (258)..(258): n is a, c, g, or t
  misc_feature (260)..(260): n is a, c, g, or t
  misc_feature (286)..(286): n is a, c, g, or t
  misc_feature (289)..(289): n is a, c, g, or t
  misc_feature (297)..(297): n is a, c, g, or t
  misc_feature (309)..(309): n is a, c, g, or t
  misc_feature (328)..(328): n is a, c, g, or t
  misc_feature (330)..(330): n is a, c, g, or t
  misc_feature (343)..(343): n is a, c, g, or t
  misc_feature (349)..(349): n is a, c, g, or t
  misc_feature (356)..(356): n is a, c, g, or t
  misc_feature (358)..(358): n is a, c, g, or t
  misc_feature (361)..(361): n is a, c, g, or t
  misc_feature (363)..(363): n is a, c, g, or t
aaatgtacaagaccncnccggatgtcnatcnttgtatttggattcngaactcnttttggtggtggcntganaactggctttggcntgatttatgattccngtggantagtgcnnaagaaaaagtgatcccgnaacantagncttgcaagacantggcncgngtatgagaagaaaaagaccncnaganagcnncgnaaggatcgcnagaacngaatgaanaaagtcagggggacngcaaaggcncnatgttggtgctgncnaaaagtgagctggagattggatcacngcngaaggagnaaaggtgctgcnatgatgttagctgtgcccncngtggattttcgcnagacantaatacnanacngn

SEQ ID NO: 711568 - DNA, 392 bp, Homo sapiens
caaattcagtgattctcctgcctcaacttcctgagtggctgggattacagatgtgtgccacacgcccagctaatttttgtatatttagtagagagggtttcaccatgtaggccaggatggtcctgaactccatagcctcaattgatctactggcctcagccatcccaaattgctggaattacaggtatgtgtgcctggaccacaagggatctttataagacgacaagaaggaagcatgagagtcagtataagagagatttgacagatgctacactgctggctttgaagattgtttaaggatcatgagtcaaggaattcaggaagcccctagaagctggaaaaggcaaggaaacagattattctttagagcctctacagggatgcagtcctga

SEQ ID NO: 711569 - DNA, 233 bp, Homo sapiens
gtatgtatataagagccttctatcctctaagtatcctaagagggggtaaggtgggggtacactggtggacacaccagtcttactgaagtattctcttaatgtgaacagctgttttttttactacaactttttctctgatgtgcatttcctcaatcatgtacataaatgttcgtcataagagtatatgcttcttcccagaaaaaacatggctatctggaggaaaatatcagtat

SEQ ID NO: 711570 - DNA, 622 bp, Homo sapiens
gatcgacgacagaatgaactcttggagcccctccagaatctggccttctccccagccaccatggcgcatgcttttcttccaaccatgcctgaagacttgctggctcaagctcggaggtggaagggtctggagcgagtccactggtacagtaagtgttggggtctagatgacccacactcctttgagcttcaaagggtgtccagatgctatgaagcattgggttcgacttggggtccacgtggtttgtgcctcagggtccaaaaccacctgcattctaccggtggcgtctgcagaagacgaatggcttgaaggagctggcactccgccggctagatgatccaaaccatttcatttctttgtcgtgtggaaaaggccctctgtgatgcacttctgttctctggaatatgccattttgggagaagggagggactgggaaccacatcagagacgcattcaaaggcccaccacaaaacaaagtttttgacacaaagctcttctgaaatatatgaaatatagaaccgggagactgactcatataacccatgacatgtaaattttgctgttgcctgagtaaatattttaaaactagtttttaaagttgttataaaatatgctcatgcca

SEQ ID NO: 711571 - DNA, 717 bp, Homo sapiens
  misc_feature (235)..(235): n is a, c, g, or t
  misc_feature (237)..(238): n is a, c, g, or t
  misc_feature (401)..(401): n is a, c, g, or t
  misc_feature (416)..(416): n is a, c, g, or t
  misc_feature (443)..(443): n is a, c, g, or t
  misc_feature (491)..(491): n is a, c, g, or t
  misc_feature (537)..(537): n is a, c, g, or t
  misc_feature (634)..(634): n is a, c, g, or t
  misc_feature (639)..(640): n is a, c, g, or t
  misc_feature (647)..(647): n is a, c, g, or t
  misc_feature (652)..(652): n is a, c, g, or t
ggtggaggagcaagcgtctgccgcggtggccgggtgccgatttgacaagatcaaagctgcaggaaaatggacagtgaggttcagagagatggaaggatctgggatttgcattgatgatgcttggcgagaagcacaagctgccttatgaggatgtcgcaataccactgaatgagcttcctgaacctgaacaagacaatggtggcaccacagaatctgtcaaagaacaagaaatgangnngacagacttagccttacagtacctccatgagaatgttccccccatgtggaaactgacgctgtggtcctttcttgtggatggattttctcaaagtacacagattaaagcagtggttgtgtttcagtctccaagattcaaacccttgtgagtaataaatcagcanctcaagaatgtacancccatttagttggtggtagcaaagtgnaatggaaattgaatgagaaactgagatttctcagtaatggtgaatatntcgctctttaaacctagaatcttcatggagtagcttatatttgaanatgatggggttaaaacattttggccctctacctctgatttgtgcttgggttggtcaacagtttaaacacctctccaactacttatgtgtgtcctgtnaacannggtgatnacgtntgagagggaaggcaagaaaggggcagaaactaggagattattacttctcaatattcccacattgg

SEQ ID NO: 711572 - DNA, 765 bp, Homo sapiens
  misc_feature (293)..(293): n is a, c, g, or t
  misc_feature (449)..(449): n is a, c, g, or t
  misc_feature (464)..(464): n is a, c, g, or t
  misc_feature (491)..(491): n is a, c, g, or t
  misc_feature (539)..(539): n is a, c, g, or t
  misc_feature (585)..(585): n is a, c, g, or t
  misc_feature (682)..(682): n is a, c, g, or t
  misc_feature (687)..(688): n is a, c, g, or t
  misc_feature (695)..(695): n is a, c, g, or t
  misc_feature (700)..(700): n is a, c, g, or t
ggtggaggagcaagcgtctgccgcggtggccgggtgccgatttgacaagatcaaagctgcaggaaaatggacagtgaggttcagagagatggaaggatctgggatttgcattgatgatgcttggcgagaagcacaagctgccttatgaggatgtcgcaataccactgaatgagcttcctgaacctgaacaagacaaattggtggggcaaccaaacaaaggaaaattccttggctccaaacaagggaaaaacaaaggaaagattggacagttgtgactatgactttagcacatntaaccaggttaccgtccaattgagaatgttccccccatgtggaaactgacgctgtggtcctttcttgtggatggattttctcaaagtacacagattaaagcagtggttgtgtttcagtctccaagattcaaacccttgtgagtaataaatcagcanctcaagaatgtacancccatttagttggtggtagcaaagtgnaatggaaattgaatgagaaactgagatttctcagtaatggtgaatatntcgctctttaaacctagaatcttcatggagtagcttatatttgaanatgatggggttaaaacattttggccctctacctctgatttgtgcttgggttggtcaacagtttaaacacctctccaactacttatgtgtgtcctgtnaacannggtgatnacgtntgagagggaaggcaagaaaggggcagaaactaggagattattacttctcaatattcccacattgg

SEQ ID NO: 711573 - DNA, 309 bp, Homo sapiens
acatccccctgaaatcctactacccccttttttgagataatttggccagcccttctctttccacacactcactcaatgtcccccccttttaatccccaaaactgtttttgtggtctttgtagcctatagtagttttctcccatctttccccctagacttttttgtttttcagtttcagacaaaaaaacttttcagctttttccagtgggtttccttaacagtaactttaccccttgaaattttttttcataaaaaaactaaattggtgtggaaaggctgcccccaataaagttttttttttttccctga

SEQ ID NO: 711574 - DNA, 219 bp, Homo sapiens
caggaacagcggttcgccgttctgagtctcttactgaaaccccattttccgctatccgagttagttgtgtaggtgccatcctgggggttgaccctatgcgctgtcctgagtgtgctttgcagcatttgcatgactgctggcatcgctgttttcacaagacccattggtctcaccggtccgaagccggctgttcccttgggggtaccggagctcgaaatt

SEQ ID NO: 711575 - DNA, 1049 bp, Homo sapiens
  misc_feature (56)..(56): n is a, c, g, or t
  misc_feature (213)..(213): n is a, c, g, or t
  misc_feature (236)..(236): n is a, c, g, or t
  misc_feature (249)..(249): n is a, c, g, or t
  misc_feature (259)..(259): n is a, c, g, or t
  misc_feature (281)..(281): n is a, c, g, or t
  misc_feature (306)..(306): n is a, c, g, or t
  misc_feature (351)..(351): n is a, c, g, or t
  misc_feature (353)..(353): n is a, c, g, or t
  misc_feature (365)..(365): n is a, c, g, or t
  misc_feature (392)..(392): n is a, c, g, or t
  misc_feature (402)..(402): n is a, c, g, or t
  misc_feature (432)..(432): n is a, c, g, or t
  misc_feature (507)..(507): n is a, c, g, or t
  misc_feature (515)..(515): n is a, c, g, or t
  misc_feature (541)..(541): n is a, c, g, or t
  misc_feature (557)..(557): n is a, c, g, or t
  misc_feature (581)..(581): n is a, c, g, or t
  misc_feature (618)..(618): n is a, c, g, or t
  misc_feature (832)..(833): n is a, c, g, or t
  misc_feature (841)..(841): n is a, c, g, or t
  misc_feature (855)..(855): n is a, c, g, or t
agcgggatttatctcgttggggactaaggcgtcagttggcgcgcaacgggttctangctgcaggcagctcgaggacccgcgggcccgccccggctcggcctggcagatagcagaggcagcagggccgtgccgggggggcatgtatgctgtaaccagttgggccaggggatgttacggtggacagtgcacctggtagggcgggccccgcagggntgaagccatgctgcagtggctgntcgggcatcgggntatactcctntcggggggttacgtgctctggntgaagactatgagacactgtggtcnagatagatgtgcacattttcaatgcagtgtccttgcgttggacananagctgcgccccnggtgaagtcgtgccatccgtgggcaangctcctgtgngtaccctacatgcgctatggagcactcaangcgtcctcatcgactgacacagtcctcctttggggcgggcggaatgacaccgaaggggcctgcaatgtgctctantgcctttngacgtcaatacgcacaagtggttcanaccccgagtgtcaggnacagttcctggggcccgggatggncattcagcctgtgtcctaggcaagatcatgtacattnatgggggctacgagcagcaggcggactgtttttccaagtgacattcacaagctagataccagcaccatgacatggactcttatctgtacaaagggcagccctggacgcttggagggacttccactcagccacaatgctgggaagtcacatgtatgtctagggggccgtgccgatctgtttgggccattgccattccaacaatgagatttactgnnaccgcatncgagtctttgacgncaaatgaaggcttgggtggtaaggtcccccgacatccagatgttgcctgaaggggcgcccgaaagcactcgggctttgggtacaagggagcatgcaattggaggggaaaaagacaggtgaacaggagtcaggacccggaaagaaacacaggctaacatggcaaaattaacaaggaagggaagacacccacaaga

SEQ ID NO: 711576 - DNA, 1225 bp, Homo sapiens
ctgtgctgctgcttttctcttctccccttatacacttcgtcctgtgagtgcgtaccccgtttcctgtttttcgccctgtgtcgttctcttctcccccctgtgggttctggtacttttatcccttttgacatgagatttcctcgctgtgcctctgtttgtggtttttccctttttgtactctctgggtttgttccgtctggtactctaggtgtttgctttttgggtcgggattggtcgtacctccttgcgtagtgatgttggttcttaaacgtgggtttccagaacgttctgtgtccgaggtacttcggcgtattccttcccatcccaggggacagttattgtacccgcaacgttgatttactgctgatggcgtcgtaacggatcacctcagttcctcccctcaggattctgggcacagagtgaaactttctgcatcgcttgacgtcacttgggtagtcacaatgatcctactgtgaagctagtcgttgacaacctaggttagtcactgtagcgtctgcaaggtatgcgttctgctcaaaggacaatgcaaaggcatcgctgcttcgtctgtctgatattgcccagatctttgcattgtgattagcattgcgttttggggtctgcctatggtttgcaagtagctcatactcgcaatatagagtatgtaaaagaatgatgattcctttgcgttcatctagttccgcttctctcagcggtccatctcagcgtctcccttcaggaaccgctgagtgtcctctcttaacatccaagccttttaatgaaatcgtactgaaatcgtgtatcagctaagagtcactccagagtcctggtcccattaactccaagtgccttgtcttgacagtgacaacagacagtcgcctcgctttttagttgattgttggtatgttcttaacccctttaatggaactgcctggattttatacagctattaaaggatgtctcttttgctgtgtagaactgcatagctgcgcaagtgccatttcggggtcagcatcctctgtcttcaacacagtgtgctctctagttatcatgtgtaacgtgggttcattgtttagcgaagatagactagaggacacgttagagatgcccttccatgctgccatccctgtggcaccatctatggttatctttggctgtttagtatatacaggttacagtattaactctggaatcctactgggcaaatccctgcttcacccaattg

SEQ ID NO: 711577 - DNA, 167 bp, Homo sapiens
tcaactgcgccgcggcagatagttcagactcgtatctatttccttgagcgtctgagatgttagtattatttagttttgtctgtgacttgttagagactctgggcatacaggactaggaagcagataaggaaaatgattatgagggcgtgggccattcaccgcctccg

SEQ ID NO: 711578 - DNA, 933 bp, Homo sapiens
  misc_feature (56)..(56): n is a, c, g, or t
  misc_feature (213)..(213): n is a, c, g, or t
  misc_feature (236)..(236): n is a, c, g, or t
  misc_feature (249)..(249): n is a, c, g, or t
  misc_feature (259)..(259): n is a, c, g, or t
  misc_feature (281)..(281): n is a, c, g, or t
  misc_feature (306)..(306): n is a, c, g, or t
  misc_feature (351)..(351): n is a, c, g, or t
  misc_feature (353)..(353): n is a, c, g, or t
  misc_feature (365)..(365): n is a, c, g, or t
  misc_feature (392)..(392): n is a, c, g, or t
  misc_feature (402)..(402): n is a, c, g, or t
  misc_feature (432)..(432): n is a, c, g, or t
  misc_feature (507)..(507): n is a, c, g, or t
  misc_feature (515)..(515): n is a, c, g, or t
  misc_feature (716)..(717): n is a, c, g, or t
  misc_feature (725)..(725): n is a, c, g, or t
  misc_feature (739)..(739): n is a, c, g, or t
agcgggatttatctcgttggggactaaggcgtcagttggcgcgcaacgggttctangctgcaggcagctcgaggacccgcgggcccgccccggctcggcctggcagatagcagaggcagcagggccgtgccgggggggcatgtatgctgtaaccagttgggccaggggatgttacggtggacagtgcacctggtagggcgggccccgcagggntgaagccatgctgcagtggctgntcgggcatcgggntatactcctntcggggggttacgtgctctggntgaagactatgagacactgtggtcnagatagatgtgcacattttcaatgcagtgtccttgcgttggacananagctgcgccccnggtgaagtcgtgccatccgtgggcaangctcctgtgngtaccctacatgcgctatggagcactcaangcgtcctcatcgactgacacagtcctcctttggggcgggcggaatgacaccgaaggggcctgcaatgtgctctantgcctttngacgtcagcggactgtttttccaagtgacattcacaagctagataccagcaccatgacatggactcttatctgtacaaagggcagccctggacgcttggagggacttccactcagccacaatgctgggaagtcacatgtatgtctagggggccgtgccgatctgtttgggccattgccattccaacaatgagatttactgnnaccgcatncgagtctttgacgncaaatgaaggcttgggtggtaaggtcccccgacatccagatgttgcctgaaggggcgcccgaaagcactcgggctttgggtacaagggagcatgcaattggaggggaaaaagacaggtgaacaggagtcaggacccggaaagaaacacaggctaacatggcaaaattaacaaggaagggaagacacccacaaga

SEQ ID NO: 711579 - DNA, 122 bp, Homo sapiens
tgagcgtggagagagggtgtacaccctgctgagtgagagagaggtttctatccctcaggtgtgcagacaccccatctccatcacttagggggtggaaacctctctctcactcagcaggtgtg

SEQ ID NO: 711580 - DNA, 250 bp, Homo sapiens
tgtctggcatggagatccaagctgtgtggaatgtaccagcatagtccaggtcctagcttcacctgccctgcatctgattcctgtactcactgacatgtaccaggtaaccatctaaaggcttgcaatgcaactgtgacccttactcgtacacagtgtgtacgagtaaactataaacatcctttaatatatatcataccacgtgataattgcctgtttaccgtactgtatctcccactattatgtaacctgt

SEQ ID NO: 711581 - DNA, 177 bp, Homo sapiens
aggatttgctgacgggtcagatacagggtatgagtaaaagagaggagttaaggatggctccaaggtgtttggcctgaccacttaagactggagtggccatttatctataataacggggtttcaacagctttaagatttctagtactgccacctttcacccgttgtaggcatgtagcc

SEQ ID NO: 711582 - DNA, 259 bp, Homo sapiens
ggggggggttttcccccccgggggggtccctccccctttggggggcttttcccccccccgtgcccccccctttttcccccccccccgggggggggggggggggggggtttttttttttttcccaaaaatttttttttttttttaaaagaaaaaaagaggaattaaaaaaaaaagatcaagattttgaaaagtaaaaataaagggaaaaaagaatattaaaaaaaagaaaataaaataaaaccatttaaaaagaaaaaaa

SEQ ID NO: 711583 - DNA, 291 bp, Homo sapiens
acaggattaacagcgacctgcaataactgagaggctatcactgggtaaaatgcttcatgaattgactgaaaatccatttggaggtgctggagaacgttattcccagagaggtagcctcagtggaggcgcagtgtctcctacgcacctatctgagggctaggagggtgccaagggcagctgctgaccgaaatggtgcttcaggaagctagggtgctgggagaacgccacatagcacagaggcgctccagaggaaaaaagccacaaccaacaagaaagcacaaaggcaggcgg

SEQ ID NO: 711584 - DNA, 1003 bp, Homo sapiens
taccttttctcacttagtaatttaatggtatataaagacatgtgtataagtgagtgcgtacatatgaggtatgacctatagggttgtgttgtgggaattagctttctcctaacatacagaagtatcagacagtgttcatctcaccccgtcctccttagagaggtgtctttggtgagactatgtgctcattgactataagtgctgccgaagtatagaaatatcttgggaactccttctactagaatggccttcagggcttggcatgttcctttggtttacccttaagtagatgagaacatcctcctcctttgaggatggatgttaccgttctggaatatgaatctcgacgtgcttgatagcacagttggatgaaaaaagatggcaactttgaaggtagagttacagccgattttctgttgtctaaaaaaatccgctaatgaccattttcttggaatgagtcttgggacctcagaagccatctcaggagtgtccacttcaaggggggatcatcctcattagcagacagattgttaaataatcaggattcgtcttgccatgcctcctatgtgtgcacatctctgcataccggctacggatataagtgcggtaaatcattcatatagacatctggtaggtatactgtaagaactgtgttactttagtgcatgttatgtgtcatgtatgatggtgactggggtggtaccttcggcagtgaaaactttgcttcgttcacgggaaatgtgaataatgtcctttgatagtggactaaattatacaggggttgcttgtatagcccagaaggtgatgcagggagggttaaatgggatggggcaagggttggtaattaggacctgttgtttttaacaggtgaacatatttcatggtggtgaaaaggggtagggagggaactaagggagaggggcccacaaaaaagtgaagtaatgaagtgaattgtatgtacacgggtgagagggggaaaaaaccatgaggtagatagaatgtt

SEQ ID NO: 711585 - DNA, 785 bp, Homo sapiens
gatgatccgggccatggaatgacaaggataagaagaaagagaagaaatgaagtgaccatccagcctttcccaatgagacttcctctccttccacacccatcattgcctttttgcacgacattacaggtggatgatgttctgtgataatgaaaagcatcagaaaagctttagtactgtatgtgcgtttgcatctcatcctcggacatttttctgatcaaatagactggattagacagaatatagttaggagttcggcttgcatcttcctggggttacccctcgactaccccttggtgagtcaactcccaatcgtgtagacctcttcggctctatctcaggcatgtacgaccctcggtgctgcggattgaagaaagttggagatcgcagcacgaggggctggctcagactatcaggtagttcctgcttttctcacatccaaggattctacttacaactccaagttggacgcgtgaaaactgttcttgtgataagaagcacgaaatcgcgggcaccgtatccctatcacttcacttgttgattcggggtaatagccgtcaacagtatacacgtggtcgtgggaacttgtgagtccggtcgaagatttttgtcccactccggggaaaaaggagatgtttcacgtaggatccccaatatgtttaacctacaagaaccttgcaaaaaggcgtacgaaaactgattcatgggccctcgtaacgaacacgtatagaatagggaagtaggccgtcattcatgggtgggattgcttattgactgcaccttctagg

SEQ ID NO: 711586 - DNA, 410 bp, Homo sapiens
  misc_feature (20)..(20): n is a, c, g, or t
  misc_feature (34)..(34): n is a, c, g, or t
  misc_feature (61)..(61): n is a, c, g, or t
  misc_feature (66)..(66): n is a, c, g, or t
  misc_feature (76)..(76): n is a, c, g, or t
  misc_feature (92)..(92): n is a, c, g, or t
  misc_feature (102)..(102): n is a, c, g, or t
  misc_feature (115)..(115): n is a, c, g, or t
  misc_feature (118)..(118): n is a, c, g, or t
  misc_feature (138)..(138): n is a, c, g, or t
  misc_feature (141)..(141): n is a, c, g, or t
  misc_feature (152)..(152): n is a, c, g, or t
  misc_feature (157)..(157): n is a, c, g, or t
  misc_feature (161)..(161): n is a, c, g, or t
  misc_feature (166)..(166): n is a, c, g, or t
  misc_feature (176)..(176): n is a, c, g, or t
  misc_feature (377)..(377): n is a, c, g, or t
agggcggggcttagtaaatncggcttccatctcnccatctccggttagtcatccacaaganaaatntgaaattccngcaataagaaatgacnaaagattggngctgaagccctanagngcttgctttttgcccgttgnccngataaataganctatntgcnttatntatgcagcanggggtttttattatttttccctaaagacgtctcttttgggtaataccaaacgggttttttaaaaaagccgggtttttcccaaaacccccttaaaggtttttaaattgtttcaaatctgggcaagttgagatttttaagaacttcctttttaatttgtaataaaagtttccaccttgattttttcaaaaaagtcaccaaacngcaagcccctgttaataaaggtttttaataata

SEQ ID NO: 711587 - DNA, 162 bp, Homo sapiens
ctgcagttgtcgtgagccccgtgcttggaacattccccccaacgatgggatgccgggaggcccatcccgccaggtttctttcagggtcctccgcgggtcacagccctctgctgcacgcacatgcctccaccctcacaatcctatgcagcatagatgggaccc

SEQ ID NO: 711588 - DNA, 698 bp, Homo sapiens
aggctctagcctgagacatgcttgctgacctgggccagagctcttcccttacgcaagtctcagcccggtcgtcgcgacgttcgcccgctcgctctgaggctcctgaagccgaaaccagctagactttcctccttcccgctgcctgtagcggcgttgttgccactccgacaccatgttcgaggcgcgcctggtccaggggctccatcctcaagaaggtgttgcaggcactacaaggacactcatacaacgaggcctagctgggatattagctccagacggtcgtacacctgacagagacatggactcgtaccacgtctctttggtagcagcatcacacctgacgagtctgagggctatcagacaactaccagatgagatcgcaaccatggccatgggcgtgaagcctcacacagtatgtcccacaaatactacaaatgcgcacgtgcaacagaacgcatctcattacaactaacgggccagaacgactaaactgccgggatccccattctgcgagcactacggtactctacgaacggcaacaacaacacacagacgcaaacgtacatcacagcacctaatcgaactgcacccgctgaagcgactctacgacatgttgacaccaaacatgggacattaccagacacagaggagaataccacactaggtggtatgcaacagcatcgcccttcatggaggac

SEQ ID NO: 711589 - DNA, 219 bp, Homo sapiens
ggaagtttccatccctgatttgctttgaccacgtgtactgagctgagcctctgatactctgtcacgtttccaaaaatggtatccattacggactagaaagagacatgggtctgcagcaaatgttgcacctttcaacttgctccatgcaattccaggcacactggcatcgcaaagcactccactcctcccaacaatgcagcaaccagggcaagcaggcag

SEQ ID NO: 711590 - DNA, 425 bp, Homo sapiens
  misc_feature (356)..(356): n is a, c, g, or t
  misc_feature (363)..(363): n is a, c, g, or t
  misc_feature (406)..(406): n is a, c, g, or t
caccaaacacacagctcctggacaccccccaacgcacagtattggtcccagtttcacagcgtggagccacaggggccccagttgaggccgcagcaacacaaacaaaacaaacaagtgctgggttactgcctcctcctcatgctggcgggcatgggcctgcactacattgccttcaggaaggtgaagcagatgcaccttaacttcatggatgaaaaggatcggatcatcacagccttctacaacgaagcccgggcagcggccagggccaacagaggcatccttcagcaggagcgacaacggctagggcagcgcagccgccaccatccgagccaacccaaggccccgagatcgtgccncgggcgnccgccctgaggggctcacctggatggggcctgcaggtcgttcngcctttgcttccttccctg

SEQ ID NO: 711591 - DNA, 326 bp, Homo sapiens
tagagcgaacatgccctcactggagctctgagtatatatgactctgtgcacactcggacaggactacatataaagatactcatagatctagcattatgcatatttctagacagatagtttactaataagatgcattcagggactgctgcaggtgagtcaagaaagcatttctgggaattagagggctgtaacccctcatcatatattgcagctcctcttttacttcttaaatgcatcagctaagtccaagtatatatactttggttccccatctcaatctcttttcccttacctatataatcagatcttttttcttctttttcttt

SEQ ID NO: 711592 - DNA, 534 bp, Homo sapiens
agtagtaacttatagtaggtacataattgtatattgaggccatcttgcctcataggccatgatgatacgctaacatccgtttccgataggtaccgacggaactgcagctctatgtcgacagctcgactgataacataagcgggattgcggctttagattgacaactagattgataatatgagcgggactgcggctttagatcaacaactagattgatgacatgagcgggattgcggctttagatcaacaactagattgatgacatgagcgggattgcggccttagatcaacaactagattgatgacctgagcgggattgcggctttaaatcaacaactagattgatgacatgagcgggattacggctttagatcaaccactagattgatgacatgagcgggattgcggctttagctcgaccactagattgatgacatgagcgggattgcggctttagatcaaccactagattgatgacatgagcgggattgcggctttagaatcaccaactagattggtgacctgagcgggatt

SEQ ID NO: 711593 - DNA, 137 bp, Homo sapiens
caggactactgataattatcagtgcctgcttagggagatgtccgggggaaaaatcattaatatgtctaccttgaagtactgtccaaaaaggaaatcttcaacgcttaagaactagcccccaacacttttcttttttt

SEQ ID NO: 711594 - DNA, 234 bp, Homo sapiens
aatgcttttaaatccaactgcccaagaactttagtcccatctacaaattcagtgaaagagtgtaatcgctcaaattcctcttctcctgtagacaaacttaatcagcagcctcgtctaaccacactgacacgcacatgcgccctgcatacagcacagcagggcaataactgcacaagccttgcaacagagcacagagtagcaagcggcaacatgcaagcatgcaaagccgggctg

SEQ ID NO: 711595 - DNA, 587 bp, Homo sapiens
ggaggttcaaatcttcagccccacgtgcggtttgcaaagtctggctgtacctgaggccctaagaagccagagacctcactcccggggagccgagccatgtccactgcggtcctgtgaaaaacccaggcttgggcaggaaactctctgactttggacaggaaacaagctatagttgaacgacaacgtgcaatcaagaatggtgccatatctactgatcttctcgattctaaagaagagagtttggtgcatatggccaaagataatagcgcttattagaggacgaagtgatggtaatagcctgtacccacgattgaatcgtagaaccgttcgtcgatttaaaggaaaggatgcagctattgagactttttccagccccaataatgcggagtaacaccgttagcccgtgcacttgcatcgtgtacaaaaccagtcagtcagagatgcttgaggcaatgacgattggtgccactggtccatgagcttgcacgagatcgtgaagaaagaccacagatgccctgtgttcccagagaaccagttcgaagagcatggacagatttgccatgtcagatactcgagctatggagcgg

SEQ ID NO: 711596 - DNA, 121 bp, Homo sapiens
tcgtgatcaaacgtatccgacagtggacatgaggcacaacaaaaggtttgaggacatcaggcatatgactttatacttaacatcagatcttttctataatatcctactacttaggatttcc

SEQ ID NO: 711597 - DNA, 196 bp, Homo sapiens
  misc_feature (97)..(98): n is a, c, g, or t
atggtgccaattttaaatagttttatctctcatagtacgatgtaggctatgttatctcacttacaacttagcgacgctgtctgtattatagacgatnngaatggtgtaacttgtgcgctataacaccccctttgtgcgattaatcgctctacacattatatcagacgtatgcgagcaactagtcccagtatactgt

SEQ ID NO: 711598 - DNA, 662 bp, Homo sapiens
  misc_feature (23)..(23): n is a, c, g, or t
  misc_feature (341)..(341): n is a, c, g, or t
  misc_feature (450)..(450): n is a, c, g, or t
  misc_feature (463)..(463): n is a, c, g, or t
  misc_feature (489)..(490): n is a, c, g, or t
  misc_feature (499)..(499): n is a, c, g, or t
  misc_feature (504)..(504): n is a, c, g, or t
  misc_feature (506)..(507): n is a, c, g, or t
  misc_feature (509)..(509): n is a, c, g, or t
  misc_feature (511)..(511): n is a, c, g, or t
  misc_feature (516)..(517): n is a, c, g, or t
  misc_feature (519)..(519): n is a, c, g, or t
  misc_feature (522)..(522): n is a, c, g, or t
  misc_feature (529)..(529): n is a, c, g, or t
  misc_feature (531)..(531): n is a, c, g, or t
  misc_feature (537)..(538): n is a, c, g, or t
  misc_feature (549)..(549): n is a, c, g, or t
  misc_feature (558)..(558): n is a, c, g, or t
  misc_feature (597)..(597): n is a, c, g, or t
  misc_feature (599)..(599): n is a, c, g, or t
  misc_feature (641)..(641): n is a, c, g, or t
taggtttccagccttttattcanacaaggactcaaaagaacacacgtcacccgctgacactgagcggtggggggaccttgtggaggaaggacacagcaggcttggccactgccctgaccagtgaccactcagggctgccccttccagagatgagcgtagggtggggtctgagcgccacccctaggccgtctgtgtgcagcgggagtgctgctgtcctggcgcccggcatcactgtgccagagtccccagcccaccctggcactggcagggttattatggggtggacttgcctgtgttgggggctcctgatcccaaaacatctaaagtcaggttccagagancaagccatggggacctgaccagcaaccggggacctccgtccactgtgcgggacggtgatgaaaagcaaagcagcactaagcggcctcctcagggtcagtcggttcatgncagcttcccccanacccttcaagttcttcttcccctggnngaccccttnccaanannanancaccnntnccnagggccncntggcanntggggcacagnagggaaggngggcccgtccaggcctgcggcgcagggccctggatggcntnagtgagtaaaaggaggtcaccagggtccaaggtgggccctgnggccctccgaagccatttggg

SEQ ID NO: 711599 - DNA, 259 bp, Homo sapiens
tccccgctacgcgcgaccgctgccgtgtgaccctggtgttcggagtgaaccgcggggaggtcgatgggatcatgaggaacacagacctcaatcagtggccagccaggacaacgccagctcataccccttcaatcccagcccggcgatcgtcccggtgacatgcgccgacaccacactgtggtgacggaactcctcccgggctgcgatgttagagatatggacctcaatacaaggcgccaccaactggacgagggcatcg

SEQ ID NO: 711600 - DNA, 364 bp, Homo sapiens
  misc_feature (143)..(143): n is a, c, g, or t
  misc_feature (150)..(150): n is a, c, g, or t
ttgggggagtcccaatcaaaatgtaggtgtagaattggggataaatttattttaaatctgctttaagagagatgtgcagacggtgcatatgtacttcatgtttatctgtacttctgggacatttggtcttcatattgcagagnacagtgncacgggaaaacagattgtctcagttcacggtccctcactgaggtcagagcttaaatttcccagtgttccacttaggaagaacagtgctaatgtgtatcttttaagataactcaggctgaaagccatctgactttcagtgagaatgaggggtacactaggggagaaaataggcatcaaagtttggagagggctgtgctggctatagattttcttc

SEQ ID NO: 711601 - DNA, 1458 bp, Homo sapiens
tcactcgacagtgcaaaaaatttatatatgggggatgtgaaggaaatcaaaatcgattggaaagtctggaaaagtgcaaaaaaatgctggtacaaagagataatggcaaacagggatttataaagagacaacattggcacacaaagaaaacgccaagatttctggcttttgtgggaaagaaagatcctgggaatatggtcagaggttatattaccagggtattttaataacacaatccaggaacaaaaacagtggggaaccgtttacaatgtatgggtgggatggctcggggcaattatggaaccaatttgtggaagaactctgggaaagaatggcaaagaacctattggtgagaaagatgggtcccagaatggtgtttccacagggtgggataaatctatggagaaccccaggtctacaatgggctggggagaataaatctccccctggatctccgcgacaatcacaacccaaggggttccccaagctcttttgggagaattttctcagcggggtccctctcgagtgggtgctcttcaactctccgagccgagaccaggagggattgggtgtcccgggtgcccaatgtgagacaacgagaatttctatactatacaaattctccagctccattgggggaaatgtggccgccccatatttagaggtctacgaggggcgcagtgggtggggcggggacacagtgccaaaaccaaatttttataactttcccaaaaacacagaatgtgctcttgagggggccagttgctacacaacagagcggttttcaattcccaaagagcaaattattccaacaaggggagggccaaaaagtataaaaacgcaaaaaaggaaacacagggcaaaaggaacagcccgcagatcgctggcacacaatagcccattattggacacgccaactgtcgcgggctcacaccacactcttgctgcaacatcgtgcttaatcaacggccaatcgtggacaatcatctttaaatgtcccccaccataaaacatatttctctcatctctggcgccaaccggggtcctccccgcaaatggcaaaaattgtacccaaaaaataatgaggcctgtcgtaaaaaaacggcgcatcgcacgtccacaacaagtcggtcccgtaacaaacgttgcgataaggccgcaaatggtgacaccgggcggtccctcacacacgcaacacaacaacagaggggggcgggcggcgcacaaaaaaaaataacccccccgggggaggggggccacagacaaatagtagcgcaccccaccggcttctgttaacgaaaggggggcccacagaatgagggcacgacaagaaatcaaagcaaacagcagacgcggtatacaacacagctgcagtcgggagcaaaagcaacaccgaggaagcgtggaagaaaacacaacacgcgtggtgagcagacgaaagaccgcagcaaaaacatc

SEQ ID NO: 711602 - DNA, 946 bp, Homo sapiens
  misc_feature (23)..(23): n is a, c, g, or t
  misc_feature (341)..(341): n is a, c, g, or t
  misc_feature (450)..(450): n is a, c, g, or t
  misc_feature (457)..(457): n is a, c, g, or t
  misc_feature (484)..(484): n is a, c, g, or t
  misc_feature (498)..(498): n is a, c, g, or t
  misc_feature (505)..(505): n is a, c, g, or t
  misc_feature (508)..(508): n is a, c, g, or t
  misc_feature (514)..(514): n is a, c, g, or t
  misc_feature (522)..(522): n is a, c, g, or t
  misc_feature (559)..(559): n is a, c, g, or t
  misc_feature (604)..(604): n is a, c, g, or t
  misc_feature (618)..(618): n is a, c, g, or t
  misc_feature (622)..(622): n is a, c, g, or t
  misc_feature (638)..(638): n is a, c, g, or t
  misc_feature (652)..(652): n is a, c, g, or t
  misc_feature (659)..(659): n is a, c, g, or t
  misc_feature (677)..(677): n is a, c, g, or t
  misc_feature (679)..(679): n is a, c, g, or t
  misc_feature (696)..(696): n is a, c, g, or t
  misc_feature (727)..(727): n is a, c, g, or t
  misc_feature (762)..(762): n is a, c, g, or t
  misc_feature (765)..(765): n is a, c, g, or t
  misc_feature (818)..(818): n is a, c, g, or t
  misc_feature (850)..(850): n is a, c, g, or t
  misc_feature (927)..(927): n is a, c, g, or t
taggtttccagccttttattcanacaaggactcaaaagaacacacgtcacccgctgacactgagcggtggggggaccttgtggaggaaggacacagcaggcttggccactgccctgaccagtgaccactcagggctgccccttccagagatgagcgtagggtggggtctgagcgccacccctaggccgtctgtgtgcagcgggagtgctgctgtcctggcgcccggcatcactgtgccagagtccccagcccaccctggcactggcagggttattatggggtggacttgcctgtgttgggggctcctgatcccaaaacatctaaagtcaggttccagagancaagccatggggacctgaccagcaaccggggacctccgtccactgtgcgggacggtgatgaaaagcaaagcagcactaagcggcctcctcagggtcagtcggttcatgncagctgncggatggtcatgtccggcttggtgatnttcacctccacctnggggttnttnatctanttagtaangttgtcacccatgatctttgggaggtaccggcctctnagccatcccgttccatcagcggtcatcacttgcagttctcaaggncatcttctcactgnacantgtcccttggaagttnatcaataagttctngacgttnaggattatggcctttacntnaaagaccagattctccngcgtgcctgaaggtggcctctcccgcggggncagcttgctccggcgccgcttctcctcaggcccanggncctgggggttgaccttggggttcccgcagccctggatgaccttggccgtgagngtgtccctgttgtcctggagagcgttgatggnctccgccagccacgtgtgcacgctgccgatgacactctccacacccgatgtaccccagaacttgtcggtgatgagcngcatggagtccaggaggtt

SEQ ID NO: 711603 - DNA, 830 bp, Homo sapiens
  misc_feature (368)..(368): n is a, c, g, or t
  misc_feature (435)..(435): n is a, c, g, or t
gccctgagcggagaagactcgaacggctcccacagtcgcgggcgtagagggaaagaatctccggactgtgaaattgtgaggggattcatgcgctaagacgtcctcttccctctgtcgcatcccatccacaggcacatcgtcttacatctcacaacaatgatctcgtggacatccatggtgtgatgtgaagcttgacgactgaccgcctagagttggcgccacgaggccatcctcaccgtctcgtcattccaagctaagctagctcgataagttgtggtacaaggcgtgcggagcgcaacgtgatgagaccccttcagcgtggagaagcctagccaggatagctagaggtaaactatttctaaggtccntcatagccaccttcggatgtccaatccactgactaagcttgggcatggatggctcataacctgacgntcagctataacgaaggcataagtggtcgacttgtaccgtggcgtagtcatatgactgttggcttcacagaggtccttgtcaagaacaccactctcctagtcagtgattccagaaggctagacgaccttccagaatctagctgaccttgaacgggtgtgccggctagccggggggattccttgttctcacgacacaactaacgacaacccttgtccccatcccttgccaaggaatgtcttgcacctttcaaggctggatcaaaccattctttgtggaggattgccggggtcctgctaggcttgtgtctaggcgaaaagggaactccttggaaccccctccaagtgtccggaccttggggaaaagaggcttgcacgtcttgggatggttatttgcag

SEQ ID NO: 711604 - DNA, 410 bp, Homo sapiens
aaccccttgccttcccggggggtttttttttggggaggatgtttcctggttccatgttccttttccttgtgggaactttgcctggtagcctttttgcctgctttgttttccctacttaagaaaaaggggtttccattggctgatagaatatttttttttttgggccaaacttttttttgaagggttttgagggggtgaaggttggttaggggttagcccaattttttattttggctctgaaaaaatgttttttttttaacgtatttggtattcccatatagggctttaaaaatggggatgtttgctgtttaatgtgccctgaaccttttaccttaatattggactgttttaccttaatactgcctgcttttttttttgaattggataaagaatgtccttagccctttgga

SEQ ID NO: 711605 - DNA, 204 bp, Homo sapiens
cccgccccggcccaggtttgcagctcgggcgcagtcatcctcatgctctccctgggactagagttcgcattcctttacagaggatcatactgcgactgtaagtgcgttcgtagtctgattttgctccgctcactagtacttaggactgctaagtccgtgggctatctattagaatgactgcgccggttggccttcatgtcgggc

SEQ ID NO: 711606 - DNA, 301 bp, Homo sapiens
gtttatgatctatttgtagattaggattaaaatgggtttaatccctttttaaggctgtgtgaatttttttaaacaagaaccctttgcaatatggattttttagagattaaacccattataacttattagcagtcgcgagcccatgttcatatagtcaatgtaaaaataccctaatgagtatttggtaaatccccgtaggcttttccccttagcataattttgtgttggccaattaagttccaattacctctttaattttggataatattccttggttaccaataaagtgccaaaagctcca

SEQ ID NO: 711607 - DNA, 700 bp, Homo sapiens
  misc_feature (700)..(700): n is a, c, g, or t
gagactctgcagggccagttagaggagaaggcccaggcatgctaggtgcacagtcagatgtgccttagcctcggcccaacgggagttggctgccttccgcaccaaggtacaagaccacagcaaggctgacatgatgagttggaaggcccagtgtggccctggggcctggcaagaggctgatagtgaaaaatagcctcatcagcagacttggaggaggaggtgtccatcctgaatcgccaggtcctggagaaggatgggggagagctaatggtagttgaaagctgtgctggtgatgtgccgatgtcatgagaatgacgccagaagctcggatggagacggcttgcgcctgctgcgaggcatgagacagccagcaacagtgccatgagctgcagaacgcatgctctgctctgcgggaggaggtgcatgagcctccggtgaggcggctgatgaaacacgcggtgtggcttcaggagaacctgcgggaggcagctgacctcgacatggctgagcgtgcggaggatgctgggccaagaattgaaggcgtggcacggagaagttcttcctagaaacgagcaggccctctccaccctgcagctcgagcacaccgagcacacaggccctggtgagtgagctgctgccagctaagcacctctgccagcagctgctggccgagcaggccgctgcgagaaacgccaccgtn

SEQ ID NO: 711608 - DNA, 279 bp, Homo sapiens
ttgggggggtttgttttatcccttaaaatttgttccccttagttttgtggggatgggggttttgggtttattaaccttgggggggtccccttccccccaacccccctttggtgagaacatcccccttgccggtgcagcctttttgccccgggtaaccataaaaaagctcctttccttttttctttttgacgttggccctcccatccaatgttagttttatatatttgggctgatgaaaatttttaatttgcttttaccaaaataaatgttcctgggtga

SEQ ID NO: 711609 - DNA, 160 bp, Homo sapiens
  misc_feature (100)..(100): n is a, c, g, or t
ggtccagattcactgtgagaccaatcctacctccatcgtaaccccactaaaacactcaccaatgactcaacctctgacccccatgcctcagtgatactcnctcaatagccatctgctgtagtatacccaaagacaaccatctacttgttcctggtggtgt

SEQ ID NO: 711610 - DNA, 196 bp, Homo sapiens
tatgaatcacacaccacaatactatgcgtattgaatttaagtataatattaagtatgcatggacctagagctaatgcagctcgcccctgagttggcgagctgctagtattgtggtgtgttgaattcaatacgaactcaggggcgagctgccttccttggatgtggcatagtattgtggtgtgttgaattcaatacg

SEQ ID NO: 711611 - DNA, 276 bp, Homo sapiens
cgctcgttacctctcctgagcagcctcctcttgtcctcctcacttcacgtcactcacgaccggttggtcgggacctcggtcggcggcgctggcggccttcagccggtcctgtgccttctccttccggccaagcttgatcttcactttgacggaccgagattcggattcggagccttcctcctcgccctcttcctcctcctcattctcctcgccttcactgtcatcctccttctcgattttctgccgcacgctggtgaagaccgatggctcaggaaa

SEQ ID NO: 711612 - DNA, 199 bp, Homo sapiens
tgctgctgctggtgctctcgcgagctcccctacggcgccgcagtgcgtgtgtctggccttggtgctggtgttcgccggtggcaacctttttttggtgctggtgtcctccgcgtggcccttcaccaggacagcctctcccgccgcgtacacctcctcaggcggccctgagccacagtcttcgcctgctgggtaccgagct

SEQ ID NO: 711613 - DNA, 434 bp, Homo sapiens
cacgtcaaaagttgtcagaacaaaaggctgaagctgcacaagctgcctttgaagatgctgtcatcacaaaggctgttgaaaacgcatcagttgatggcgatgaaattcctgaagcaatgatcgaagaagacgttcatcgtcaaatcgaccaatacttgggtcaattgcaacaacaaggcatttcacgtgacatgttcttccaaatctcaggtcaaactgaagatgacttgcacaagcaattcgaagaaggtgctgcaacacgtgtcaagacaaacttggtacttgaagccattgtgaaggctgaaggtatcgacccaactgaagaacaaatcactgaagaagtgaacaacttggctgcacaatacaacatgggtccagcacaaatccgtgcacattgtcagattcattgttgaagattgcatttcaattcagtt

SEQ ID NO: 711614 - DNA, 205 bp, Homo sapiens
  misc_feature (90)..(90): n is a, c, g, or t
agaggtgtttgctggggtgactctagcaggatctcagacgacagaagggagaggatggtttctcttctggcctcactaagggctaggganaccaggagcaaattccaacacggcttccatctctcaagcaaggagaagccaacttgtgtgacgtttagttccaaccaattatagtaacgtggacgaagggattgggccggctccc

SEQ ID NO: 711615 - DNA, 313 bp, Homo sapiens
ctgctgttctgctgcggatcctcatgagtgctatgccccattgtccaatgaaggtcagcctcttgtggaagagtgtcataatagaatctaccgttgatagctttttgagcagcttgcagagtacacattgcagaatgcgctattagcccgttacaccaggatagtatctcaagggtcaactccaactattgcagacgtctctagatacctatgaatagtgaacagctcatgttgataacttgctgactcactgagagtgccctgtgcagaagactatctatccgtggtcctgccagttatgagggttgcatgg

SEQ ID NO: 711616 - DNA, 1077 bp, Homo sapiens
ccacgcgtctgagaaaacaggagggaagacagtagaacacagagcctgaccacattttcttttttctctctgttgccggggctggagtgcagtggcacgatctcggttcactgtaacctccacctcccgggttcaagtgattcggcctcccgagttgctgggattacagacacccgccactatgcccggctgattttctttttttttcttttattgaaacggagtttggctcttgtggctcaggcacgaagtgcaatggcgtgatctcggctcactgcaacctccgacctcctgggttcaagcgattctcctgcctcagcctcccgagatagctgggattacacggtgcccgccacacattcctggctaatttctggtatttacacgtaagagacgggggttacacccaatgtaggccacaggcaggtctcaaactcgtgaccttgtgatccgacccgacttggcctcccaaagtgctggacatcacaggtgtgagaccatatgcgcctggccatgcccagctaatttctacggtatacacagtatacgacacgggtcacaccatgatcggccaggctgaacccttgaaatcccctggcaaccctgccttacaactctcccgattattcccaaagtgctacgagactccacaggtagttgagccaaacaatatacctggcccggaccaagggaacggactatgactctcacttgaccctcggtgaatctagacacgaccatagcagaccgtccccaacagtgtgcctggaggcactctacaccatgggcactagtagaagaccacaaaaccgggtagacacccggggaaccggccccataggcgcctcgggacgcgcacttctatcgcaacacgcaatggcgcaaaacgcgcggaacattgaacgaaacatatacagcgacaccgggagaaaacgatagatgtgatcagcccccacacaacggtggatgctgactaaccacaagcgatcaacgcgtgcgcaatctaacaccctggaccacctagaccccgcagcgacagacggcactcacaggaaaacaaccacaaccgatgacgcc

SEQ ID NO: 711617 - DNA, 497 bp, Homo sapiens
taaattttttttaaaaggggggggggggtttttcccccggggggaaaaccctggaaaccatttttggaaaattccctttttttgggggggggggtttttttttttccccccaaaaaaaaaccccttggtttccaaggttttttttttatttttaaaaaatttccaaaaatttttttttgggggggggggccattaaaaggtgggccccccccttaaggggaaaggggtttaaaaaaatttttttttttcccaatttgggggggggggggtttttgacacaaaaattgggggtttttccccccggttttttttaaaaggaaccccgggaaaataattggggttttttaaactttgggtttcttggggggaaaggggttttgggttttaaaaaaaattttgcccattattttttggtaaggtttaaaagggttttttttctttccctttttgggggggtttttttaaaaaaaagaaaaaaagggccctttttttattta

SEQ ID NO: 711618 - DNA, 146 bp, Homo sapiens
  misc_feature (106)..(106): n is a, c, g, or t
  misc_feature (141)..(141): n is a, c, g, or t
tggctgacggtcgactctacgacggactccccccaacgcgttggacttgttcaccccacctactacgggacaccgtgacgctgggtttacgacccgtcgtgacganacggttacgttttacccctacctgactgactgtgnttgtt

SEQ ID NO: 711619 - DNA, 283 bp, Homo sapiens
gccaggatgggagtgcagcccgggctgaggtgtagcagtcatctgataccatgacatcatgatgcagcttcttaggcacaggtgcggagacgatgccagtgcccctgggatgcaggcatgaggcgtatcagcacagagccgcagcggcctgtcaccttgcaagggacagtgtggggcttgccgatcttgttcgcccagtagcctctacgcacggggacgatggagagcttgtgcaggatgatggccccacggatggcggtggacaactccttggagcacttaa

SEQ ID NO: 711620 - DNA, 163 bp, Homo sapiens
tcgtcgttgttcgtgcaggtgaggcttactagaagtgtgaaaacgcaggcgttggattaaggcgacagcaactttctaggatagttcagtagaattcagaatttgttgaagatgactaggtgtactgtcgattacaggttgtgagccactgttgcccggccca

SEQ ID NO: 711621 - DNA, 885 bp, Homo sapiens
gtgctcctccctttctttttatactgacttcttttaaaattatttaacctatttttagtattcaattttaatttatctattttagtttggctatatcactcatatttttagtgatggctctataaatctcatagaaattcattatttcatagtctgctgagaatcactattttacaaattcaaatggaaggtagaaacattaccataatattggtttataaccctcacacctttatgtgatactcatatatatttctgtacattgaaaacttcatcagatgcttataatttttactttgtcagaggtaaggacttcagggagaaaattagcctattttatggacctataatatttattatggctggtggctctttatgccaaagctaccatttggcctggacatcagcaagaagaatagagaactgatgcacctcttttttttatcagatgagttttttctaactgggaccataaaccaggtcaaagctctagttggctaaattttgaatcgatcaaagttttataaatattccttaataactctcttccttcttttcctcatcctgatctgatgcatgtgcctgtacacgtacacaattcacccaatatactcaattgacacattatattctatatagaatgtgcgttctcaacttttctgtttgccactattttaatctcctttggtaacttgggtcttaattggttttaccgtttgtgtgaccttttctgcgctctggaatattgccaatcagagctgcagggggcgtcacaattaacggggccttaaccccagaacctggcggggcttcggaacaagggagagacgcttcgttgttaagcaccatttgggtggccaccgagcatctttgcccaacacgctc

SEQ ID NO: 711622 - DNA, 449 bp, Homo sapiens
  misc_feature (425)..(425): n is a, c, g, or t
agagtcaaacagtgccccaacgaagttgacaatttgggcctgctgggatccatgtagtgagcactaggctgctctttggccaaggtcttcataagtgattaattttctcattatctgtcctctagccccacgccctgatttatatcgtggcaaaggaagaacttgaggtctagaccaaccaaatctgtgaattaaagctgttatttttttctctgcaagggcgcttagcttcaggtctgggctatgtgcagaacctaagcaggctgtgagagttagaagaggcagtattacatgttcggcccagaacaccatgggaaaaggtctatgtagtgtatcttagtggtctggctagctgtctctgggccaggctgacttctgatgtccacatttagcgtcgtacctgaaccctgttgctgaattgcagncctgttctcctgtaactattatat

SEQ ID NO: 711623 - DNA, 240 bp, Homo sapiens
tttttcccccctccccatcctcatcagccggatcgggggctgtgcagtgtggtcagcatggtgaaaaaagtcatttcctcgttgggcagtattcctttttatttttcattaccctggaaatgttatttttgctgtatcatccgggctcaacgttttagtttgtcagggtccccttttttttggaaagaatttggttaacttgacattccatgggccgctaataaaaaatattttgaaaga

SEQ ID NO: 711624 - DNA, 146 bp, Homo sapiens
cttatggtggatgggctgagcccggcagtcaagtatatagtgagctataatcatgccactgaactccagcctgggtgtcagagtgagaccctgtctcaaaaaacaaacaaacaaaggcacagagaagttaactaacttgcctgtgg

SEQ ID NO: 711625 - DNA, 475 bp, Homo sapiens
acctcctaccccacggaatcataaaatgggaagttggtcaaaatcacagatggctggcggggcacggtggctcacacctgtagtcctagcacttggggaggccgaagagggcagatcccttgaacccaggagttcaaaaccagcctggataacaaggcaaaaccccatctctacaaaatagttcgctgcgtgtggtggtgcacgcatgtggttccagctactcaggaggctgaggcaggaggatcacttgagcctgggaggtctaggctgcagtgagccgggacgatgccactgcactccagcctgggcaacagagtgagaccctgtcccagcactctgggcggcagaggagcccagttggagatcagcctgggtaatatagtgaaacttgatctctacaaaaaaaggagaaaaagaaatagcctggtgtggtggtgcgcacctgtagtcccagttactgggaatgctgaggtgg

SEQ ID NO: 711626 - DNA, 775 bp, Homo sapiens
accatgcgtcgggcgcgcgggcccagataggtatagtgatagcatgggtcataggctgttttcgctaggagatgcctggctcatgacttagtgctctggatgttctgcactcgaattagagaaatacgcccgggggaaaatccgtagcgtactagaacataatccagaatggcagttcatgaggtcgataactggaatctatcaactaggagttccaagtcgagacgtcggatattcagacacttacagtcccgcgggcctggaattcgactggactttcccctagttcgtcaggggctacagccctaagaccgaaaccgtacggccacaaattccatcttcgactaatcagtacttcagtcgggcgttaagatcctaagctcttcattcccagcaagcacatttcctcgggccgtatcgcggacatgcacccggacggttacatcgggactacacccggatgcgatacagccagcattgaagacgatcctaatcagtctggtagggctcagttcgatgttctcctagacaggcaggtacatattcaataactctttccatgactttgcagaacgcccttcggcttcgcaagcggaaacagttcctacatagctagcaagaaccgctccagtaaggcctgcgagtgacgtatatggactgcccccgcgaccttaccacacagttcgaacgaacccagtataccataacaactctagacaactctcggatcggaactcgaaccgcccccacaagctgggtttcaagcccaaagcgc

SEQ ID NO: 711627 - DNA, 231 bp, Homo sapiens
gttcggcacgaggtacaacaaacccctgtgacatgcaatttacctatatagcaaacatacacatgtatccctgaacctaaaatataacttaaaaataaaaatattttcttttcattttttgtattaccagtttagtgtcctataatacctctcattaagcctgttgcatagtctccaagctgtatttcatgcattccatattccccaaccaatatatctccacgtcggtac

SEQ ID NO: 711628 - DNA, 228 bp, Homo sapiens
acaagagtggtcatggcccaggatgtgtagccttgagttagatcaccttgtacgcactctcaaccacctgcttgtgcacctctttccacatgtgccgtatctatgtcagtcccataaatctgggtgcagagtcttgagcggagacaccagataaacattatgctttactcctatacagcgcacactacgactctccatgattccccaaggaactcaccctatgacagc

SEQ ID NO: 711629 - DNA, 127 bp, Homo sapiens
tcacggcaacctcagactcccggggtcacaattctccggcctcagcctcccgagtagctggggattacagggcgtgtgccaccacctcggtggcatggaaatgagaccccgtctggggtaccgagct

SEQ ID NO: 711630 - DNA, 918 bp, Homo sapiens
ggagagagagagagagagagagagagagagagagagagagagagagagagagagagagagagagagagagagagagagagagagagaggagcgcgctagagagacgcgcgcgcgctctcgtgggggccccccccgctgctgctacgtttcttcatgcttgtgttgtgtcgtcgttgagcagacgagatatgtcttcttcttgctgtgtagtatcatctctgcgctgctgttgtgtcggtcctcgtgtgtgtgtgtgtgtgtgtcgtaggtgtgtgctgctctcttctttttctctcacaggtcctatatcatgtgatgagcagcatcctcggtggtgagtcgtcgtcttctcttgtgggcggcggcgtattgctgctggctagctagtagctacaaagaggagtagtatactcttctttgttgtagtagtcgtagtactgacgattcggacacagcaggaggaggtactatttttcttctcttctccgtcggtatagtatcctacgaggaagagagtatacacacacaacatcatccatcatccaacgaagaacgaggtgggtaggaagcgtcttcttcttctactaggtagttgttaggtatgtctgtctgtcgtcagtagtgactgtctctctcttcatcgtaaatagctgtagtcgagtcggtcatcgatgggggggcgcgctcgctggtagaggatgtagcgagcgatcgattgtttctcccggccgacgtaggtagattgtaagcggccgcgtgtccttcattcattatgaagtagtcatagatcaccatgtggggcacaaagaaggagcgcttttatatggtttggtttatttatactaactaggctgttcctcgttgctgccgtgtggaggtagttaatagtgaaggagcacgaagaagcaggagaagaac

SEQ ID NO: 711631 - DNA, 582 bp, Homo sapiens
gctgttacagagatgtcttctttccttaaacgtcatgaggcaacttctgctagcttcgaactgttttgttgcctcaaaataaaaagagattgaggaagttcgttgtaggatggccaacacaagcgaatatcatgacacgatcatgaagcaaactgggacacacgtattgccaagcataatctggacacaagggctaattccctgtatcaactctacacgagatgttaactaaaatcatgatctagaagacaacttacaacacgaaggacgggtacaagggactctgaagaacctcagttataagacaggaaattctacactggctcaggtacattcactagtgacatacagagatgccctaaatcttaataatacgtaatcagacgggtacaatggaagaaagattcaccaacagggggtagattcgccgtagtgtgacaagaagcaaatttgtgaaccactccgtacatatcatatagacagttggtgttgtcacaagttatggaagatcgtaaacttttcgtcgctatctcacatagacagggtacgctggggaacaatggcagcatttatattagagac

SEQ ID NO: 711632 - DNA, 335 bp, Homo sapiens
gggaagggagaagcccacttacccatttatgatttgaaagtcggaaatttgtaccatttgttggagtctatgcacatttaaaaaatatcatatagtaaatgcacacatgccacgtattttataaagattaataacacacctactcttacctggcggtttacttaacttactgttttgagtcctaaacttagagatgctaatgcttatatataatctaaccaaagagttacacagtctggttttagttctagaactgttattttcttggtgattataaatgctgagtttggaatatattgcgcaaaagaagtttcattttggttacttagacctaa

SEQ ID NO: 711633 - DNA, 435 bp, Homo sapiens
gaccaagtacatgtcagacggatacagataacaccttacccggtctaggttatgaacacccggtccaggttgaacaagacaccttctacacggccagtgccgtactggcacgagcagacgaactcagctactttgggcaggaggggatgacggaagtgcagtgtggaaaggtggccttccagttccagtgctcctcggaacagcaccaacgggactggggtccaggatgggcagatccctgagctcattttctatgcctgaggtgcccggggaaggctgcagcaggtcagcgagtgagtggaggggaagtcaagatgctaactgcttcttgacaccatgaaaggctgctcttaactttgtctctctttgacatgtagtcggctgaagcttgactgtgtagagacattttccacacagccagaaccacaaatatcg

SEQ ID NO: 711634 - DNA, 1506 bp, Homo sapiens
  misc_feature (406)..(406): n is a, c, g, or t
  misc_feature (516)..(516): n is a, c, g, or t
tggaaagggatttccactcttggctgcccaggttgaagtgctagtgggctcaatctcgggtcagtggaaacaactcgcgcctccggggtcaaggttgattcgttccgtgcctttgagggcctcctgtgtagtagtacgacgggggatctaacagggctgcctataccagcaagtgctgcgggataattctgtgcggtactctattgagctaagaataaaggggatcttcccccactgtgttgggccgggcgtgtggtcatcaacacttctgtaggcgctcatctccaccccgtggccgtgcgggccctcccaaaagtgggctggaaattctaacggaggcgttgaagccgtcgcagcgccgcgggcaccccttggacaagatgtcctgcatcgtggagtcaggggntgagggtagcgtagtccaacagggggcatcacagtgcgggggacagaagaactggggcccacaggcgggaaggagagagaaaggactctaagcaagtgcactacctcggngggaaaacactgggggtgtgctcccacggagcacaggagagaaagcagcctaggggaccctcttcggcgaggagcaaaaccttccgatgccatggatattcagagtcatctggacccgaggcaagacgtacctgagtacaacactaaaccaagtgggtgataaacaccccctcactgggggggccggccattgtaatggtagcacaaatggtagcacgtatgtcaccataggggcaccgttggttataacaccccacgagagggggcgggagtaaccacccaacccccctttgtgagggaaagccctctggtggggacaacgagcgacaaggagtctctttccagtcgaggctggcacatccaaccctgggagtccgtccgtgggaaaagaggacgcatgcaccctaaggcaaaagatgtgggcgagacccgttgggaagcaaacacaggaaactcgtcagtcggtgggtcggtggggcgacaacgcctcaacaacgtatcaaccaccctttacgcacagtagaaagggcccatcaaacggaggagaggggagtccatccacgacacctatttgagagaccatccatgacaaccatccgtgtggggaggaaaaagataacaccactaagtaaggtgaggagagcaaacgacccacggtgttaccacctaccaagcaagcgccacaataggatccccacgaatgacaggcaaacgcacagaggaggaacgaagagcaccaccaccgagcctccccgaggcacgcgtgtgtgacacacagaggagacaacggccagagaggcggcggcgccaaaccaggggaaagcaacaacacaagacagaaaagatgggcaacgccccgacgtcgtgccgaacaggcggcactagcgacacacggttgtacaaaagagggtggccaaacatgcacaggctcaaccacgcaatgtgaagtggtcacacgggacaatacagacaacaagagccaaaaataca

SEQ ID NO: 711635 - DNA, 182 bp, Homo sapiens
gttcttcggagagcacctctttggagtctgatcttttcccgacgtctacttccctgagtcccttctaccttcggccacctccttctgcggcaccagctgtttgacactggatttcagaatgcgctggagaaggacagtttttttaacctggatgtaagcattttcccagagactcaagtaag

SEQ ID NO: 711636 - DNA, 368 bp, Homo sapiens
agaggaccaggtctgtatacagaatgattatcgagacatccgatacagagcagcagacgtgtgtggacagtgctaaaatgcaggactcaaacaggccattaatgtggacaaaagtcattcgaagaggaggcacacgtggtgtctgggaaaccattttatgtcctataatgcactgtaacaagggagtttgacaatgggcaccttctcttaggacatttgacaaggtaagtaggatattcataatagtgaatgctgaagatctagtgagctaccaagtgatttcataaaatgaaagcgtaatgctcctttgccattatgattatatagctttatattccaaactcaaattattttgtgccattatgata

SEQ ID NO: 711637 - DNA, 468 bp, Homo sapiens
agaagctttactctcgaaagcggggttagcatgagctatatatgtctgcggacagactgggtggtctagaacaggtatccccaaagccccaggccatagaccggtactgacctgtgtcctgttagaacccaggctgcacagcaggaggtgagtggcggctgagtgagcattaccacctgagctccacctcctgtcacatcagcagtggcattagattctcataggcatgcgtactctattgtgaaccgtgcaatgcagggatctaggttgtacacttcttatgagaatcttaactattgcctgatgatctgaagtggaacagtttcatcccaaaaccaaaccactaccggcaccccacctccgtccatggaaaaattgtcttccatgaagccattccttggtgccaaaaagattggggactgctggtctagaacgagctcaccaagaccctgggaccagcacaacctg

SEQ ID NO: 711638 - DNA, 652 bp, Homo sapiens
cattagttatcattagttaataataaaagagaaatatggaaattatttacatgacgaaagattccagaacttcaggggaaggggcagcatcatgtggaggccattccaatagtgacttattccagtctacgtacttcccaagaatgtcaccatctctaaataggaaataatcctggtcatctagaactacttgggtgcctccatattcggggagaagaactttatctccaactttcacgctaacgggttgaatctctccaccctttcctttagaacccgatccaacagcgactacggtggctggcaatacttttccttgagatttttctgggaagcataaggcctccttgggtgcacagtttcagcagcactcctttacaaccaatactcggtcaaagagtggaagaaactttctaaacgctggtccgggccattattccctcggctaaaagtcgtactcggctctagtgtagcgccgaaagagactcgcagtccggcccgggaaggaactcaatgaaaagaattaatcttacagtttaaatgtcgcagatttccattattgtatggatttcgcaacttaggatgttctggagcccatggtccattgcgatgcgtcaactctggttattcacactctctcggtgaaaaccga

SEQ ID NO: 711639 - DNA, 592 bp, Homo sapiens
tttagtttctctacactgtctgtaacctgtagtaggctctgacctagtcaggctggaagcgtcaggatatctttgcttcgtgctggtgagggctggccctaaacatcgcacctaatcctttcaaaatcagcccggcaaaagctagactctcctcgtgtctacggcatctcttatgatcataggtgccatacaaggaccccaatttgtgcttcagggggataatctccttctctcggatcattgtgatggatgctggaacctcagggtatggagctcacatcagttcatcatgggtgggtgtagagaattcggtgacatgccctagtgctgagccttggctgggccatgagagtctgtatactctaaaaagcattgcagccatgggtgccccatcttctgaccaagcagacagcacgaagccatcccacccaaagaaccccccaaattcaacgagtggatgtgggccctgtcacagggtagacagaacgctattaagattaacttcttttcattggcccacagtactccccagcaaaaatgattggttttgagatcccctatagttttaaactaccctcctctttaacactgg

SEQ ID NO: 711640 - DNA, 188 bp, Homo sapiens
atctgggatggtcagaacatttagattgtcctgtaatgcctctagtcttacacctatttccctcttctcctgctcactgcttcatagaagagactgcaaatgccactttatgttgagacagtgctgcctgcagtgccagggaatgcactacctggggcttgcagccctttgaggcagcatcccgggct

SEQ ID NO: 711641 - DNA, 175 bp, Homo sapiens
ctggttcgttatgacattaacactattctcaccagacctcctagtgcgacccagacaattataccctagccaacccctcaaacacccctccccacatcaagcccgaatgatatttcctacttcgcctacacaattctccgatcctgtcccttaacgaactacggaggcgtccttg

SEQ ID NO: 711642 - DNA, 309 bp, Homo sapiens
tgcaagggagccacacagcaggaggtgagcggtgtcgagtgagggagtgagggaagcttcgtctgtatttacagccactcccctttgctcacattcccgcctgagctccaccttctcagatgagcagcagcattagatgctcataggagaacgcaccctgttgtgaaccgtgcatgtgagggatcgaggttgcgctgtccttatgagaatctaatacctattgatctgtcactttctcccatcacgctcaggtgggaccatccagttgcaggaaaacaagcttaacaacgcccactgattctacattat

SEQ ID NO: 711643 - DNA, 556 bp, Homo sapiens
aggaatacagctatgacttacttttttaggattgtgacgatgatcttcacagggtaggcattatggcacatagctgaagtccaaaatgactaaaaagattctgagttctctttctgtcctgttctcaggttgaggttggctattgattgactgtgttgactccaccagtcctgacttataaaaccctagcggggagatagatccggtgtccaaaaaaaaaaacactggtgtacaaaacatgtctaatcaggtttcaagccaaacaaactcatccctgagggaagcttactcattgaggtattggggagttgcgctggcatgtgaggaagtgccctggggaaaaaaacgcagaggtgtgggaccaatcctgactgtgcacacgttttccgccatgtgcgggtttgaggcaccacggaggtccctgcaggagccctgggaaaggtacatccagagaggggagaagaggacagagcaaaactaggaacaaaactgggcttgaggactgtggaacagctgactattgaggaacagaagaactgactgaaagccaatgtgt

SEQ ID NO: 711644 - DNA, 290 bp, Homo sapiens
cccctttgtgcttgataggactgctggttttgactctcggcatcatgctgctgatcgataatttgcctgctcatcatattagccttgctgttgatcatagcctgactgctggtcatctgaatcttgttgaccatcgtctggctggtcataggaaggtgctcttccaccttggcttcctgataattccatgttttgcagcaatccctggttattatatggtagctggctatataagctctgcttatgattctcataagcaccataggactgtgaataacctgactgactta

SEQ ID NO: 711645 - DNA, 375 bp, Homo sapiens
gcaccatcttgttaaaacataaaagatcatgcagagtccacttaaaagcttaccaaatatctcattgtacttaaaataaaagctcaaatttcagcaatgcctagaaggcagcgaggagtggataggtattagaatggctgctgatgtggattgcctggatttaaatctttttcttccttttttttccccgccatgacaggatctcactctgagcgatactcaggctggagtgcagtgggccaatcatggctcgctctaacctctgattcccagtctcaagcaatcctcccacctcagcctcccaagtagctggtattacaggcatgcaccaccacacctggctaattttgtatatttagtagacaaagggaaaca

SEQ ID NO: 711646 - DNA, 1735 bp, Homo sapiens
aaagctgagtcgtgggcacctgagggactacctaccactgctcccggctgtgccatcgccaccagctcccagcctcctgctcagacccgggacagcccctccatggcccccgagatggaccagttctacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccggatgttagctgatggacgcctggttgtttccactctttggctgtcatgaccactgctgcgctgagcatccatgtacgagtcttcatgtggacatatgttttcatctctcttgggtatataagagtagaattgtggggccatatggtaactctatgtttaactgtttgtggaacttccagaccgttttccggagtgtttccgtgtccatcagcagtttatgagggttccagttgtttcacgtcctcgctactttccaacaccttcctgcagttcttcggccggatgttagctgatggacgcctggttgtttccactctttggctgtcatgaccactgctgcgctgagcatccatgtacgagtcttcatgtggacatatgttttcatctctctctcaaaaaaagaaggcagccttagaataagatttaaagaactctaggtgcccgggcacggtaaattgtctttcttattcatcttcgctaattagtctttgcttagtccaagtctagtcagtaacgtgccttcccacctcatccttagcttctctcgtttactgcagctgtgcaaatgtatctccaggataaattcctagaagtggaattggtaagcccaagaatatagtcattggttgcaccagtttacacttccatcagtgatgtatgagtttctgtgcttctgcaccccttgacaacagtgtatgagcaaactttctgatcttggctaattagaaaggtaaaaatggtatctcggtgtggctttacctcatacttgtcttaaacgcgagcttgacatcttttcatgtttcaaagccattggattttctgtgctgtgacatgccagtatcttttcatccacttattaatttgtaggagctcttgatatgttactgaaaccagctttttcttggtgatgagttgcaaatacaatagccagtttgccattatcatttgcctgtgttatgattggttttgctatacaaaaacattatttttatttagtaaaatgtatcggtcttttcaagttt

SEQ ID NO: 711647 - DNA, 1225 bp, Homo sapiens
gacccacgcgtcgcttaaatgccatcgaaaggttcttagaaactgactttaagcaataatgacacgtagcacaactgttcttgaatgatgtcattctcccttaacgtggttctgtaacatcgactgaggcaaaacaaaacttggttctctgcgctcattctcacttttacttcttctactcttacttctctcttgacgacagcagctccttgaccctgctcgcccagtgctggcacgtgcaactggcacagatctcgcactcgactgcacacccgtctgtcctacctgggctctcacacgcacgactctctccctcgcctcacgcccctccacttacacgcgcgtgcatccacccgatgcctccgcgcctacactcccccctgctactcgtctctagttcacgcagtcggcggcttctcaccccactgcctctgcgcgcacggcctggctccttgcacactccttgacctccgtgcatcgcacccacccgctggaccatcccaaaagctgctgatctaccaggctgatagaggccaccactgcccagccaatgctcactcttcactattacaagctcacacactttccactgaactctcacacaagctgaggaccatgcatactatcctcgctccgccatgcccgctttcttcctttaccgcgacacctaacaacaggcccccactacttcacaccacttccactcttacctttacacgttctacaccgcgaacttccccacgaactccaccatataagctggtcccacactccgctccagcccccggacttcacctctgactacctgcttttccgaccttcgcttaccacccggcccacacccgccccgcgtcccctcgcaccctccaccctcacaccccaccctcctgcctcgcaggcttacctgccttcccaccgctccctccgcctttcgatccaaccccgacccacctccgcaaccccaacctcgcaccacatctaccccgaacgcccagcagcccgcaccctccaaactcccaaacccaccccccgagcacaggaccggggccggcaccgacccagcacacaatagtgacatccaaaacacacgaccaagtaacacagcacacagaacaagaccacaagcaagaaaccaccaccaacacgcgacataccgaaaaaacgaaccagagtgaaccgcgaaaacaaacacgtagagaaagaaaagactacaagaaacccccaa

SEQ ID NO: 711648 - DNA, 289 bp, Homo sapiens
cccgttgcagatatcctaagccaaagcctatcagagtgaggcctaactcgcctcatttctgtgaagacagagaggtgaggaagctgcggaagaaaagttggttcatgaggtttaaggaaataagctgtctctgtaacataaaagtgcaaagtgaagcagcaagtactagtggagaagctgcagcaagtcatccagaagatctagctaatgccaggcatggtggctcgtaattgatcatggtgtctatgatcccaccactctgggaggccagggcaggaggattgcttga

SEQ ID NO: 711649 - DNA, 204 bp, Homo sapiens
ctccacccggagggtgtgggggaggttgtgtcagtcgcagagaatgctctgtgggagagaatgacaggaacttgacatgatcaatgttacagtacagtaggaacagaggcagccagccaatttggcacagttaacggcaagtacgtcaagccattcactcttcccgaagccggggatgccaacggtccagcacagcacctttaa

SEQ ID NO: 711650 - DNA, 686 bp, Homo sapiens
tggattagttgaacgtctcctcatgaaatctgaaggtctgtatattgattgagactatctaaactcataccgtgtatgaattaagctgtaaggactgtattgctctggttgtatacttttgcttttcaaattatagttctatcttctgtataactgatttataacaggtttgtacatttcttaatactcatgtcaatttgagaacaacaggacatatgaggttttcgcgatttattagtgaaacttccgtttgaaaaactgcttgagttatgatctctgattcattgtccatttctactaccagagtattagctagggccttatgaatttctgtatatgaaattatatcttcgtcctattaagatctagtcacggaatgtcatttcatgcataagagctaaggtaatattgcgaatgccatatattcaaaaaatgctcaaacgataattttctttgactgatttatgttcaaataatattcaatatgcatattatctttgaaaaagttaagatgtttctttaatcttcaagaaatcatgctacacttaacttctcctagaagctaatctataccataatattttcaatattcacaagatattaaattaccgaatttttcaaattattgtgtagttaaatgaacaaaaatgattctctcccaaagaaagacacatttgaaatactcc

SEQ ID NO: 711651 - DNA, 109 bp, Homo sapiens
agggtaaaagaacgccccttgaacccttattctggttcaaggcggtttcttgagaaaaaacgaaccccttgtaaccaataattctgcttcagggggtttccttaatgta

SEQ ID NO: 711652 - DNA, 775 bp, Homo sapiens
  misc_feature (86)..(86): n is a, c, g, or t
  misc_feature (100)..(100): n is a, c, g, or t
  misc_feature (109)..(109): n is a, c, g, or t
  misc_feature (115)..(115): n is a, c, g, or t
  misc_feature (120)..(121): n is a, c, g, or t
  misc_feature (143)..(143): n is a, c, g, or t
  misc_feature (148)..(148): n is a, c, g, or t
  misc_feature (164)..(164): n is a, c, g, or t
  misc_feature (169)..(169): n is a, c, g, or t
  misc_feature (171)..(171): n is a, c, g, or t
  misc_feature (193)..(193): n is a, c, g, or t
  misc_feature (196)..(196): n is a, c, g, or t
  misc_feature (200)..(200): n is a, c, g, or t
  misc_feature (215)..(215): n is a, c, g, or t
  misc_feature (218)..(218): n is a, c, g, or t
  misc_feature (268)..(268): n is a, c, g, or t
  misc_feature (281)..(281): n is a, c, g, or t
  misc_feature (308)..(308): n is a, c, g, or t
  misc_feature (315)..(315): n is a, c, g, or t
  misc_feature (339)..(339): n is a, c, g, or t
  misc_feature (395)..(395): n is a, c, g, or t
  misc_feature (399)..(399): n is a, c, g, or t
  misc_feature (403)..(404): n is a, c, g, or t
  misc_feature (408)..(408): n is a, c, g, or t
  misc_feature (413)..(413): n is a, c, g, or t
  misc_feature (420)..(420): n is a, c, g, or t
  misc_feature (427)..(427): n is a, c, g, or t
  misc_feature (430)..(430): n is a, c, g, or t
  misc_feature (437)..(437): n is a, c, g, or t
  misc_feature (441)..(441): n is a, c, g, or t
  misc_feature (444)..(444): n is a, c, g, or t
  misc_feature (476)..(476): n is a, c, g, or t
  misc_feature (756)..(756): n is a, c, g, or t
tttaaaattcaaaaagaaaaaaaagaaaaaaagacgatggccccggaaggaatgcacaatttgttttagtttacagcacagagatntttctctcaatggnaatagtgcncttggnttcannaataagtgaaggaaaaaagatnttgcncattagaagaactgangggangngtagggagtccaagtaaaaaangangganaagataagcacacanggnaacgcgtccaagtaggaatggtcttccagtctccatggcatccacatgcnactggcgtaagtnccagatcttgaggaagctatcccaggnccctgtngccacagccatgccatcgtcagtnacgcccaggcagctgacgcggttgtcatgcccagccaagacacctgcccggtcggntttnagtnnatcncagangttgcantaaaaanaantcgtacncagnaangaggaggcgcccgctcttggagaaggagacanaggtgatcccgcagatgatgttgtcatgggagtaagtcatgagctcctggtcagcacgaaggtcaaacagcctgcaggtggcgtcgtctgagccaatgtgcaaatgcattgccatttggaaagaagcaaatggcattgatgtcagactcgtggccagtgaaggtctgccggcacatgccttctcgcacatcccagagtttggctgaagcatcacaagcaccagagacgaacagtctggtgtcaggagcaagagaaaggctcatgacatctccagtgtgtncggtaaacgtggtcgtctg

SEQ ID NO: 711653 - DNA, 883 bp, Homo sapiens
tcccaactctcctttttttaaacggggggaagagggcccggggccccccccctaacctttggcgcccttagaaaaaaccggggtccaaggggtcttgtcccctccctctctctctatagaagggggctctccgtccccctcctccgagggactcccggttcggcctatttccccccgttcgtgaggagcagtgtggccacagagcggcaactagttggcagtagtgaatgggtcttagtcaccccacccccagcgtatattacacagccactcctttgtgctcaacaaagaatctctcaatgtgtggcccaagaaatagacaacacagagggagagagaataaaacaggaacacacccaccgaggggttcacccaccaagctgggtgaggaggaatgcgccaaggaacaccccattaatagttccctcttataagaaggaggagcgcctcaaaggacgaattttaagtaaagttataataaagggcacgccttccacaccaacagaaggtacttgctaaaacccaaacccggagaacaacagacgtggagaacagaaaaccacaagaccaaaaggagcgagaataaaaacggacttactatcgaggaagaagagggcacataagagcacccacccaccctattagggaacccactgttgatcagaagcgggaacaacaaatgagggggcctcccaaaagagaacacgtgaagaggagcgccccatataaaattattcacccccctatattatggctacaaaaccaggcatacacatgacagggggacccccaatcacaagtagaaaacacccataaagggagacaacccctataaaaacgcccaaacaaccttggtggcagatgaacatattaagcccccggg

SEQ ID NO: 711654 - DNA, 1298 bp, Homo sapiens
tctctctccacccccgcgacccacggggggggccccggggggcaaggttaacacagggcccccacacagcgggggggggggggggggggggggaccacacacacacccgggagcgccggacatttgtgtgaaacaaaataggtctcccgccccacacacacatcccacaccacacacacaacgaagccgcacacgagacccgggcgaacaacgtgagggcgccggccacacggggagccacatcccccaccccgtggtggggaccagcgagccaacaacaatgcccggggagcacaaactcaacagaaccacaccacaggggaactccaccccctccaacaacagcgggatatcccaccctccaacccggggaggcacaagggggaaacacccacgaaccccacagggagatgcggcccaccagtgggacacacacacacagagagaaaaaagaggaacaaaaaacaaacaaaacaaaaaaagaggaaaacaaagaagcagaaaagtaaaaacgaggcccacgggaagcaccacaacactacacacacgcacagagaggaaccagggggaacaccacacgcggcaacaacacaccacacaaaagacccaatagaagaaaaaaaaaaaaaacaaaaaaaaaaaacaaaaacaaaaaaccaaacaacaagacaaaaaaaaaaaacaacagtggtgtgagatccacccccacaaccaacaaaccacgcaaaacaacgacacgcaacaaccacaagcaataacgaccaacaaccaacacaaaaacaacacagagaacataacacaccagtaggagataccaaccaacactcaaaaataacaaacaccacataggatacgacgacacacagagttgacacaccccccaaccacacaaacaaaaagaaacaaaaaaaagaggaagacaaaaacaaaaagaaaaaagacacaaaaaaaaaagaagacccaacaacagacaaaaaaaagcaacaacaaaacacaaaaaccacataaaaaagaaaaaaagacacaaaagagaaaaaaaaagaaaaaaaacaacacacaaacaggaagagaaaaaccacacagaaaaagaacaaccatgattaacaacaacaaggaggcaacaacacacctcggaaacacacaacagaaacatacacaccacagaacaatatgatacgaacgacaacaacaaatagaaaaaaaaacaaaacacacacaaggtgaaacacaccacaacaacgaggaacaacaaaacaaacagacacacacaacaaagaaacaaaacaacaagaacacac

SEQ ID NO: 711655 - DNA, 573 bp, Homo sapiens
tcgggacgtggagacgccggggtcccgagcagcgggcgggccgcgggcccaggtggggatgcaccgccgcggggtgggagctggcgccatcgccaagaagaaacttgcagaggccaagtataaggagcgagggacggtcttggactgaggaccagactagcccagatgtcaaagcagttggacatgatcaagagcaaacctggaggaattggccagcaaacacaagcaggagatccggaagaatcctgagttccgtgtgcagttccaggacatgtgtgcaaccattggcgtggatccgctggcctctggacaaaggcatcaggtctgagcatgctggggcgtgggggacttctattacgaaactaggtgtcacattatcgaaagatgtgcctggacgctgaaagcatcggacatggacggtctgatacctttgtgaggaacctacaatcaaccaggtgtttgcacgggaaggggcaagttcgaccatagatgtcagtcaagatgacctgatcagacgccatcaaacgaaaactaaaggcaacttgtcacatggcttcggcatcatccctgtgg

SEQ ID NO: 711656 - DNA, 274 bp, Homo sapiens
gagttcattttacttggagttacttgagctgcttggatgtttatatgcatgtctttcatcaaatttgggaagttttcagccattatttcttcaaacatagtcataagctgcataatgacattttggtcatcattgactggatataatgtgggtggccctcaaagataaaaaaacggtattttcactgcactttttatgtttatatgtacttagatacacaaatacttaccattgtgttataattgcctaagtattaaatacagtaacgtgctgt

SEQ ID NO: 711657 - DNA, 379 bp, Homo sapiens
  misc_feature (37)..(37): n is a, c, g, or t
gaaaaagcacatttatggtctggccctagggtaattnttaccttgatttcctctctgtcagatacaatttggaggaaactggtcattctgcagaatatcacattgacccattgtaccaatataatgatgttgatgatcatgttaatcaatacgtcacaaatactttggtaagacacttatagtcaagaggatggtaagctttatgaagatgtaggggcctgtcacaatcgtgaaacttaacaaggttgggagaagaagtccaacagtctgcaggattcaaggccatcctggaaaagacacttctttatttaagttatttgaaccactcctccagaatatccaatggggcctctttttctgggggaacttgtataaagag

SEQ ID NO: 711658 - DNA, 673 bp, Homo sapiens
tcccaaaaaaaggtttttttttttttcaaaaaacgggaaaaaaaaaaccaaaagggggccccccgggggggaaaatttggggtccccccccccccaaaaaaaggggggggggggtggtcctcctctaaccccctttttgttggtccactattggctgcccccctttggtctccactctgtggtgtggagactctctcctagggggggggcgcccccaccttcttctggtggtgctggggggttcgtcgggcccacccaacgtcgcttgtattgtccctcaacccctctttttctcccacaaaagtattttcttggcggggagggtactttttgtgcaaccaaaaaaagaggaggccacaatgaggagagaaaaaaacgaagttggcggcgccgctgtggatcagccagacagaaagagcgatgcgagttgtctatccaaaaaggttgggaagcttgtgagaaccaaaaaaaaacacaccaagggtggtccacaagagtagtgtggtggcgcaccaagaggagagaaacgtgggggccccacacccctctgggggtggagcacgagagagaacccaagagggggggtgttgctgacccggagtggaaggtggcacacccctagtagtgtgggggcgcccccaatgaggaaggggggaacacaagatgaggagcg

SEQ ID NO: 711659 - DNA, 162 bp, Homo sapiens
cccagtcagtttccccagcctgaccaacctggtgaaacctcgtctactactacacaatacacaaaattacacggggtgtaggcagatgcaagcctgattatcccagactactggggaggctaattgcattgaacagagagaatagctatgaacccggagagg

SEQ ID NO: 711660 - DNA, 185 bp, Homo sapiens
cgcgctgcatgcgagtggccgcggttggactatgggcgatcgatgagcttagagagagcttcgtgtttctctcgctttgatgagattgagctgtgtggtattagagcatatatgatacgagtcagtattcagaaattatgcaagactctgagttagacaaaaggataactattaaacttattata

SEQ ID NO: 711661 - DNA, 395 bp, Homo sapiens
  misc_feature (356)..(357): n is a, c, g, or t
  misc_feature (375)..(375): n is a, c, g, or t
tgttttgcgttgggttagtctggggattgaaatgtagatgagaatgatcctcagggataggtaaataatttgtggtgtaaatattcttagattccggacttttcgtcaagtatccgtagttttcgactgagtgttgtgacgggtgattagatgatacagcctatgaatgaaatataggtgctgcaggagaaggaggaaaatgacgaaacgcggcttaatctaatcggctcggggcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711662 - DNA, 102 bp, Homo sapiens
aatgcgtcctatcctaacactaggactaaaggatggtaataaaccaatcagaaagaaatctctgtggggtcactttaaaaactactagctgaataatctcaa

SEQ ID NO: 711663 - DNA, 609 bp, Homo sapiens
  misc_feature (570)..(571): n is a, c, g, or t
  misc_feature (589)..(589): n is a, c, g, or t
ccgttgcataccaatagttgattgaccgcggcgaccccaggccgccccaaggccggaggtgtgctacaaagataggtagactcacgctttgtaataaaaataggtcagcggtattaaacgcgatgatatgaaagaaatatactacattgatacataacaagagctgttgagtactaaaggaagtattggactagtggtgcgaacattagatacccactgtgccagtttatgaaagattggttcatcagacccgatatttgcccttaacctttgttactgcgtacaccgttgccgccttttgtggcgtccacttgcatttgctacaccgtgtaagtaatgcgctctacgccaacggtatcagtctcaacatttgcggcgctgttaactagtcgaggattaagatgctgtactgccctgtggccactggtctgcttgaccagcggttcgtaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711664 - DNA, 559 bp, Homo sapiens
  misc_feature (538)..(538): n is a, c, g, or t
catctctacaaaaaataaaaaattaggccaggctcagtggctcatgcctgtaatcccagcacttctggaggcccaggcgagcggatcacctgaggtcaggagtttgagaccagcctggcgaacatggtgaaaccctgtctctactaaaaatacaaaaaaattagccaggtgtgatggcgtgtgcctgtaatcccaccgccaaggaaggctgaggcaggagaatcgcctcagcctcagagctcgggaggtggaagttgcagtgagccaagattgcaccactgcattccagcctgggtgatagagcaagactctgtcttaaaaaaaaaaaagtatgtcctaaatgccactggatatggggggttggtttttttggttggttgtttgttttttgtttttgagacagagtctttctggggctctgtcacccaggctggagtgcaatggcatgatcataacccactatagcctgaaactcctgggcacaagtaatcctcccacctcagcctcccaaagtgctggggattacaggcatgaggcnttgcacccagcggccactgaa

SEQ ID NO: 711665 - DNA, 581 bp, Homo sapiens
  misc_feature (542)..(543): n is a, c, g, or t
  misc_feature (561)..(561): n is a, c, g, or t
gcgaagcggaccacgggcggctgaacgaataagaatgggctgcgacgattaattattagtgaccggcaacaatgcctacttggagtagcaccgggtacccggccggtaccacggcagtaactgcgacctttcaggcggcctatcgcgcattagacaccgcgtgcggtacgagaatctgtacctaggggtgggttcttaactgcggcaagcggcggaaagatggaccgttgggaggactatgagattggtggcaaccacgttcaacaagacgacggggggacagacgactactaggcaacaacagtggaggacaaattggaaaaccgtcaaacctgatagtttaccaatgttacccacggagatgcctgctacaacgacccctagccgggctaggtgcagtatcggtgaccagcggttcgtaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711666 - DNA, 531 bp, Homo sapiens
  misc_feature (492)..(493): n is a, c, g, or t
  misc_feature (511)..(511): n is a, c, g, or t
atattgataaacgagaatacaacagaagatacaaccccagctaaaggataatcacgggtaaaaataaattgagaagccgggagaaaattaggagatatagggcttaggtaacattgatacgtaagtacatacggataatttggtaagactgactttgtaaaagaacaaagggaaacaaaaaaggaaaaaaaaaaaaaagggcggcggggggggtagtgaggaaatagttgcccttgagaagctgcacgggtgaaaagggtactgcgggaacaccaataccaatgcgggtggcaacagagaaaaatgttttacgaagacccgggggggatgcaatacataaacacccaactatagtagaccagcggttcgtaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711667 - DNA, 544 bp, Homo sapiens
  misc_feature (505)..(506): n is a, c, g, or t
  misc_feature (524)..(524): n is a, c, g, or t
gcatccaatagtgaataacgaggaataaacgcgactagcacaaatgcaatgagaaaggacgagtaagggatcacccggaaaaggacaaacaattggggagctgcgggaacagggggaagacggaagaaccgcggggacttgaagtaacagagatacgtgaaaggaaaaaaggaagaccgcgtagtgactaaaacagcagaggagaaggacgaagaatataacaggggcggggccgggggaagcagggcggggggcaaaagcaacgacaagttactaacacgcagatggaagtaagcaaaaagggaaaaaggccagaacttagtaaaataaagcggactgcgggatatcattacgctttaagaagacttagaccagcggttcgtaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711668 - DNA, 521 bp, Homo sapiens
  misc_feature (482)..(483): n is a, c, g, or t
  misc_feature (501)..(501): n is a, c, g, or t
aatagttgatataatagaaaaaacttaccaaactaccggtgaccaaacaccaatattgcaaatgacattaagaagcccggcctgaaacgcagcgccgagccgtatttacgcacattattgtgatcctaacacgtaaactacaacggcgtaacgtacgctgtgaacggcggtcctgccgctactattgagtactctgtccactgcgaccacgctgctggcactttacctatttggtttggacaatatttacgcaacataattatacggaaaaataaactataaaattcggcggcaaaactagcatcagttgtcaggccaaagggaatatcaacgacagagtttacttaatacgtaattgggtccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711669 - DNA, 362 bp, Homo sapiens
  misc_feature (202)..(202): n is a, c, g, or t
  misc_feature (323)..(324): n is a, c, g, or t
  misc_feature (342)..(342): n is a, c, g, or t
gcttgtctgtaggacgcacgtctctgacggaccgacggtcgcaaagtttgtacatttagttagtagattgctcgggttgtgcttggcccggtcctctaacctgagagttgttaagtgacaataaaaaaattgccacttaaggtatacataccctgagggacggtatattgcatgattttgtggttattacaccaccagatgnccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711670 - DNA, 285 bp, Homo sapiens
cacctgggtactagactttgcagaggagtgcagtgtgcatgtagtccaagtatctgaacacagttcacatcgaccttattagcaaaagtatttaagaaataggcatctatcaaagaagcactagcagcatatattcagaaatatcaaagtggaatatatgtacatgtcatcagtggtacccaattcccctttttactgtagggtggataactacttaaggatttaactcttagaatattatctctatgaataaagcatagtagttaatgtaaactccctaaaaga

SEQ ID NO: 711671 - DNA, 499 bp, Homo sapiens
  misc_feature (460)..(461): n is a, c, g, or t
  misc_feature (479)..(479): n is a, c, g, or t
tatgcaggatagtttgttatgcttatttgggcactacccgaagtggcccacgctagttcactacctttggggtaggtaaatgggcacgtaaatgggtgtaattaataggtttgacgaagattaaaatggggttaacattagggattaatgcgcaattgggtgaaattgtacggtttgagtaatgacgcaaaggggtggttggggtgcaatgtaaacaacctgggcgttgatatagtttggcaggcgaagaaagtatcaagaatggaaagcagttcgtgttattgattgaggttagtgtagaacattgtagggtgtatttagttacgaccgcggttcgtaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711672 - DNA, 941 bp, Homo sapiens
gggcccggagggcgctctgcgttcgtgtacgtggcgctgcttgggcccgctggcggattgtaatgcctgctggcttattgcggctgggcaaggagcggcgagacgggttcggcactttcttcgctcgggatccccgcaaggatgcagtgctgccagagagtctcacccgcatggggtgaaagcgttcagcctcccagacgacgatctgggactctagacaatctgggaggcacgcagacttgggctaatgaagcagagaaacacaaaagttcttgagacttactgggatgcagcgaaagacaacgaacatactggtcgctcttgctataggacgatcacaaatcaacatctcacttccgaaccggggaagaagacaagaaacatcaatgaagaactggagtctcaatatcagcaaagtatggacagataaatcatcaggcacagatatcggcgacattgtggacttggcttcagtgaggctagacggaccatgactgggacgaaggtgctgtggcctggagaatgactgcatgactgaccgatgatgattcaacctgatcctgaaagtccagcaacattctgaaagcgattcagagtcagagcaacgacgcactctgctgcaagaactcccagcctgctgagacccctgatgacaagcggaggcatcccaaaaacgacaagcaagatgcaaaaagcaatgatacaaagacggacgacaactcccgcggttcatacgtcccaaaaggccaagcaattgtcaattaccacgaagccctaattggacaccaagtgccagcggaacgacctggctatataaagcgcacacgccatggacgttcatattctaaaacggctctgttaaatcattcaacagaagtttcgctacaaagtaccagaccacactacaggggcacatatcacattgcgaggcagacttttaa

SEQ ID NO: 711673 - DNA, 556 bp, Homo sapiens
  misc_feature (517)..(518): n is a, c, g, or t
  misc_feature (536)..(536): n is a, c, g, or t
cgacgctacctttgggactttggctgcaatgacagcacacgtaaatgcactttgctgtcttccctttggcaacgacgcggctaccatatgtacggcagaaaagatggcatattgcgcacctagagcaacctgggcctgcgttgctgttgttccatatgttatacttgctaggggtaactgttccgactgcgagtcgcaatcttgatgatcggttagctgcgtttgccgtctgcgtacccacaatgtgcgggcaacggccatttgtaacgcgggccgtaggcggaccacgctttgtctacccccgccccaccccgacgacacacaattgcggtatgggattgctacgaacgctttatatgcactgcacccgagagtggagttttaaatgctgatattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711674 - DNA, 710 bp, Homo sapiens
  misc_feature (263)..(263): n is a, c, g, or t
  misc_feature (265)..(266): n is a, c, g, or t
  misc_feature (288)..(288): n is a, c, g, or t
  misc_feature (361)..(361): n is a, c, g, or t
cggaacatcggcacctgggcctctgtgcccgcactgttaccagccactcctccccagtccggcgggacactcccctgaagtcccggaagttcccccgagcccggaggtgcagggctgtcttttccgtaaggatgacggcgtccaccagatgcagaacctcctcaaacaccgctgggaggtacgcccctactgtggtgaccagccattcttcccctgtcaccctctccttgccgtcccggtcccagcctccttgcgcctgagcncnnagctggtctgctgatgatgtgnctgaatgatctccacgacctccacttccttccgggggatgtacgtgccaggtccctcgaaaagccactcatcncctgccaccaccttgtcgccatctttatcctcaaaatcaagcagcgcctttagatggaggacagtgttggccagaaccacctgcaggggtgtgatgtccttttccagcacctcccctggatacagggggaagggctcctgggccagccggatctcgagctcagcgtggcgaagccgaacttgccctgtgacatcaatctgtcacacaaccctggcaccccgagacaaaggtttcgaccatctgctcagtagtaactgggcgaacgctcaccaatgcgccatgcggccaaccagtactcgtcatagtcccgcccgaattcggtaccgagctcgagtcgtatcatgtcatt

SEQ ID NO: 711675 - DNA, 463 bp, Homo sapiens
  misc_feature (424)..(425): n is a, c, g, or t
  misc_feature (443)..(443): n is a, c, g, or t
cccgttccgagctgtctctaggtggttggagtatacacggggcgcacgtgtggtaaatagggtataacatacttgacgtactacgactacttgtactaacagtgtactctattagcgaaagaaagaaaacgcgtgccaaaagtattaacatgtttgcgtaccgcagggccctctggttatgctatggttattgttatttgcctaagggacgattattacatatgcttatttggcagctatccgttgagtttgctaggaaaaatagaaaatacagcgcgtcccgaaaacaagctctcactacatccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711676 - DNA, 669 bp, Homo sapiens
  misc_feature (25)..(25): n is a, c, g, or t
  misc_feature (50)..(50): n is a, c, g, or t
  misc_feature (94)..(94): n is a, c, g, or t
  misc_feature (123)..(123): n is a, c, g, or t
  misc_feature (127)..(127): n is a, c, g, or t
  misc_feature (170)..(171): n is a, c, g, or t
  misc_feature (175)..(175): n is a, c, g, or t
  misc_feature (183)..(183): n is a, c, g, or t
  misc_feature (199)..(199): n is a, c, g, or t
  misc_feature (201)..(201): n is a, c, g, or t
  misc_feature (221)..(221): n is a, c, g, or t
  misc_feature (233)..(233): n is a, c, g, or t
  misc_feature (247)..(247): n is a, c, g, or t
  misc_feature (254)..(254): n is a, c, g, or t
agcggaccaggcgcagatcatggcnggcagccggctggaaaccgtagggngcatcttctctcggactcgggacctggttcgggccggggtgctnaaggagaagccccttggtttacgtatatnacgnctttcccccctgagggagcccgtcttccaaaggcctcgagtcnnattngcaaacanagctccatccaagcantntggaccagactggattaagngaagtttatcantgtatgggtctggnaaagagnttatggatctattcaatccaaatcttcaagtctacctgtcaacggtttcgtggcacgaacgtacatctgagtctacacgaacacttgggcgacacgcagactgaacgaagcaaagttactttcggctggaaacgagggaccacggctttacttgcgcagaaagggtgtcatgttcatacgacgaagtaaggctgaagcaacggactcaacatcgggaggtagtcacggtttcccgcgcaaatcccgaacacttgagctgtcagaacccacagccctggcggttgggcacagaaaaaccgaaggaacgtccatgaaacaggaacggttccgactagggaacccaggccacttctgggaagtggcaaccctgcctggaacccagggtccgcagacgggtccttccatgccccttccc

SEQ ID NO: 711677 - DNA, 313 bp, Homo sapiens
tctagagttacccttacagggtcttccctgactgctgatctaaaataacagccagtcacactttcatcccagtaccctgcttttctttttccctgcagagccaagataacattacctttatgtattcttgtctattatctgtctcttccactggactataaagtcctgtgagggcaggagatttgtctttttgggtacactgatgtcatcccagagttcaggatagcacgagtcacacacccatccattccttcattcattatctgatccatttattcattcactcactcatctgatgggtgtgtgattcgtg

SEQ ID NO: 711678 - DNA, 430 bp, Homo sapiens
caatggccatgggggacacatcatgcctcccacacaatcgcagtttggagagatgggaggcaagtttatgaaaagccaggggctaagccagcctaccataaccagagtcagggactcgtatcccagctgcaaggacagtcgaaggatatgccacctcggttttctaagaaaggacagcttaatgcagatgagattagcctgagggctgctcagcggccttatgaataaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggcagaactccttcaactaactaaaactgttg

SEQ ID NO: 711679 - DNA, 883 bp, Homo sapiens
cgcggtggctcacgcctgcaatcccagcactttgggaggccgacgtgggcagatgcttaagctcaggagttcgagatcagcctgggcaacatgacaaaacctcgtctctacaaaaattactaaaattaggtaggtgtggtggcacgtgcctgtagtcctagctatttgggcacactgaggtgggaggatgggttgagcccaagaggtggaggtttcagtgagctgagattgtgccactgcagctctgcactccagtctgggcccgatgtcgcctcaaaaaaacagaaacaaaacaagaacaaaacaaaacaaaacaaaggaaactgaagcccagaggttaaatggcttgctcatgaccatagccatacgaatttcttatatcaaataaggaaaagcaagcgagcaacaacagaagacaaatctccattatcctctggccagcatgcttgttagaacaataaaaacttggccaggcacggtggcataacgccatggtaatcacagcacttagggaggccaaggtgggcaggatccacgaggtcaggagatcgagaaccaatcctggcgaaccacggtggaaaacacgagaatcaacatcaaaaaaataccacgaacattagcccggggagtgcgcgggagggcagccatgaagcccagagtcacaggacacggctgaagaggcaggagaactggacggaaaccgtggggcaggcgggagcaatcggcacagtatgaggccagaaaatgggacgacattgaaaatcaagacatggagcaaacgcacacgaggaatccaaggcaaggaccggaaacacaaggacaaatcaaggccctgggaaccacgcaccgaagacacaaaggaaacaacgcaagacagagaaaa

SEQ ID NO: 711680 - DNA, 459 bp, Homo sapiens
ctgtggaaggctggaatgtacaaatgagatagagttatagcttaagaccaggtgggtaagggagtcagaagtatgcgatgtaattaaagaaattatcgcccaacctctacaaataaagataggggaactctgaaagagaaagttcttttgatttccatttgactgttttatatgagcctacgcctaatgttccgctgtgcacatgtttacctgatacagaagtgctgcgtgttgtacatacttggaacaacaaactagaaatactgtacttgtgtaccaacattgactactagtagagaagggtgtgtgtgacaagccagttctacaaggataacctaggtgtgagaataaaagcttttcttattgacttaaatttgaataacagcgttgtgtaaagccaattgccgaaatttttgcacctaaccaggtttttggagattacaatgtttaataaataaa

SEQ ID NO: 711681 - DNA, 130 bp, Homo sapiens
tgggagatagcaatcatgtggagactatttggcgttggagcccaggtcttcctggactaccctaggaacttgtacctcgcgagttctttcaagtactctctctctgaaatttcgatacactgtctacaga

SEQ ID NO: 711682 - DNA, 255 bp, Homo sapiens
gtcatgtgcggaattgtcatctcgtctagtgcttcgtgcaggaatccatttctgagcgtatgccctggggttatccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggcagaactccttcaactaactaaaactgttg

SEQ ID NO: 711683 - DNA, 216 bp, Homo sapiens
tcgagctcggtcccttcgacggtgtttgtctgatgcgctgctcattgtagctcttggccaggacacaaccaccacgcactcaaacaccacctctgggacagacacctcagcttggtctcaaaactaatccaccacttatccaggaaaagcctgccaagaccagcaaaaagccaccaccgtcaaaggcagaactccttcaactaactaaaactgttg

SEQ ID NO: 711684 - DNA, 1698 bp, Homo sapiens
cggacgcgtgggctttttttattttttttcactaattacatttttattttgtggttctctaatttaaaattaccttttcatcttggctgtgatatttccttcaggctaacactatagaagattggtagattagtcacccgtaaaaaatatcaagaaggacctcgtcggatcaattgagcggcacttcgcaacggtgaacatcctgagctacacatcaagcgccataaagagaccgaaagagcaatacctcctagaagggcagttaaccagcgaatagacagataaagacaagggagaaagagacgaatgccatacacgagaaaataaaagaagacacaaaccgagcacaacgagcacaacaacgctacaaggagagcaaagggagaacaccacgcagaaaagacacacacggagcaacaacacacgcaacaaaaaccacaaagagagaaaaaaaagaaaatagaaaaaaaaagacactaataagaaaaagagaaaacatgaggcagaaagaaaacacaagcaagaacagaaagagaacaaaacaacaaaaacagaaaaaagccagaaagagaggactcactgagaagcagaaacaaaacaagaggaaaacactaaggaactaccacaaaacaacgaaaacaaaacaaaccaaaacaaagaacagagaaggacacagacgaaaaaataaaaggagaacataaagacgccagaaggcgacaagaccagagaagtacaaagaaaccaaaacaacagacgagacaaccaccaaccacagagaaaacaaagacaaccacaagaggggcgaaccgccacgagagacaacaccacgagaccaacgaacaaacagaaaaacaacacataaaagcagacaaggcaagcagagtaaacacaaaacacaaacagaaaaagagcacacgtaggaaaatagacaccagaaaaacgggacaaataaagaaagaacaaccaaccagcaaagcaaaagacagcaacgacagaccgacaaaccacaaccccaagaaacaaacaagaaagcacagggagcaagaaagcagataacgagagcaacacaacgagaagcgaaggaggctacgacgggagacaccaaaccgaccagacaaggcacccacacgccggaagcaagaggcgccggagagcaggacggagagcacgcagcaacacagagggcagagataggaggcgcaagaccagcgccgaagagggagcgacgacaggagcgccgacgaagcaacggcaagagcgcatagcatggatggccagggagagacagcagggagagacagacgcaaagacgcgaggtacgcgagagccggcgagcagcgcacgaagacagacggaggggcgcaggagcgagcgagacaaggaagagaaggggcggacaacagcgcagagaaggcgcagagccgagaagaaagcaaaactggatgatgaacgaggatgagagaggatacaagggcgaggaaagagagaagagaagagaggggagacggtgagagcaggtacaacgaacaagcaatgaaatggagaggggagagggacagcaacggaggtgcgcgaagtgacgagggagacaaggaggaagatgaacgtcgggcatgcacgacagtgaacaagggcggacgactcgatggggcgctaatcgcggaccgagtgagtgcgtgtgtactttcgggagcgacc

SEQ ID NO: 711685 - DNA, 219 bp, Homo sapiens
ctggctattttgattttagtagatacaggtttcactgtattggcagtggtctcgaactcctggcatacaggtcgaactctctgactcaggtgatccacctgctcagactcccaaagtgctggaattacaggcatgagccactgtgctcggctgagattgcattgttgttgagggtgcattgttgttgaggctggattgttgttgaggctggattgttgt

SEQ ID NO: 711686 - DNA, 144 bp, Homo sapiens
ttaaggctgaacacgaggtggtgaggttgatcggggttcatcgaattacagaacaggctcctctacagggatatgaaggcacccgatctgagcattagcacccgtctgcaaaaggggatcctctaatatctcgaccatgtcaga

SEQ ID NO: 711687 - DNA, 867 bp, Homo sapiens
tgtgagtagcaggatgactataggcagcccttaccttggtaatctgtgggacataaccccaggtcaacataccctcttgtttcagcataaaagtatgggactagagagtactaagccaaaaggcagtggttataaaattctgcctgttaggaactggatcagctgtgttcagttatgacaccatgggtgtccagtagaaatatactgtgagccacatgtgtaattttaaatttggtgtagccatattttaaaaagtacaatgaaacagacgaaaataattttatttaactcactgtatgtaaaactttatcaatttaacatggtaatcaaaattagaaagatactgatatatttatagttcagataataagtcttcagaattccaggtgtattgtctactgtagcacatgtgattctgactatcaccatttcaagtattctatagctacagatggctagtgattctcattgacagcatagttctaaaaatgaacatttatggtacatatgcttggagtcgggtacacttctatagattgccgtagccactatattccgggtttccacattcttctcttcaaaacttaagttaaccgtgggattatccagatctgtattagtggcaaattcaacagggctaataagtccaatattggacgatggcaacgttacattattgcctctgggggcggaagcacgggcagggggggataaccttatgtatttggaacatgtcacggcgagggcacccctaacatggagggccacatggggcatccgcagggatctcaacaaaaaaggggtgcacacccgatcggcggttctcctatttctcttgcccttctctatttatcttcacactcctct

SEQ ID NO: 711688 - DNA, 347 bp, Homo sapiens
aagcagttaatacagactcatgtgggtggggagggaagtcaactctagctcactcagtcaggaaaaagtgtgagctccccaagtgactaagtttcaatgctcataaaccctgagcctagtcctaaaaatgagaaagatccccgagacttctctgattcccaggttgcgactaggctgagggaataggaccaatggaaccagaatcctacttccatgagccatgcctggagtcaggattgtctccagggtctattccctgaaatcggttcctccagctaccaggacaaaccccctgtcagcgtctgggcctttgcaggccatagccttcatgagaacatggctgtagg

SEQ ID NO: 711689 - DNA, 456 bp, Homo sapiens
  misc_feature (105)..(105): n is a, c, g, or t
  misc_feature (108)..(108): n is a, c, g, or t
  misc_feature (345)..(345): n is a, c, g, or t
  misc_feature (354)..(354): n is a, c, g, or t
  misc_feature (386)..(386): n is a, c, g, or t
  misc_feature (398)..(398): n is a, c, g, or t
  misc_feature (441)..(441): n is a, c, g, or t
tgatggagaccgggtttcgctgtgttggccgggctggtctccactcctaaccgccgagtgatccgccagcctcggctcccgaggtgccgggattgcagacggagntangttcactcggtgctcaatggtgcccaggctggagtgcagtggcgtgatctcggctcgctacaacctccacctcccagccgcctgccttggcctcccaaagtgccaagattgcagcctctgccaagccgccaccccgtctgggaagtgaggagtgtctctgccgggccgcccatcgtctgggaggtgaggagcccctctgcctggctgcccagtctggaaagtgaggagcgtctcttncccggccgncatctcatctaggaagtgaggagcgcctcttnccggccaacatnccattttaggaagtgaggagcgcttttttcccggccaacattnccgttttaggaagtt

SEQ ID NO: 711690 - DNA, 590 bp, Homo sapiens
gtctgcttgactatagttggacagaaggcgccacaccagtacctagggccttatcctccccaagccagtgcagccccagtgattctagatctggacatgaccttgaagcaggtctgcatataatggaaagcgatgcccttcttcttacaatatactggataatagcaagatcatcagtgaggagtgtcggaaagagctcacagcgctccttcaccattataacccaattgagatcgacccacaccggaccgtcaaggagaagctacctcatatggtggaatggtgcaccaaagcacataatctcctatgtcagcagaagatccagaatgtgcagatagcccaggtgattagagagtccatgtgcaaggctcagggagggatataagaccttcttcaatacactctaccataacaagattcccctttccatcttttctgcgggcatggatgatatcctggcagaaattatccgacagatgaaagtgtaccaccccaacatccacatcgtgtctaactacatggctttaatgaagatggtacctccagggatctaaggccagctgatcacacatacataaatagtcgagcag

SEQ ID NO: 711691 - DNA, 936 bp, Homo sapiens
gctggatgatattattttctcttctaaagaaatttatggatattttatatcctaaaaactaagttgtaaagtcagtcaccactagcagtttaagtgtgcatgcgagtgcacacactatacacacacacacacacacacacacacacataagggaaggaagaaaagtgcacagcgaatatatgcatagtgctacgagcagatcttttctttaagtggtcaggaggccatagtgtatatgtgtaactccttttttccatcaccattaagtgtccctctgtcatcttccagcaccttgcgtggtggggggttctacaaacgtgatgtggtcttcgtgaaccttcacttctgaagggtctgagtcctaaaaggttcgtgcttaactgggtagctgaacgtctttcattaagaagactaaagagacgtggaacttctgagagggagcaccagataatactctagtcccagagatactttttttatttaacccttcagggtatcaccatcacgttatttatattttatacacacttttgggccctaccggaagaatgaacccttttttgtattgcccggtgtcacagagaatggaaaccggcaggtggtgtgacccacccgactctcccgcaacgggcaaccctgacttggtctcctgggaaaaagcaccccctaagaaacggacgacttgtaattcacagacgcccaacggtgtgtacaggcagccgcacaacgttggagggcatatcaactatcgggaggggacaacgagaagccaaacacggcctgggttggtcaacacaccaactcagggacggaccacgtagaaaaggcccagctgatataataggggagaaaaaagactgcaagcatgcgaaagagcaacgctgccacaaatgtgcgcggcagcggaaacacaacttgggggaaggtcaactaaat

SEQ ID NO: 711692 - DNA, 1414 bp, Homo sapiens
  misc_feature (541)..(541): n is a, c, g, or t
gttgttgtgtttgtttggtatgtcattttgtttgtttgtgttgttcatcgttgtttgactgttgatttgtcgtctctgtgcgtctgattgatgtctgtcttgtcgtgtttgttgtgtctgtgttgtgtctgtgtttgtctttttctttgttattttttgttattgttgatgacgaagagaagggcgggcgcgcgaaggacgggatgaagaccagaaggacatgtacggcgttgattgctgccaatctctcttgaggattatggagacggtgggagccaatggtacgtgctgccagatatgggtgttcccattcgaggggtgctttatgcgccctattggccgctgcgggtgcccccccgtcggggcgcgcctcaactgctgtgggcacttctctagggggttcctctctttcgggtgatccggcctgcttcggcttctctctgaccgaggcggttagcgacacctcgatcccagggggcctgcccccccccacggggcaccggggcacactcactcaggagtgggccctctttttgtgaanacttgctagtggggacgcgctttctttgccgtcgaccagccggttttgctgtgctccgggtcccctgggacactaataggcgaccagcgggggagtccccgccacgggaccgaccgccctgggtggtggaggccgtttcgggggagtgtggtccccgcctttccccacggggttgttccctcgagagactgcctttgctcgcggtttttttcggacacatacacttcctgggggacacaggcccccgcgactcgcgggggggacacattgatcccggtgcactcctccgcctcctcggagccctaagatccacttggtctttgggggggattccagactcttgtgtagatgtgggcccctcaagcctgcgagagagaaggttccgcttctcgacgtttaatatttttagagtagaggagtgataactcgtgctttagaggacttatgtttgcgtcccctctcccgcgtgcaccccccgcggttgttcggggccacaccacgcggaatccacccaccactgacacctcgaagggtggtgtgttgttgaacacacgagccactactgcgcggcgtgacacacaaggtgtggggataccatcggggtgttggttggcacctgcgctctagcacatgagaaactgttggctgtgaggggggttcgcgtaagtccatgcttatatgagagtttaggggggccacaatttggcaacgaacctttgggccttttgggtgtttgtatataagttgttgtatgtaagccacaggatatccgtgtgtctcccccgtgttggagggggagctttagaacctttaaggtgagtttttataagggggaataattttgtcccaaataagcgcttgccctattaaata

SEQ ID NO: 711693 - DNA, 239 bp, Homo sapiens
gggtctcgagactactgggtttattagatataggaattaagtcatcgcaagagagagcgtaggaggacttccctcttcctatttgaataccctttatttcgctctcttacctgactgccctggccaggacttccagtactatgttgaataggagtggtgggagacagcgatctggtctggtgtcagttttcaaagggaatgtttccagctgtgggttatttcagcagttctatggttgt

SEQ ID NO: 711694 - DNA, 203 bp, Homo sapiens
acagggtaaaaatcctattgtgcttttgtgactttcaaacggtaaagttcccattttagagatgggtttgaatctaacttagggaaaacctggcctagccggaaattgcaaggctaagcttccagtaaaaaaatcattaggcatcatgagatctacaatctggaatcagacagtttgcttgactgctgagatagggtctatgg

SEQ ID NO: 711695 - DNA, 453 bp, Homo sapiens
tctttcagatgggtttcagcccagcagaagcattatctttgccagttggagtgctggagactttggatcggttggtgccactgaatggctagaggtattctttatcatcccttcccatattggacacgagcttgtgggcttaggctgttggtccagaagtgatgtttttataggtttgattttaccacttttgcctttgcgtttaagtctcagtagagtccagaattgaaaatgaatccctaatgctactgtatgtgataaataaacagatttatacttattagtgttttcccttctcttctagggatacctttcggtccctgcctcagcctcctgagtagctgggattacaggcacccacaaccacacccggccaatttttgtatttttactagagacagggtttcgccatgttggccaggctagtctcctgaccctcaagtgattcacccg

SEQ ID NO: 711696 - DNA, 1428 bp, Homo sapiens
ggcgggaccctgtgacttgtgcatctgatgaggttgcaggctgtcttgcgcatctcggtgatgagaggtgttccttgccatcgatgctgcggaggacgtgatgctgagcaccaagtcggtaagaatcaagcatgaccggtgctaggagaagcatggacggatcaactggtgtagtcagtcatacttacgaatgttgcactcgggggtgccagtcgctgggatgcctggatgactcggctcgcaaatagaatgtgtgaattagcatgccgtcgcacaggaatggttggcctgtatggatgcactgtgcattgaatattgactactgtaataaccaactggagtgaagcaactctggatctttaacaaacaatttcactggaattaatggtcatgaagagcttcctagctcccctaggtagcatggaatcttagtcgtgtccacgggcattggagacggtacgcgtctatggggcaacggaatgcttagtagcagggtaacattctcttgggtgccaacaagttaacctttaactacagcgaaatgtgggacttaatcaagggaaactcctgcgtgcgtaggaactagtacttcactctttggccaatagcgtcgcgtaaaaagggatccgtcggacaacgatgagtttggccccacctgagatagagggggctccttgaaaggatttacgggccaggcatttccacgagagaagacataaggttctctccggcttgggggacaggatttcctatgtacgtctaagagaaggccgcctccgatattcactagaagggaactgcgcctttcagcggtcccaaggtggcttggcatagtggtggaggtcgtctagggacaacgccaagggtcagatacctcccaagagtggcaagcgccttaaagagaacggacgtccttcatggcgatcactcttcgcggacatcttttgcatgcgacacaggtgcatggcggatggttaggccaaaggcgcttcaggaaaatcacttccccccggaccgccactttttgatcgtccaagaatgcgcatgagggatcacgtcgcatcacccgaaatggtcttcgtgtaatcggagcttgcagtttacaaccgatgggtttttctaggtgcggccaacccagtttgtgggtcaagtatggcactgaggagatcagtaccgccttgtgtctttgcgccaaaaatacggttaggaaggtcgtgcgccaataagagcagcgcgcaagttggaatttctgacgggccaggaacccttaaacttatgacctgactttgcgtctgttggcaaacgtgcctcacaccacttccggctcggactaggatctattgaagatggaacgtttgtcagacaccctttgaatctggtggccccgctgtggattggagccacaaagactttactttgacagcaatg

SEQ ID NO: 711697 - DNA, 674 bp, Homo sapiens
agcgggtgcggtgtaggatgcttcacgaggtataatcctattcttattagcactaaacttgctaggctaattatcatgtttatcttctgtccagaccaggacaccgtctaggtccgtagaatatctttacatggaagcaagatacatctattactactttaccgactttaccccctttctttaattctgtataattctttgtactatatatcgattgtgtaaatgcttctagatgtcttcatcatgaaaatatcaactataatactttcatttagatttcacatttcatacctctgcgtataaaatgaaactttttaaattcaagtgaaatgcgatgactcttccctcgagatggaatacgttgataggtcaagcaaggtcctgttataggaattcactctagtcctagggatttatgcactaaagaaactactcttaaggatattctttggacaaacaagcatgaactaaaaagttgtcattgcactactgtttagaggacatacccgcacatatcccgtgttaatacctctacctcgataccataaattgttattgttgtattgtacattttggttcacacgtattgggcgcttatctagctttcttgccaaatgtgcacccagtgttgcgggcattgtttattctaactcaaacaactaaatctgtatgcc

SEQ ID NO: 711698 - DNA, 380 bp, Homo sapiens
cgggtctatcaccatgcttccgaatctgctcctcagcagcccctccttgcccgcagctggtgtaccggcacagcagtttgatgtcatggtgatgcccaactctctatggcaacatctgtcaacaatgtctgcgcgggactggtcgggggcccaggccttgtggctggggccaactatggccatgtgtacgcggtgtttgaaacagtgagtgccggtgcaactgcgcggcttgccgccttttctactgttcacagacttagtagaggcacactcataccatcaggttagcccggtcaacatgcatgatacagaagttactcggataataccagggttgtactagcgccaccatcaggacaatcccagaacatattaaccat

SEQ ID NO: 711699 - DNA, 162 bp, Homo sapiens
tgtcgatcgagctcggtaccgctccccgacggggtgggactggaaggaagaagagaagactcctgtactgtttgacttgtttgttttgtttcatttgttttgtttttttgagacagagtctcactccgtcgcccaggctggagtgcagtggcaccatctcgg

SEQ ID NO: 711700 - DNA, 1210 bp, Homo sapiens
ggacatgcttgggagaatcaaaaaggtcttcatctggattataagatagatcagcaagcccagctccagagtttacatattgaatggtgggtcagaaatgcagatgttcaagtgttcgaggaaacccacctgcgtacaagaggtgtaccagccccagcaataaccaggggaaggggaggagttacagccggccagttggagttgtagtacacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagaaatgtcagccatcttggaatgtcacaggaactggttgaacacctgaagcaaacaaaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatttgtatagtagttaataaaggctgcctattgaaatctcttctactttaaacctagaaaaacaaagtcttgttatttcagcacagctctaaattgtatacacttgaaaaccatgtacagctgcaactcactgcaagaagtcaagattctacacatattccacatttgaaaatgatttatccatctcagttatggactaataaatatgaaagtattatgcaaaaagtattctgtcacataaaaggttaattataacagg

SEQ ID NO: 711701 - DNA, 457 bp, Homo sapiens
gtcaatctgttatttggatccacaagtatacatcttatttaaggtacttatcttagaataatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcacgaatgcgagccagtatgggtattatggttaatataaactggatcgaattaccattgctagag

SEQ ID NO: 711702 - DNA, 493 bp, Homo sapiens
  misc_feature (454)..(455): n is a, c, g, or t
  misc_feature (473)..(473): n is a, c, g, or t
tttccgactgtctctaggtgatatgcggccgtacactggcatgacgcatctaacacggaatatgataccgggtcgatttgtcataagcggttaatgttgtggccgcgaaaaataacagcacgaatatgggcataaccagcctgaatcggtaccattaaatgtaaacgcgaataaaataaaactcttataagatggcatgctgtgtgttaaaattggccgaaaagtcaactcctaacaagcccacgaatcggaatccacggaacttgttattcctattgtcccacaaaaattccagattaaggggcttgacctacaacaagctctcactacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711703 - DNA, 844 bp, Homo sapiens
  misc_feature (124)..(124): n is a, c, g, or t
  misc_feature (228)..(228): n is a, c, g, or t
  misc_feature (257)..(257): n is a, c, g, or t
  misc_feature (262)..(262): n is a, c, g, or t
  misc_feature (312)..(312): n is a, c, g, or t
  misc_feature (375)..(375): n is a, c, g, or t
  misc_feature (404)..(404): n is a, c, g, or t
  misc_feature (414)..(414): n is a, c, g, or t
  misc_feature (453)..(453): n is a, c, g, or t
  misc_feature (530)..(530): n is a, c, g, or t
  misc_feature (735)..(735): n is a, c, g, or t
  misc_feature (746)..(747): n is a, c, g, or t
  misc_feature (764)..(764): n is a, c, g, or t
  misc_feature (767)..(767): n is a, c, g, or t
  misc_feature (774)..(774): n is a, c, g, or t
  misc_feature (777)..(777): n is a, c, g, or t
  misc_feature (783)..(783): n is a, c, g, or t
  misc_feature (786)..(786): n is a, c, g, or t
ggtgacggctgcgtgcggcgggaatcatggctgctcgcagagctctgcacttcgtattcaaagtgggaaaccgcttccagacggcgcgtttctatcgggacgtcctggggatgaaggttctgcnggcatgaggaatttgaagaaggctgcaaagctgcctgtaatgggccttatgatgggaaatggagtaaaacaatggtgggatttgggcctgaggatgatcatttntgtcgcagaactgacttacaattatggcngtcgngagactacaagcttggcaatgactttatgggaatcacgctcgcttctagncaggctgtcagcaacgccaggaagctggagtggccatctgacggaagttgcagaaggtgtttnttgaaaccgaggccccgggaggatataangttctatttngcagaatcgcagtctggcctcagtcagatcctgtattanaagtaactctagcagtgtctgatcttcagaagtccttgaactactggtgtaatctactgggaatgaaaatttatganaaagatgaagaaaagcaaagggctttgctgggctatgctgataaccagtgtaagctggagccacagggcgtcacagggtggggtggaccactgcacgcagcttttggaagaattgccttctcttgcccccagaaagagttgccagacttagaagacttgatgaaaagggagaaccagaagattctgactcccctggtgagcctgnacaccccaggnnaagcaacagtacaggtngtnattctgnccnaccctnacngacatgaaatttgctttgtcggggatgaagcatttcgagaactttctaagatggatcc

SEQ ID NO: 711704 - DNA, 1021 bp, Homo sapiens
aaggccttcataaatagttgtaaacagggaaagaattcatttaacaatgcttgtcataaaagggtcacactaaacattgtacaacttattttaaaaatggtataaaattaaatgtaccattatatactcaccatagatttaaatgctgtttaaagagtccaaatggtatcgagctgcttgagtggcacgttaaactacgcaaaaccaaatcttgtttaaaaactggttttaaaataactactggattttctgaaaaagatgtgatcagttttcatcttgttgagcgttttttcactagtgcaactttggattttttatgagaattttggtaccttaatgaacacctcgctccatgctggaagcactaagcacaaagcttttaaagactttctggcttgactaattgaggtcgcactcgccaaggctgaggatgtgtaacccttaaacggtcttcattttcaaaggaaatgtcagccatcttggaatgtcacaggaactggttgaacacctgaagcaaacaaaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatttgtatagtagttaataaaggctgcctattgaaatctcttctactttaaacctagaaaaacaaagtcttgttatttcagcacagctctaaattgtatacacttgaaaaccatgtacagctgcaactcactgcaagaagtcaagattctacacatattccacatttgaaaatgatttatccatctcagttatggactaataaatatgaaagtattatgcaaaaagtattctgtcacataaaaggttaattataacagg

SEQ ID NO: 711705 - DNA, 472 bp, Homo sapiens
  misc_feature (433)..(434): n is a, c, g, or t
  misc_feature (452)..(452): n is a, c, g, or t
cgagttgagtatgagcgacgccgaacgtgtgatggggcactgttatttgccatgggcgacgctgtcagataaatactattggttaaaaacataggcttcaggctggagctgctgctggaacctatgaaggaggaagtaggcagtgaacgcgttgctggagcaattgctgataaaccagcttacgtctacgcgcatgaagggcaggctacctgtacacgttgtgctgaaccaggtgcataatttggccagcctaatactggaaattaatgataaacatgcggttgagcggcttacattattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711706 - DNA, 387 bp, Homo sapiens
  misc_feature (189)..(189): n is a, c, g, or t
  misc_feature (275)..(275): n is a, c, g, or t
  misc_feature (279)..(279): n is a, c, g, or t
  misc_feature (349)..(349): n is a, c, g, or t
  misc_feature (371)..(371): n is a, c, g, or t
gagatcaagtatcactcgttacccaggctggaatgtagaggcgagatctcggctcactgaaacctgtgcctccccggttcaagcgattctcctgccacagcctcctgagtggctgggattacaggcatgcgccactatgcccagctaatttttctatttttggtggagacatgatttcaccatgttggnccagggctggtctcgaactcctgactcaaatgatccccctgcctcggcctcccaaggtgctggggacttacagggcgtgacaactngtgncctggacctttacaggcagtattttttaaaaaatcaaaattaaatggcaaaaatccatggatgagggccngggttgggtgggcttcatggcntgtgaatttccaggca

SEQ ID NO: 711707 - DNA, 958 bp, Homo sapiens
  misc_feature (916)..(916): n is a, c, g, or t
  misc_feature (949)..(949): n is a, c, g, or t
ggacatgcttgggagaatcaaaaaggtcttcatctggattataagatagatcagcaagcccagctccagagtttacatattgaatggtgggtcagaaatgcagatgttcaagtgttcgaggaaacccacctgcgtacaagaggtgtaccagccccagcaataaccaggggaaggggaggagttacagccggccagttggagttgtagtacacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaataatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 711708 - DNA, 550 bp, Homo sapiens
  misc_feature (511)..(512): n is a, c, g, or t
  misc_feature (530)..(530): n is a, c, g, or t
gcagctctagtggcaccctaattatataattaacaactgtacagcacttgtcacatactgggattttgaatagcgctggatggtatcacatatagggataccttatgctaaggtaactgccccgaggacgagtgtagggagcgtaccaatttaatagcgcgtatgcagggcagaacagtgataaaagacagtgacttaaccctgcgtttactaacagaattttgaacaagttgtgaaaaataaaccgggggggggcgggggaaggccggtgtacgggggctgcaggcgccgtaggacagacgggccagtttagcaaaaagtaaggactagaggatggcaacaagggatgcacgtgcgaaggaaatgaagtcagcaagaagctctcactacccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711709 - DNA, 462 bp, Homo sapiens
  misc_feature (423)..(424): n is a, c, g, or t
  misc_feature (442)..(442): n is a, c, g, or t
agttatatagcgtacgccgtgcgtgtgggaaagtcattagatagaagtttaaaagggcaaggagccacaaaagggaactaagtgataagctaatgacaaagaagaagaccaagcacacagcaatgatacgggatgcggaaagagttgacagcagaggaagccaaaagaagccaaaagaaaccgataaaacgggcgcaaacccaaagtaaaacggcagtggaaccatatgggggcggacgcgaaaaagggtcacaataggaaggaggacaaaaggagtagggtaggggattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711710 - DNA, 370 bp, Homo sapiens
  misc_feature (15)..(15): n is a, c, g, or t
  misc_feature (125)..(125): n is a, c, g, or t
  misc_feature (143)..(143): n is a, c, g, or t
  misc_feature (155)..(155): n is a, c, g, or t
  misc_feature (157)..(157): n is a, c, g, or t
  misc_feature (194)..(194): n is a, c, g, or t
  misc_feature (196)..(196): n is a, c, g, or t
  misc_feature (201)..(202): n is a, c, g, or t
  misc_feature (234)..(234): n is a, c, g, or t
  misc_feature (239)..(239): n is a, c, g, or t
  misc_feature (249)..(249): n is a, c, g, or t
  misc_feature (276)..(276): n is a, c, g, or t
  misc_feature (290)..(290): n is a, c, g, or t
  misc_feature (305)..(305): n is a, c, g, or t
  misc_feature (309)..(309): n is a, c, g, or t
  misc_feature (370)..(370): n is a, c, g, or t
ccccctcacattgtngaaaccccctccccccagagctaatctgttcaaactcaaatacttaaaaattacagcggccaaacaaaagcatgggggaaaaaaaaacaaaaacaaaaaccagatggggngggtagcctgggccagtngtgtcacttggngngggcgactgaggtgctgaacaggagcttctgtttctntntttannttttctttcctcctttctcttcaaaaaggggntctgnagtagctggngtgtccagtttcatgggggctgcttcnatagcttggcgggnggggttttgggggcngggngcgggggcacggtctgaattatcactctccccgtcgctgtcccccggggccgggggccctn

SEQ ID NO: 711711 - DNA, 510 bp, Homo sapiens
  misc_feature (471)..(472): n is a, c, g, or t
  misc_feature (490)..(490): n is a, c, g, or t
gctctagtgaagtggcaggctatactctggcctaattgcgcccgctgcgtggggaccaatagggtacggtgatgtaggcaccacctggacgggcttggcaggttgcagaccgttaaaccggactggcccaaaaaatgtttttgcgtgagaagaatacaagggggggtggggggtgttagagcctacgccctaggtagatggcctgagaataacctgcggagaaccgaaaagggggctaagagccaaagctggccacctcctacctaccaaacaaagtgttccatacgcgtgtggaagccggtaataattggcgcggcccaatttgtgataccgtaaggtaggactacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711712 - DNA, 416 bp, Homo sapiens
  misc_feature (19)..(19): n is a, c, g, or t
  misc_feature (24)..(24): n is a, c, g, or t
  misc_feature (26)..(28): n is a, c, g, or t
  misc_feature (32)..(32): n is a, c, g, or t
  misc_feature (377)..(378): n is a, c, g, or t
  misc_feature (396)..(396): n is a, c, g, or t
aggcggtcctgactgttgngtttntnnngatngcgggcgctagatggatacatggattacattcacattcccttcccacgccaaatttcacaacgcatgggaaggcttctgcctattgtattaccaccactttaattcatggaattaaaggcaaatgctaaactggttgagtattttttccggtttgggcgtaaaccaaatttccggctactttcctcccatgacccggaggtcttcttctgatcttccatcctgaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711713 - DNA, 538 bp, Homo sapiens
  misc_feature (499)..(500): n is a, c, g, or t
  misc_feature (518)..(518): n is a, c, g, or t
ctgttccatgctgtctctaggtggtggacccactgcctaatgcttaaacgtagcaaagaacaacaagaaaagcactagcaaagataaccggaatatgataggcccataaggcataaatgctagaagttaacaccaaatgcaatatgtaataagagcaaattattagaagtgaagtgtgtgccggaagtagatgtacacgggcgcctacacattgcttgtatgaaacaggatacacaaattggtgacacagaactgtgaaatagaaagcgaaaaacatgatatgcaaatgctgatacgggagcggggatattaattatattgtttaatgtgggttgtaaaataaattaggaacttatgataaacaagctctcactacatccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711714 - DNA, 427 bp, Homo sapiens
  misc_feature (388)..(389): n is a, c, g, or t
  misc_feature (407)..(407): n is a, c, g, or t
atatagcgtacgccgaaccggcttgtgatacgctgtaatggcgtcgtgatctgcggccacctatcggggaataccaccggcggtcacggcgacgaacattaagatactcacgaacaaaaagatgatgattataatgaacactataaacttgtaccacttaatataaggcaggtgcccggttatatttgttactttaatataatgcccgtggtttattgagggacacacttggcgcccatattaaattacattattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711715 - DNA, 339 bp, Homo sapiens
  misc_feature (120)..(120): n is a, c, g, or t
  misc_feature (124)..(124): n is a, c, g, or t
  misc_feature (130)..(130): n is a, c, g, or t
  misc_feature (143)..(143): n is a, c, g, or t
  misc_feature (162)..(162): n is a, c, g, or t
  misc_feature (300)..(301): n is a, c, g, or t
  misc_feature (319)..(319): n is a, c, g, or t
agctgagtacgggtaagggccggacgtccggccctgttgttgccgcaccgcttactcctaaggaaacgtttggtgtcccgggttatgtttcctttccgtgtccgtgccgaacgtgcgaangagntataantatcgaattcacncaccaccactgaccttcantaagcaaccaccagagcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711716 - DNA, 151 bp, Homo sapiens
tcgatctctagcaggatccccctttatcccggggagggaagcagttataaatgcgagtttcgcagcatacgctcgcgaaagcgtttgagcccgagacccctacttcatgacctagctgtggccagcacccagaggggtaccgacgctcgaa

SEQ ID NO: 711717 - DNA, 125 bp, Homo sapiens
  misc_feature (9)..(10): n is a, c, g, or t
cgaggttgnnttgttaccttgccctggtcaccacctgcttgccaactcagcgattgctttttctggctgctgcattatcatagaaacggctcacaagttcatgagctagacgtaatttaacctca

SEQ ID NO: 711718 - DNA, 1075 bp, Homo sapiens
tttgttccttctactggacgaactggaagacctatgcagcatatacccacttaacttagtttcgttgttactcaatgttgtcctctgattagtcgttgtcaggtttaactgtgtatttctatttccctttgcatattttgctatttcatcctctcgtgtctgtttttggccttcgcctgtctctctatgtcggtgattgcttcaaatggggattcggttgatctgatgttttattgatggctctggcaattttcttaccagtccgccttcgtgttccgcgccaacagtcaccacttctagcgttcacccaggtagttagagtgcgctcgcctgctccagtggacacatgtgtttgcgtgctacggtaccgtaaccgtgcatacggtgagctctaatcacttgttccttaaagtagggacctgttatgtatggtctccatcgagggttcagctgtctcttactttcaatccagtgagatattgacctgcctgtgacagaatggcgggcataacacagccagacgagtagaccctatggagctattaagttttacttgatgcaaaacagtacctgacataccccaccaggtcctaaactagccaatacactgcattaacaaattgtacggtctggggcctgacctcggagcacgaaacccacacctacgagcagtagcatgctagagagcgttcatccagtcaggagcgaaatactatactcaattgatccaatgacttgaccaacaggaacaagttaccggctagggatgacagcgcaatcctattctagagtccatatctagcaatagggtttacagacctcagatgttggatcaggacatgcccgatggtagcagccgatagttaaaggttcgtgttgttcaacgacttgaagttgcgtacatgatctgagttcacaccggagtaatccaggtcggtttctatctaccttcaaattcctcactgtaagcgataagacgagagagattaggctgattgcagaggcccttatgacccgggttttatatcttacagtcttactccgtgtcaccgcctttaatccgtcgtttttccct

SEQ ID NO: 711719 - DNA, 423 bp, Homo sapiens
  misc_feature (384)..(385): n is a, c, g, or t
  misc_feature (403)..(403): n is a, c, g, or t
ccggtaacagggtgtgaggattagacttaaagtgtaagcgccctgtgcatagcacccccgctggattactggtaacctgaggataaagttaataccaaagacgagggagtaagattgtagtacgcgaagataaagtacggtactaccttttaatacttacaaccttaactaacttatactttgctaatatatattgttactgtactttgaatattataacattaattggcgggaatattatgcttagcattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711720 - DNA, 303 bp, Homo sapiens
agagagaactgaggcagaggtaattcaactgccctgggccacagagcagcacgactcaagggcctagcacctggatccagaagctagggctctcggtccagcattcatccactggtggacatcacactgggcttatctttaccagcgaaggttacgtgaaggacaaaacgcactcagccagcaacggaaactcaacagttcaaacagcactggggaacactgtcagctaacagagacgcaacgctgacccagcctcatgaattaggcacgacaaccaactgcggctgaggaacgctgtggaat

SEQ ID NO: 711721 - DNA, 218 bp, Homo sapiens
gtttacaaaaaaaagcaaaacaaaaccaacaacaaagccccttgatgtccgtcaagcaagcagcggggatgtagctctctctagccctgggcaagaataacacttcccgttaaaagccagcagccgggcgtcagtccctatcaaagccagctagatcatgcactgttgaccactgggcaatctgtgtaacagtaaaagttcacaggggcattatagag

SEQ ID NO: 711722 - DNA, 135 bp, Homo sapiens
tcacggtgattatacatctctcacactcctctgagtactactgctgtttctgagacgcgagggcagtgcaggcagccgtttcttttccttctttaagcgttcttctcctgtctctcccagcttcctagtaatctc

SEQ ID NO: 711723 - DNA, 392 bp, Homo sapiens
tgtacatataaaagtattatgaagagacattaacattgatgcaaactctagaaacagcactcacacacagacttattttctgcgcatctcttcaccctctaactcgcgatggctccacagggttgacctgttacggctgtccccagtacttcatcaccagctggactacagtgcgtcacatcatcaggaaacgtgcaccttacatccgtcagttattgaatactgtgaaaacatatccatcatctgacaaaacttgtacgctttctttcaggatctgtttggcgtgttagctgacatctctattacaccaacgaggtacgtgtgtacaggtctgaaataggacacactataaaaggcatggttctcacatcaggtgtgtgtgaagtcgctgg

SEQ ID NO: 711724 - DNA, 324 bp, Homo sapiens
  misc_feature (69)..(69): n is a, c, g, or t
taaattcgcggccgcgtcgacgatggagtcttgctctgttgcccaggctggagtacagtggtgcaattnttggctcactgcaagctctgcctcccaggttcaagcaattctctgcctcggcctcccgagtagctgggattacaggcacctaccaccacacctggctaatttttgtatttttagtagagacggggttttaccatgttggccaggctgctcttgaactcctgaccttgtgatccaactgcctcggcctcccaaagtgcttggatttcatgcgtgagccaccgtgcccagccatacataatcattctttactttgca

SEQ ID NO: 711725 - DNA, 967 bp, Homo sapiens
gctctcttccacccatgccgtcatgtctaagttcagagtctcctaaagagcccgaacagctgaggcagctcattcattgtagggttagagcgtttgaaacaagcatgagtgatggagcctcgaggagccattttgagacaatggggaacgctcactggactgtgtgtgtaattgagatgatccaagacaccaacgcgactccaggtggctatagagccgtcttgatcaccactactgctcactgtgtgacggcggtggactgccgcatatgaactgcaacggccacaacaacggtggactgcgacacgagtagtggaaaccaaaagagagctgtctccagtagaagattctcaaagaccaggtgcccacttacctgtgaaaaagatatttcgttggaggcacttaaacgacaacacctgaacgaacatcaacctaagagacttcactatagaccaagtcattggacaaacaatatgacaagtgatctgaacacccaatgactgaccagcaggcaagtgcagcacgacaacagggagacaagcacataagaacacatatagacagcaccacgacatccgatgacaacacgaaatgacactaccaacacaacccccacacagacgactggacacacacagggaccgaaaacacacagcctgacaacagaagacaacgacaaaagtacaaacaagacaacacgaagccgaaacggcactggaaacacacatgaaggacgagcaagtgcaaaaaagagagaggcacagaaaggtaagagcagccaacaacagagacgtgagtaacacaaagaaaggaagcaaagcaaagaaaaagacacagaacaagaaaggagaagcacacagaagaggcgacacaaaacaagaaagcaaaaacaaaagcaacagacaacagaaacaagaacacacaaaacgcacgaaaagaaacaacccgaccccctgaagagagacaa

SEQ ID NO: 711726 - DNA, 167 bp, Homo sapiens
ctgacaagaacaacagtaagatataggaaaagaggagaaaaaaaacatacgggcgacatatacgaaagtggccaaaggaggcaagtgggcaactgaaaacaaaacataaaggtctatgtggatgcagccaaatgtatctccatttagaaaatcatcataacaggtgg

SEQ ID NO: 711727 - DNA, 467 bp, Homo sapiens
gttcctttccttttttaactttttaagagacaaagtctaggccaggcgcggagtctcaggcctgaaatcccagcactttgggaggccgaggcgggcggatcacttgaggccaggagttcgagaccagcctgatcgacacggtgaaaccctgtctctactaaaaaaacaaaaaacaaaaaaacaaaaaacaaaaatcagccgggcatggtagcaggcgcccgtaatgccagctattaggaaggctgaggcaggaggatcacttgtatctgggaggtggaggttgcagtgaaactccgtctcaaaaaaaaaaaatttcactttttaagagcgaaactccgtctcaaaaaacaaatctgccaggcgtggtggcgcaggcctataatcccagctacttgggaggtggaggttgcagtgagcccagatcacgccactgccctccaacctcggtgacagaatgagactgtctc

SEQ ID NO: 711728 - DNA, 103 bp, Homo sapiens
  misc_feature (48)..(48): n is a, c, g, or t
  misc_feature (55)..(55): n is a, c, g, or t
ctctccttggtcagatcggcgccgcgttgcggcctcggtggctctgtngcagccngcggcgccaggactccggcacttatgagcggctcaagacccgaggagc

SEQ ID NO: 711729 - DNA, 1753 bp, Homo sapiens
taaggttggaggggggaaggcgtggagaagtgtggtaagtgggttatgtggagaacatgtgttcatatatataagataagtgcataggggtgaggtggataggaagtttttttacaataggagggtgtagtgaagtgggctcgataggcggaaactcgggggatagtgcgtggttgcagaatattacaataagaaaacgaagggtgaggtgttagaaagtatgagggtctctgtggggtgaacacaaagatagtggtgtggtgttaaagtttacacgggggagaaggtggcgtatcaataagtggtgaggttccatagagaaaaaaagtggtagagggggtgagagaggggtggttaaactatatatacaataaagatgtcgatgggggagtatatatagcaggcacgatactgaaaaagaaaaactaggtggcgaacagagggggacacgaggcgcgcgcgcatactttcgagagaagtaatagaaaagcaccagtgaagccaccataagaacagcgagcaaactatcacacaacaaagacgagaacaaagagggacagaaaagaggatggtacacagagagagagggaccaacacaggggcaaagaaagagtggagaacaaaaaaaacaaccaaataaataaaaagaggcaaaaaaaagaaagaaaaacaaagcaaagagacacaagacgtagaaataaccaacacaaaaaaagcggaaagaacaccaacaaccgaacagccaaaagaaaagaaaaatacatagagacgcacgccaaacagcagaatcacaaaaaaaagaagaaacgcccacacaactaccacatacaccacgaaacacatattgtcaaaaaaaaaccgaacacacaaaaaccaagacacaccagacaaagaaacaacgaagaaccaaatacaccacaaatagacacaaatataagacaacgaggacgacgaccgacaataagaataccacacagccagcaagaggaacggcatagacaacacaaacaagcagagctagagacacacacaaagacagacacaaactacagagaagacgtgcacaccaaccaccccgagaacaaagaagaagtcgacacgacaatactagagacaatagaacacataaggaaaaaacacagcacacaaacagagataaagaatcaatacacacaaacatcaagaaagaagacaccaagcgaagaaaagcacacacagagagaacaaaaaagccaacaagcagccacacaaaggacgaaaagcagaaaacggaaagacagacacaccacacaacaaaagaacgagacccaacggatcaagaacacagacagcgcaagacgaacacagagcgaatgacgacagaaagagaagaaacacaaaaaagagcgacagaaaggagacaatagaaaaaaccaacgacaaaacacaaacaaagcacacacaacaaaacaaaagagaagaaaacaaaaatagagagtaagaagacacaaacagacacgagcaagaaacagacggaagcatcaacagacaagaaaaagaaaacaaaaagaagaagaacagaagaccagacaacacgcaaagcaacccacagcaagaacaaaaacaaacaagacggaagtaacaccgcacagacaagaaaccagcagaggaaaggcaggcaacagaccaacgcaggaacacaccaccaaagaacagacaggaacacaacagacagagacatcaactggacgagacagaaaaaacagcgacacgc

SEQ ID NO: 711730 - DNA, 220 bp, Homo sapiens
aaaatactcaattttactataagaaatgtaaacttaggacaatagtgagctaccattttttgccatcatattagccaaatactttttaaaaatgaaatggcaagatctttgtgaaattgcactcgaatttttgttataaattaatgcacatttttggaagcagatggacctcttctggaaagcaattccaaaaattagtataaatcttttaaaagtttga

SEQ ID NO: 711731 - DNA, 205 bp, Homo sapiens
aagagtataatgaaaaagaagaatatagctgagctccttagcccagtgagcctccatgctggctgggaagccaatattccctaacgcagcctgtaacagggaggcagttgcaaactctagggactggccatgtgtcagcctttatcctacaggctagcggctcaacgaccaagcgctggctgaacgcacaagaacatgccccttc

SEQ ID NO: 711732 - DNA, 451 bp, Homo sapiens
cactaactgtttgagtctgaacatacaggccagaggtgtccacgtaggtcagcgacaggttcccatacccggtctacattatgacgcgtactgaagcatcgccgcctaagaccatatgaagacgtccagccatgacctcatgctgatccgctatgtcagagacctggcaagatcacagatgttgtagaaggtcctggggctgacccagccaggagccagtactggggaccaccggctacgcttcaagatggggcaacatcgaaccagaggagttcttgcgccccaggagtcttcagtgtgtgagccaccatctcctgtccaatgacatgtgtgctagagcttactctgagaaggtgacagagttcatgtcgtgtgctgggctctggacaggtggtaaagacacttgtggggtgagtcatccctactcccaacatctggaggggaaagggat

SEQ ID NO: 711733 - DNA, 338 bp, Homo sapiens
cgccagtttgtgtgcttttcactgagtacatcatgggttgcccttaatagctgggagatctctaaaggcttccttgtggccgactggatggagaataatgttggaggaggagaggacgaatctcggactgtaaggtaaaacccgaggagggcacaaatactctcttgatgtctcctgcctcctggtggaatgggcagtttaggctgtgtgacctctggtctctgtgtgatttctgatcttcacttgactctgggcttcattgtggtattcaaccttggcttggttcttgtactgcagtttgacctccgagctcctggtctgatccacatccgtactgg

SEQ ID NO: 711734 - DNA, 186 bp, Homo sapiens
ctaccagtcctgcatcggtcaaaagttagtaaatacgtcaggacatgtccagcctctcaggtcgagtgtagctgtgaataattaagtaagaaagtagtagcccctggactttgctatgagttctttagctaacacgaataaagcagtgacatcatgaagcacagcaaagtgcaggggaacagaatt

SEQ ID NO: 711735 - DNA, 122 bp, Homo sapiens
gtgaacgaggtatgaatgtggggacagtgtgtgatagccccctccccgtccatgtaccaccccgggggcatgcggctgttgtcggaggcgcacggagtacaggggggagcaggcggcggccg

SEQ ID NO: 711736 - DNA, 341 bp, Homo sapiens
cacgcagtatgcctatggcagccaggacgaggattgctgacaatgcggattgaagccttgccactgctcgcgcagaccattgctccagatccgcagtcagaccggcataggaagcaaacaaggcatcgcacttgctgcgctgaaacaccgccctgaacccttacctgatagcgccacgccggcggaggccattcgtggaaaccgtcgccgtgctcgtcgagcaggatgaccctggagctgccgtcatccaagcccgatcacttcaaccggaatattgccgatcggaacgtcgaacgctgactcgacactgctctggatcttcagcacaccccctgccggac

SEQ ID NO: 711737 - DNA, 494 bp, Homo sapiens
cactgaccagaccgcacgtgaatgactcgcgggtacatcccgaagtgaaggcataacatagcgatgttcactgagcccagcgagaacaaagacaccacataccagcattctgtggagaggccatacaaagacagtagttgtagcagtagaattgtaataggcgcctgaaatgcctacagagtaaatcgcgggggatccgctaccacgctcgagctggcaggccttcaaacggggccctggacgtcgttgtccaacgagttacctggactcgcctccacgtggcctggtcacctcgtcagtgcctttgtccatactggggcccacttgttgcatcagcttcttcttccttccttgcttggttgttcctggtgaatttgtgcctggtggttactgaatttgtctacattgtgattcttagtttaagtgaatctcttcttcagcagtgcatgagcttcctcacagcagggactgtgtcttattatctttgtcttccc

SEQ ID NO: 711738 - DNA, 162 bp, Homo sapiens
agaggtatcccctcacagtacaagagacgagatggcagctgacagaggaagccgctcaacataccttcacaataaatcgtggcagtatatatcttgttacagaaggcctctccgatctggcatctgtttaatttattattttatgcttctatagcagcatct

SEQ ID NO: 711739 - DNA, 168 bp, Homo sapiens
  misc_feature (23)..(23): n is a, c, g, or t
ggggtttgccccccccctttttnaatttgcccaaccccttttttagggggggggttttttttgggcccccttttttcccctttccctttttaacccggggggggggggtatttctgttttttttgggccaggggccccccttatttctttggggatttttttttttta

SEQ ID NO: 711740 - DNA, 168 bp, Homo sapiens
caataaatacagcagtgtacacataacaacatcttggtaaacaacagactgcatatatatggtggtcatccagtaagctaaggttaatttattattattccttgtttctttttttttttttttttttggaatttaatgttctcctttccccccggggaaaagggaagg

SEQ ID NO: 711741 - DNA, 436 bp, Homo sapiens
  misc_feature (257)..(257): n is a, c, g, or t
  misc_feature (260)..(260): n is a, c, g, or t
  misc_feature (397)..(398): n is a, c, g, or t
  misc_feature (416)..(416): n is a, c, g, or t
gccgtgctaatgagtgcagacagaatgcaaccggtacaatggcagagcaaatgcacagggggcactagtgcaggtgggttgtgaaaggcgggcgcaataagcagcgcgggtggaggcgtggggagttgggtcagcagtgtggtgggaaagacatatgctagtgacgataggggcaagggccatttgccgcttttgattacggtaaccgggcacagcttaatgcgccagcaagtagccagtgatctagagacgataantanaattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711742 - DNA, 142 bp, Homo sapiens
gctcttatctttctaccagtactccttggtctgtaacaggaatgccccttactcagtagcaggcggaacacggacatgggtcacgaaacccatgctatcatggggacaccgttgtatgtcgttccccccccacgatacagcg

SEQ ID NO: 711743 - DNA, 462 bp, Homo sapiens
  misc_feature (423)..(424): n is a, c, g, or t
  misc_feature (442)..(442): n is a, c, g, or t
gtacgcctcatgcatcccagaatactcaggcaaaagtgggggagaattgatggcgaaggcggttatagtgggttgtgcacccgtatgccggggctgcccacgcagaaacgggtaagttgataattgcggtgtacgcttggctacacgcggttgcttgggcttagaacgggagagtgcggagagttttagcgagccctgtgtaaggaggcgaaaagcggggggcggtgcggtatgcgatacttgggggtggtacggtttaatgcacctggctaatatggtgctgtgacattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711744 - DNA, 502 bp, Homo sapiens
  misc_feature (463)..(464): n is a, c, g, or t
  misc_feature (482)..(482): n is a, c, g, or t
tgtgaaactgatggtaattgccacgggaccggaacgtaaatagacctaaccggaccacagagacggtgctaccaggacgtattgacaaaacggctaaagcggggagcgaaggaggacctatgggaagtacgcacgggggaagtacccgggcggctgccgaacctgccgactgcgagggcggaatacaaaagtaagtaggccaacgcgccttagaaacgagaatggcctgcaactgggacgcgacgcacaatgccggacgcgagatgctagggcgagaaggaaaagcataacactttgagataagctactggccggccgaaaagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711745 - DNA, 418 bp, Homo sapiens
  misc_feature (379)..(380): n is a, c, g, or t
  misc_feature (398)..(398): n is a, c, g, or t
cctgttataaagcgtacgccgatataaccaggtggagggtcaccgcgacggtagcggtgccagacgccaatagctgcggcgggtgaaactgaggacacctaaataagattgcttgtgtaggtatagaaataaggggctggtgtggaaattggggtaaataactatgggctatgcgaaagtgtggacttgttataggcgcctgccgtgtagcttagggtaggggacatttaagacatacaataagtacataatattatgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711746 - DNA, 110 bp, Homo sapiens
tgttagtataattcgggagtcgtcaggaagctaggtgatagaacaacttcagattctgggatttctagtctataatgacggtttttttatggataaggagtttcaactct

SEQ ID NO: 711747 - DNA, 368 bp, Homo sapiens
  misc_feature (329)..(330): n is a, c, g, or t
  misc_feature (348)..(348): n is a, c, g, or t
ggacgctaccattgggacttggctgcatgagctcgtcatctaaaaacgattaatcgacatcctataattagatgaacacggctgcggaatgttggctcaaccgaacaatgtttgtaggagcccggtcacgctacccaaagcgttcatcacgcgtgccaagcaaaagtttagtacgacgacacaacaacttgaccaggattactatgcaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711748 - DNA, 505 bp, Homo sapiens
  misc_feature (466)..(467): n is a, c, g, or t
  misc_feature (485)..(485): n is a, c, g, or t
tctatgcgagaccctgtggcgtaggggaaagagataaagctacgagatatgaattacggtgtatgatatgaaactcgtacttaacggagatgggagcctgatatggttaagcaggcaggggcgcggaataaagatactgattacttggattactaataaatttgcaggaaaaatgtatgcaggaaacgcttgaagaaggatagaaaatagggctaatggggtgaccgcatgaagttgctacaaaagagagtgttgaattggcttgaagcgggcatggaattgaaatgttaccggcaaagaactgggaaacgtggaacatataagagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711749 - DNA, 512 bp, Homo sapiens
  misc_feature (473)..(474): n is a, c, g, or t
  misc_feature (492)..(492): n is a, c, g, or t
attaatgaacattatttagcccatgagaataaacggctttgcctagaatgagccactggcacaccacacatgggtgtcgccccggactaccctgaaaatagcggtgcgcggcaggcagtacttaattaccgggcgcatctttactaatttcgcctaaactagtgctgtactgcccacccaggctacgggaattgactcaccaaacaacaccatttacgttacaactacgtgcgtaatgaccatgctgaattgctataactgctagatgcaattgggttgcgcgaaactaccggaccggcatatttggaggagcaaacggtgcgcctttgacagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711750 - DNA, 1491 bp, Homo sapiens
taaaagatggttttgtccgtgtggagtttgtgatggaaggagccccgttattggtggtccccggtctttgattgagtttgtgcccaggtctttatgtgtgtaggggatctaccactggggtggggtgtggcaacagatggaagagaagagtagagttttttttggtgggggggtttgattaggacttatgttgttgtgggggggctcctcactgagagttggtttttttgtgctcttcacccgtgcggttgtagggggggagcccctgctatataggaagggtgtgtgttgattgggttgttcatcatgtactccggcgaccaccagaggagatatgctcgcctcttgtcatatggagtagaggaagagaatggtctgtggttgcacagggggtgtgtattattagcgcgccgagtggtttggatttttgttgtgcagtatgagtacgtcactaatgttggtgggttgtttgtgacatgaaatgaggaagggagggtgcttataaggaggatgaggctggctcgttgtcggattcaccttctctggggtgctatgatgagaaggatatctttgttgcggggcgggaccacaagaataggacgcgcgggtattgatttgttggttgtctctccttcttggtgggtagggaggggtgcttctaaataacaacaacgtgattgtaggggtatggagaacacacacggctgttgatggtggtggcgacgtccctcgcatttgacctctgtgaggaggagacatctgtccttttggacacgagtcgttcgacatcaacacacgtttaatggtcggctcttctgtgggcggggggtgttgttgcacagggtgtgtgggcgtcacctcactctgtctctcggctctcacaatatctctcgcgaggagaggggggtctctgtgcgggggtatagtctcccctgcacacacgagcggagagagtgggccacaatatactctcttttgcacacacccaacacggggtgggtcggcacacacagcagagtacactctctccacactccgccctcgagagtagtgttgcgtctcttgttctcctctcacacatctcactctggagacgcgctgtgttgggggcgctctgtatctccacagacgtggttgtttgtgatatatgtgtttgatgatgtctctgtgtgtgtgtgggcgtgagatagacagaggagacgaacagatggtatctacccacacagagcacacactacacagctgtgtgtgtgtgcgggaagacaccctgataattttgtgtgtgttagacacaacacatagtctccacatcttttctcagcacacctgggctcttctccccctttcacacacgtggtcgcacacaacgtttgtatatccgacacacatatgtggagacgttctgtgggaaattgtgttcgtggtatatgttcgtgcgtgtaatataaatggagaatgttgtgttggggaagatgtaaagaatataaataa

SEQ ID NO: 711751 - DNA, 510 bp, Homo sapiens
  misc_feature (471)..(472): n is a, c, g, or t
  misc_feature (490)..(490): n is a, c, g, or t
cacggtgtagaggtcgggggggtatagttatatagaataggatatttagtgggatattcaacgaagaggtgaatgtgcttgtgcggtaggatgagaaaagagataataatcgggttgtgtaagattttgttaacgcagatgatgtttcgaggcctggttgcgtgcggtcttacggtctgcctatgagtaattagaatagtgatttagccagcctatttaattttagtatgatctgtaggaaagtctatgtggtgtttagcctatgtagggtgaatagtagtatgtatatgtactttggcggtagatgggtattacgcttggtggtaaagagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711752 - DNA, 270 bp, Homo sapiens
ccacctcggtctcctgagtagctgggactacagacattccgccaccatgcctagctaacaaagggtattttaaggcagtgggttcccttctggctcagggtgtgtctagaaatgttgtccaggaggtagggcctgaagtgggggcctcaagactctgcctgttgccctgtgcactatggctgagctggtatccaagctgccagacaaaggcctctctactttcctctcctctcctcaaaaggaaagtagagagtctccgtcgaactgggt

SEQ ID NO: 711753 - DNA, 207 bp, Homo sapiens
ccgaaatttcacttatgacctaatctcataggtcacacaccatccatctccaccacattctattctccaagagcaagttaaagagtccagcccacactcaaggggagggcaatgaatcattgcctttagaagggaggagtgacaaagaatgctacgacatattctaaaaccaccacaaagagtgccagaagtccataatgatgtgac

SEQ ID NO: 711754 - DNA, 360 bp, Homo sapiens
  misc_feature (173)..(173): n is a, c, g, or t
  misc_feature (181)..(181): n is a, c, g, or t
  misc_feature (183)..(183): n is a, c, g, or t
  misc_feature (189)..(189): n is a, c, g, or t
  misc_feature (321)..(322): n is a, c, g, or t
  misc_feature (340)..(340): n is a, c, g, or t
ggccgctcgctcgtggccggttgaggtacagaaggacgcttgatctgaatgtacagttccttcactcagtaagcgtgactgacctaaggataaacgcgtggctgagactagtacctgccgatggttgccagccaccagagcccaccagatgccaccagagcaccaccagagcncaccagancnccagancccaccagagcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711755 - DNA, 384 bp, Homo sapiens
  misc_feature (30)..(30): n is a, c, g, or t
  misc_feature (36)..(36): n is a, c, g, or t
gttccccttggttgctaaactctgcacccnattccnacccttcgaaacccacacgtccccacccactgtaactcacatcccccttcccttccttatttgggaaaatatcccacaaatagcccaatcaggtcaacttagaatgtgcagtctgacccgcctaccccccgcccatgggagattgacacagatgtaggggccacattaggaataaccctttctctcctttgttcagtgtgctcttgtgatcgtgaatgacacgagcagcacccttctgcagaagtaaattgccttgctgggaaaacttttgcccgagtgctggtttcactttgcgaaccgagcatttatctccaacatagacattgacttaggcaaggatttcatgac

SEQ ID NO: 711756 - DNA, 260 bp, Homo sapiens
  misc_feature (26)..(26): n is a, c, g, or t
  misc_feature (66)..(66): n is a, c, g, or t
  misc_feature (68)..(68): n is a, c, g, or t
  misc_feature (106)..(106): n is a, c, g, or t
  misc_feature (151)..(151): n is a, c, g, or t
  misc_feature (155)..(155): n is a, c, g, or t
cacatattcatgatgaaagttttcanttaaaaaatacataaggccgggcacggtggctcacaccantnatcccagagctttgggaggctgaggtgggaggttcgtntgcgctcaggagtacgtgaccaggctgggcaacatggcggaactntgtntcttccaggaatacaaaaagttggctgggcgtggtggctcatgccggtggccccagctgctggggaggctgaggtgggaggttcccttgggcctgggaggcaaag

SEQ ID NO: 711757 - DNA, 406 bp, Homo sapiens
  misc_feature (367)..(368): n is a, c, g, or t
  misc_feature (386)..(386): n is a, c, g, or t
gtgcatctgcgaggtgaccgacagaagaggtgcagtggtgtgatggggctgcccggacggtgcacgtgtggtgtactttttatatgatagtgtgtttcgaatgcgtaaagttggtacaagatggactattaggagctgggtgggtagcgataaatagagtaattgaagttgcgattgctttgaccgtgaccgcagtgatagatacatgtgatataatgaatatatcctgcaattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711758 - DNA, 111 bp, Homo sapiens
aacgatggtcctcagctcgagaccaccaggccttcttcactaagacttgtattcaacttagtttaatgtagattgccattagctttttcgtaaaataaaagcacagaacag

SEQ ID NO: 711759 - DNA, 790 bp, Homo sapiens
  misc_feature (107)..(107): n is a, c, g, or t
  misc_feature (193)..(193): n is a, c, g, or t
cgggcagccagcgccagtcggagccagcgcgagccgccgccgccatcactgccgctgccaagtcctccacccgctgcccccgccatgtctgctaccgctgccacggncccccctgctgccccggctggggagggtggtccccgcatgacaccccacctccaaaccatcaccagataacaggagactagcagcnagacccaggacccagagtggcatgaggtggctggacactcatgagggtgaacgtggaccaaggtcctggagcgagaccagaagctgtcgagagctggacgaccgtgcagaatgcactccaggcgggggccatcccagattttgaaacaagcgcagccaagcgtcaagcagcaaatactggtggaaacaaccgtcgaaggatgatgactcatcttgggagtgattttgcagccatcatcctacatcactcatcataggctgagctagcggatgagaactggccggggacccatttcccctggaccacggtttcccacaactggattctagcgatttctggacaaggtcagtgtaccgtcgtagcttatatgagacgtcattcagcgccaaaaacgcgatatagctggctaagtggccacatctgcattcatctagagcccaaaccaacctattggcctgcttgcgtttacgccctgcaatttaggacctagctatcttggcagaacatagctatacccatttagggcacctatggcacggctggctgtattccactccagggacccctttaggccctcaaaagccccagtccggagaa

SEQ ID NO: 711760 - DNA, 209 bp, Homo sapiens
acctttaggatcttctccggacctctgatgtacagacagaaacttcacattggggctaggaaggggccccttaacattggaagcactggcgggcaacactgctcggactctgaaaggttgtaataattttggaatattaagaaggaagggtttcttttctctttctggaacatttataatttagatattaagctcctgaagggatcaat

SEQ ID NO: 711761 - DNA, 116 bp, Homo sapiens
acaaccactttgtgcatgcatctcaggcacacacattctttccctggacgcctatcctgatccccatcaccgtacttttcgtttcgtctttccaatcttttcttgcttcattttct

SEQ ID NO: 711762 - DNA, 137 bp, Homo sapiens
atgtttaaatcagtaaaagtttcagagtggtagttatattttcctgttcatcatcttccacgaactgcaataccagtaaccttggtatatatttttttgatactgtacacatggatgtcttgtttctatgtgcaaaa

SEQ ID NO: 711763 - DNA, 1202 bp, Homo sapiens
  misc_feature (107)..(107): n is a, c, g, or t
  misc_feature (187)..(187): n is a, c, g, or t
cgggcagccagcgccagtcggagccagcgcgagccgccgccgccatcactgccgctgccaagtcctccacccgctgcccccgccatgtctgctaccgctgccacggnccctcacgtgactgacacaccggtctggggacgggctggtgccacgctgtgactacgcgtcgaggctgtcagaaaggaancaaggagagcagtagggaagcgccacggacgcatggtaggatgagtgtggtggaacatgtgatgcatggagttgcaagcgatggaatctaagggatcacatgagaagcctgagaatccggtaagaactgttggagaagccttgagaacgtacacagcagggaagaatgtcgatttcacaaatggccgagaggagttgctgcgctctagattcatggaacatgatagcagtcatgggaatggggatcctaagggcagccgatgaactttacctggatgggacatatacacctctaataaatgagatgaatagaattgagatcaaaatggggtgaaaagctagaaggtgtgtcgacaggaacagaatccatattccttcgaagctcgatattccatgtcagctgaaccttttttatccgtagttgaagacgagccatttatatgaaaatcacacacatgtaggagtacacgagttctattagttgtggccggtaagaaatcgtttaatggaagggaaaaccgtcgggatgcgggcattgcattctagtagtagaaactttggaaccgagatcgagtgaattcgaagatgggcactagacgttgaatccaggaacaagcgtagtctcactataataatttgcggagggtataaaagaaacgcgagttgtagcacgattcattgagacagtatcaaaggcataggcagaattttgaatggggagggaaatatgaaaacctgcgcacggccaggattacacataagcatgcaagcacaaatggaggttgatagggccgaatagccgcacacttggacaacaggggcagcggagaagttggaggtataccatttaggcggagccttcgttagaatgacatctgtacccctatcgaattccatagtcacatgtaggaagatacaggtaggccacgaaacacacacacagaggttcgaaacgcaaattattagtcaggggtatagtaccatcactttgggcaaccacgaaaacaagacgaacg

SEQ ID NO: 711764 - DNA, 143 bp, Homo sapiens
accttcacaaacgacgactggggttctaccctgacgtttgccttcctacctgtccctacgacaccactgtgctgtcggctatgtccacctcacgccatcacaaacctcatacgacgcacggttatgccacgtacgtgtccttg

SEQ ID NO: 711765 - DNA, 240 bp, Homo sapiens
gtagaaattgaaacctagcgcaatagatatagtaccgcaaggagaagatgagaaattatatccacgcataatatagcacggactatcccctataccttctgcataatgaattatctagagataactttgcacggagagccacagctaagaccccgagaccagacgagctacctcagcacagctaagagagcacaccgtctatgtagcagcatagtggggagatttataggtagagcgaca

SEQ ID NO: 711766 - DNA, 888 bp, Homo sapiens
gtagcggcattgtcccagatatacgtccgtctggtacaagagtcggggtatctcgacgagtcttcttctctactgtgttgctgatctaacgtgagccgcttatcagtggagcagtgactcgtgcttctgcagcaaatcggaatatgacatgcacacgaaaggttcaggaggtgactgacgcaagtgcgaaggcatcacccatcttaatagtgatccacatccgtgaagtctccccatcgaccgtcacggagcgcgggaagtccatctccctggggctcgtcgctttgggaatggtcgagcagcgctcctgcatcgctgacaggggacccaaacctaggggccttccatcagatattgaacactggcaggcaggctgacaaagaaacatagtgttgacattacattagactctcagttgcatctgcatgttgctgcagcgggcttagccctatctgacattacaccagttctcataatcatctcataggcagtttgataataccagcacagcatcgtctccaagcaacggcgcagggccggatgcaggcacctgcccgagctggtgaagtcggtcctagtacgggtgcagaccttggtccttggcatgccctcgtgcggcgtcgcagctggagcgccagggaattggcagatggccgggccgagtcccctgtgttcatggatcattcgctggacgtaaacctacttgctaccctgatggacctctggatgtgcttgacaccagacttcttactcccacgtatcgggacagcgtcggcaagatcagtcatctttcccaaggaaccaaccaggtatccagggcctgtagcagtaatgcggaccccgtgaagcgccccagaacgcaaggctgtcgctggaccgggcgaaaca

SEQ ID NO: 711767 - DNA, 924 bp, Homo sapiens
gaggcacccagcagcaacagccggctaggccaccgtactacggactccggagcagcagacatggcatccacgatcatggccgccgcctcccgcgccgttgtcgccaagacgccgttcctcagcggccagggccgcgccgccagcgccagccccctgcgcgacatcgccgccgcggccaacggcagaatcaccatggtacgtacgtgccatgaactaaccaccacggaaggaactcgtccgcaatgctatgtacgcgtgctaagagctaacgattgtctgatgcatgtgtgcgcgcgctcgcagggcaacgacttgtggtacggcccggaccgcgtcaagtacctgggccccttctccgcgcagacgccgtcctacctgaacggcgagttccccggcgactacggctgggacaccgccgggctttctgccgacccggaggcgttcgctaggaacagggcgctggaggtgatccacgggcggtgggcgatgctcggcgctcttggctgcgtcttccccgaggtgctccagaagtgggtgggcgtcgagttcacggacgcccgtctggttcaaggccggctcgcagatcttctccgagggcggctcgattaccttggaaatcccaacctcgtccacgcgccgagcatccttgccgtgctgggcttccaggtccttctcatggggtcttgggtagaagggttccgcatcaatggtctcgacggtgtcgggcgagggcaacgacttctacccccggggccagtacttccgaccggtcggccttgccgacgaccctgtcaccttcgctgagctccaggtgacgggacatcaagaatggccgtctcgccatgttcacctatggaagggatccttcgtccagctactgtcaacggtagggtccattgcagaactgttcgacacatcgagacc

SEQ ID NO: 711768 - DNA, 146 bp, Homo sapiens
atagtcagctcggtaccaattgggtagggctggaccgaaatgctggtgctttcattggcggcacgtttgccagccaccaccgagactttctgccacagctcttccgtgatgaacgggatgatggggtgcgccacgcgcagcaccac

SEQ ID NO: 711769 - DNA, 144 bp, Homo sapiens
agtactgaaagttgtcggcagatcaaatctcgtatgggcgcaaccctgttcctctgcagctggctataggcgcagaagacaaattcaccggcgttatcgacctggtgaaaatgaaggcgatcaactggaacgaagaagacgcag

SEQ ID NO: 711770 - DNA, 350 bp, Homo sapiens
  misc_feature (52)..(52): n is a, c, g, or t
  misc_feature (86)..(86): n is a, c, g, or t
  misc_feature (114)..(114): n is a, c, g, or t
aatcgagctcggcccgctctcgtgagactgtccatgacaagcttactgccgnccatcgtgatcaacctcgaacaagattgagctcnaaaccccatcgagcaagagcgggtccgncgtttcggcaagggtcgttaatgtgctcgtcagcgcagagaccgtaatccaggattcccccccatgctcacgtgccaatgtcgatgctaaaagccgaacaccgcgtaccgggtcaacagccataagtgcactgaaccaggcgttcggcgcattgcgtgtctctctgccgtcggtatggttcctcactgctcgcacgagcggctgtaacttgatcaagccatcaagcgctgcggtgg

SEQ ID NO: 711771 - DNA, 978 bp, Homo sapiens
  misc_feature (902)..(902): n is a, c, g, or t
  misc_feature (978)..(978): n is a, c, g, or t
ggagagagagaactagtctcgagttttgtttattttttttttgggctctaaggggggtagagggggtgctatggggtacactcggggcccaatatcacaaagaatttctaaggggagaatgaagattgctagggaccgatggtggacttgtgaaatctgtgtgggtttggctaccacatagatattgcatgatgcttttgacctgtatgtataccctcgtggtccgtggtaacccggtgagacaacgtggtgtctggtgttgtaaatcgtgctcgcggagaaattcggctctcgtggtattgtatacagcgcctacattggttgggtggaacagcgtctcatgagattgtggcaagagatggtgttctagtgtgagactggtgtactggtctatataatccgcgagaagtgggggggtgtcttacaaacctcgtggacgagctattcctgactacagactttgtgtccaatgcgatacaagtcgaaatatctaccgcgaagcgctcacgcgcgagcgtgtactcataggcgaaaaacataatagcgtgggggcggcaaggtgtatgaagatcaaggcgcaagtgtcgaggaccaaaaacctaggtggctgctccgccccggaggaggaagcggaagggtgcccaaaccaccgggccaagtgtggcgacggccagagcaggcccccgggggaaacgtgggctgcgcaacgaatctggagactattgtcggcgatttggtgtgcaaactagaggtgtgtacggcgagcacaccataagggtcagcccctacgtgtcgttttggcatagcgccgaattagtggcgtcaaataacagtaggaggactcgttgcgtcttatagtgggcagatctagagtggcggcagagcgtcgcgagttaagcaanagtgggcatatagcctcattgttaacacctagggagaatagaggcgcatttgtcgaagaagagaaagaaccaatan

SEQ ID NO: 711772 - DNA, 547 bp, Homo sapiens
  misc_feature (522)..(522): n is a, c, g, or t
catagctgcaaccaaaggcgggcccatatgttcccgagggcaaaaacctttcccaggaaaggatttccaaggttggccccctttattaagttaattggcaaagggacaaaattttgggctgaacccttgtccaattcttacccggaaaccttttgcctcagcagaaaacggtataaatagcctgaaaatgtcttattacaaaatatcccaatgtatcagcgagaggttaggcatgtttaatggagttgtcggtaaacatggaaaaccacccgttcgcattgatcaccgcctgtaattccaacactttgttaggacgaactcacctgagatctcctaggtttggcacattcaagacccacccgggtgacatggtgaagcctcgtctctacaaatgagtatgtaaacattaaggaggagtggtggtgccctcatgtagtcacagctacttggaaggatgaggtgggaggatcgcattagaacatgtatgtggcggttgccatgacccaatattttgcctctgcnctcctttaagacagcaagactccgt

SEQ ID NO: 711773 - DNA, 506 bp, Homo sapiens
  misc_feature (291)..(291): n is a, c, g, or t
  misc_feature (497)..(497): n is a, c, g, or t
tgcctagatcctagccctaagggattgcataatcacaggtgtatcaattaggacccacactcttttgagatagggcagccaacccacagtggccctgagctctatgtagcagaggggggcgttaaacttttgatgttcttcttacctcatgagcacagaagttcatgaccacacctggtttatgtggtgctgggcattcaagtcaaggccctacgcatgctgggcaaacactttgccaactgaggtacatctgcagtccctttttgctttttatttgaagacaagtaattngcccagactggccttaaacctgccttagctttccaagtagctgggattattcggcctataacacaaggctatttgttttttgctttaaattttttttttaacttcttcagatggatgtctccctttcatcacctacaatgtttgcttcaaagctcttaaagtgtggatgctagagaatgatatctatttaagagaatcatgacatncaaatttga

SEQ ID NO: 711774 - DNA, 661 bp, Homo sapiens
  misc_feature (200)..(200): n is a, c, g, or t
cttgacgtccgggctgtgggcccgctttctgccgagatgccgaaggtcaagtcgggggccatcggcgcgccggggcggtggagcagcgccgggagctgaagagcgctggaggactcatgttcaacacggggattgtgcagacattttgaaaaatcctctcattataacagcattatcggataaggctgccttaagaccanatgatgtaggtgctggaagtttggaccgtgggaacgtggcaacattgactgtgtaaaggttggtagaaaagggcaaaaaggggtgtcgctggtgaaacttgacccaagggctagtaagctgaacttcacaaaagagttcaggcacgcctgtggccagcaaacttcaagtactggtgggtggatgtgctgacaacaagatttggccattcttgtgatacctggtgtgggcaaattggccttatcagatctctccgccttgtgtcttcaagcttgtgtgctacattcgacctttttccaggtgtgctatacttactgtctcacagagacttggcctccgatgtgttgcaaaactctggagatacgttaatactgggagactctcaatttaatacacagctgtgggcaccgtgtggacccattcttagttgaaaggtggggaaacggaaaataactttccaaga

SEQ ID NO: 711775 - DNA, 1065 bp, Homo sapiens
atggctgcggcgggtttaattcggagagggctggacctcctgtgacttccgagttgcgatgctgtacttctctttgtttgggcggcttcggctctgctgagatgtgggcgctggtcagtgatggccattcgggctcagcactgtaatgcagcccagactcagactggggaagcaaacagggtgctggacagtgccaggagatgcctgtctggacacgtgatcctgatgatgtgggagttgctgcagagggagaaggacggcagtgtcgtggcctggagctcattgcctcagagatactatgtggggagcagagtgtgttgtggatgaaattgagctgctgtgccagctgcctgtggccttgtgaagcctttgacctggatcctgcacagtgggtggagtcaatgtccagccctactccgtggtgtccccagccaacctggcctgtctacacagcccttctgcgacctcacgaccgtgatcatgggtgctggacctgtcccgatgggggccatctcaacccacggcatacatgtctgacgtcaagcggatatcagccacgtccatcttcttcgagtctatgccctataagctcaaccggctttagctgtgtgttgtgtctgtccagcccaaaaactgggctcatatgagctaacaaaccagctaggaaaactgaaactgctcggcagttttccaggccaaggctcatcattggctggtgaccagctgctatgctcgcgtcttgaactacgccccggcgttgagaagaaggtgtgtgactgaagtacaaatgcaaacctgcatgcagacattgggccaaaaatcaagtgggcctggtggcttgccaagttagattcccttcggcctttcaggacacagaggaacatacgtcccgacaactaatcaacatgaatcttcgaggtggcaggcaggggccatcaacctaacggaagaggggttaaggctgggaccaaagaagggccgagaacacaaaaaaatagagagcatatcaattgctagccaacatagagggagccaaaaaagacaaggagatgagcataaagagaa

SEQ ID NO: 711776 - DNA, 271 bp, Homo sapiens
tgatgactgggaccgcatttgtggactcagcgtctaacatgttttaattaacaaggctgggcatggtagctcacacctataatcccagcacttttgagaggccaaggtgggcggatcacttgaggtcaggagttccagaccaacctggccaacaggatgaaatcatgcctctataaaaaatacaaaaattagctgggcgtagtgacaggctcctgtaatcccagctacttgggaggctgaggaaggagaatcgcttgagtccacaattttg

SEQ ID NO: 711777 - DNA, 389 bp, Homo sapiens
atcggccatgctcgccggtacccccgagggcgctcaccagtgtccccaacatcgcgtcgccgtgatgctttccagacttgttaggaggggggctgaaggctcttctgcgaagtaaataagggcgccgcacacgcgggcgtttgcacatgcgggctgggtgtcgccccatacagaagtggactggcggtccgctggcatggaggaggaggaggtggtgactggcctcgacgcctctggcacggaccagtggggcctcggggatgcagtcgagaggccgactttggctcagaggaaacggatttctctagacattgaaagcggtcccaggagctggacaggccactttggaaatgaatgaactccaacctagaaggactctccttcttgcg

SEQ ID NO: 711778 - DNA, 883 bp, Homo sapiens
cagaagatcttccgagtgggattgagaggtgctcgctgtgcatgggaggtgtttatatggggtgagtcatcgacacgagtggcgtgtctccgtgtgccgctctttctgggacgttggtttccaggtggccctgtggccacattactgttgcgcggggtaaaaacttcgggccggtgggataatctcgagccagggggaggcgccctctagaaagtgccggggagggcacctccaccggggcctgccgggaaggttctttcgtggttcgtggcccatctcgttgtcggcgaaagaaaccccctttatgttgtgggagaaaaaagttcttaacaccaatctgggcaagacgggtaacctattaactggggcctctctaagacgtgggtttgtgccccctccacggtgcgcgaaaaaggaatgtagtactataaccaggggtgtgcacgggtgtggaagacaaggcaccgctttgtggacatgagccctcacccgcacacgactgcagtgtaggtcgatgccccttttcatgagcaccccatgaaggagtctgttctttccaaaagaccctgggggttagcatttcccccgcagagatagaggaactggagaaaaacccaactgggcggggctattctcttgcgcgcgagtcccacaatgctctccgcccgctacaagccgctttatgacccttctcggagctcttacggcctcctgccccctgggtagccgctcccctctttgcaccacacttcaggggggcgactacatacattgcgggaaaacataaagtgcggggacatgtctttgcaaaaacagcgggggtcccgggaaacccccttcataaacttctccgaaaaagaaaaaaaacaattcgtccaacaag

SEQ ID NO: 711779 - DNA, 229 bp, Homo sapiens
ggtaagatgttttcatcatccagagcggctgcggggaaattaacgaggacctgatggaactcctcatcatgaccaatacctgcaagattgtgttatcatccagagttactgccgtgatcccgtgtttcccatacgctcgacaagataaaaaggacatgagtcgtgccccaatttctgcaaaacttgtggccaatatgctgtcggtggctggggcggatcacatcatcac

SEQ ID NO: 711780 - DNA, 252 bp, Homo sapiens
acatgggcccaataccttgaagtgcgcaattccatccgctacaacggactgatatcaccgcaagactgtgggctgtggagccggcagccgacggcaacggtgtctgtgtgtgtgtcattaagcggagatccggccagcggaagcctgacaactcctatgtgcggaccaccatcaacaagaatgctcgcgccacgctcagcagcatcagacacatgctcctgcaagaacaagtaccgccaccgacctgcgcat

SEQ ID NO: 711781 - DNA, 183 bp, Homo sapiens
agtggatctagaggatcccggcagagcatccttacatcatatttcttcgattttttagatcgtttttggtttaaaatctcttcttcctcaggagtcagctgggctcccttctggcggcccaggggcagcgctatagtgggggactcgataccacgtgtgcggtaccggtgtgctggtcgactg

SEQ ID NO: 711782 - DNA, 151 bp, Homo sapiens
cacgatgcttaatggtcgagtcgagacggcatggtaacgcggagaacccgtctctactaaaggtgcaaagattaggcagccgtggtggtgcgcacctgtggtcccagctactcgggaggctgaggcgggagaatcgcttgaacccatggag

SEQ ID NO: 711783 - DNA, 145 bp, Homo sapiens
  misc_feature (42)..(42): n is a, c, g, or t
ataaccaattaataatgattactgataagtgtatactaaggnttatatcggaattataggggtttcacataattttggaacatgtaccaataacacatttataatgaacagattaatgctttaataaagttctgttgtactatta

SEQ ID NO: 711784 - DNA, 467 bp, Homo sapiens
  misc_feature (428)..(429): n is a, c, g, or t
  misc_feature (447)..(447): n is a, c, g, or t
actactaaaacctaataaccgccacggccctaaggggtggcctaataggctgtttgctagatattgagtgaggtggatagctacccgggtaagggccgtcgcccttgtgttgctacatattataaatacttggaacaactttcaaactacacaacggtaaacagagcggtatgactgatgcgtatttaatgtaggactaaaaactgacttaatactatttcgcatttacctacttatactgtgatttcacggtgtaaacacttacaaaatagaccaacaccgcggaagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711785 - DNA, 396 bp, Homo sapiens
  misc_feature (357)..(358): n is a, c, g, or t
  misc_feature (376)..(376): n is a, c, g, or t
atttttatatagcgtacgccggtagcggtggtctgactacccagcgatgaatccgtgttgctggtggcggtaatagtactgctagggcggatgataatttggattgagataattacaaaaataatgcgtgatattaatggctggtgacgcgagccgagcggtacaaattgaatgttggaaggaaaaaaacagctacggatgcgttataacggacttacattattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711786 - DNA, 177 bp, Homo sapiens
gagaacgagtatctgtgcctgctcgtgaggatgtgctctaggagtaatctgtctactccacctgagggataaagggcagctacttactctcctgctacgcttactgttaaagaggaagagtttacactagtcaatctctaacatttgagggagatgatttgcggttgatacaataat

SEQ ID NO: 711787 - DNA, 103 bp, Homo sapiens
catgatcttcaagtactggctccggtctctgacctggggtccctgtcttctcccaatgctccctgattatgctctccagcctccggtactcggtctccaggct

SEQ ID NO: 711788 - DNA, 474 bp, Homo sapiens
  misc_feature (435)..(436): n is a, c, g, or t
  misc_feature (454)..(454): n is a, c, g, or t
gtctctagtggagagccgttttattgggagccaaaactaataccacggataaccatgaacccaagcagagtagtacatagaggagaaaattgaaacagaagaagagaaccccggggtgaaaaaagatgaaaatagaaggcggggaccggggtaagggagaacacaagggggaccgggagagacaacagaaactgaagaagggttttaaactgcgatagggcatatgcccaattgtagaagcaccaagggcagtacggaggacatacccatagaaattgatacaggggaggcggagaaacaagctctcactacatccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711789 - DNA, 360 bp, Homo sapiens
  misc_feature (322)..(322): n is a, c, g, or t
cacgaggaggaacagggggtcccacggggaatcggccacgccgggcgtggcgtgcctggacggctccagcggcagcgtcaccgtctcgtcgttgcgccgctcgcccagcatcacggccggatcgaacgaataggcgatatggtcgatgtcggccagcgtgatgccggcctccttcaggcagtagtcgatcgcatggtagggcagctcccaggccgtgaacggcaccggccgcttgccgtgcttgatatgcgtgaaccgttcgtcctcggccgcggcgatgacctcgccgtcgcgcaccaggcaggcggaggtgtcgtgatangcggcgttgattccaagcgtgtacatggcggctcctca

SEQ ID NO: 711790 - DNA, 379 bp, Homo sapiens
  misc_feature (194)..(194): n is a, c, g, or t
  misc_feature (197)..(197): n is a, c, g, or t
  misc_feature (211)..(211): n is a, c, g, or t
  misc_feature (233)..(233): n is a, c, g, or t
  misc_feature (252)..(252): n is a, c, g, or t
  misc_feature (285)..(285): n is a, c, g, or t
  misc_feature (315)..(315): n is a, c, g, or t
  misc_feature (354)..(355): n is a, c, g, or t
tccctcctgattttaaaatgtttcaagggcaatgccccctcccctcctttaccgaggacagcctgcctttgccacagcaaggctgtcggggtcaagctggaaaggccaacagccttccagtggcttctcccaccactcttgggggcccaaatatatttaatggttaagggacttgtcccaagtttgacagccanagngttaaaggggccancggccctcccaggcgattttgngtttactttaggactgggnccgagggtggtttacctgccccgttgactcagnatagtttaaaaatttgccccctgcacaggnatttttgaaagcaaaataaggtttttttttttccccttnnttgtaataaatgataaaattccga

SEQ ID NO: 711791 - DNA, 399 bp, Homo sapiens
  misc_feature (360)..(361): n is a, c, g, or t
  misc_feature (379)..(379): n is a, c, g, or t
acgcacaaccgcaggtaactagccaaccccggcaatattaccgaggagattagcggcgcacaagattggtgaaccaattgaagtaatagacatgcagaaagcaaagtgttggatgggacagccaagccatagaatgtgagcatttgagaaataggcgcctaaacaaacaattaaaagaataaaaaatataggttaacataatgacaaaagaaatgaaggcaacgattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711792 - DNA, 416 bp, Homo sapiens
  misc_feature (377)..(378): n is a, c, g, or t
  misc_feature (396)..(396): n is a, c, g, or t
cgtaccgtactccctacacaagtacggttaaagttggacccctgtatgccgacctacgcgtacctgtagccagtgaaacgtgcctgcgctttgcttgtagttaactactagggaacggtaccgatgagaataactaaacaggactgcaggaaacgtcatggagatggccaaatattttgaaatgcccgcttaaactattattgcccgctgacgcggcctgtgattgccgccaccgacaacaagctctcactacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711793 - DNA, 145 bp, Homo sapiens
gcacactttgagtctctgtatgaagctgaaggtcttcattccagaaatggttctccctttctcagaactcttctgaagagagactttagatgaaagcaaatgattcagctcccttttacccccattaaattcactttcagttcca

SEQ ID NO: 711794 - DNA, 277 bp, Homo sapiens
  misc_feature (42)..(42): n is a, c, g, or t
  misc_feature (44)..(44): n is a, c, g, or t
  misc_feature (238)..(239): n is a, c, g, or t
  misc_feature (257)..(257): n is a, c, g, or t
gtgataagagtttgtgtcacggagtatgaccgccagcactanantaagagtacaggggaccacggtaacacagctaagcgtaccagcacgcaaaaggccacaccccaccagagcttaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711795 - DNA, 191 bp, Homo sapiens
  misc_feature (45)..(45): n is a, c, g, or t
ttttttttgggggaaaaacccccccttggggggggcccccaaaantgtcctttttaaccccaggggggggccgggggggggttttccccccttttttcccccccctttggggggccggggggggggggtccccctgggttcaaggtttcaccccccccgggccccccgggggggcccccttttttttttta

SEQ ID NO: 711796 - DNA, 406 bp, Homo sapiens
  misc_feature (367)..(368): n is a, c, g, or t
  misc_feature (386)..(386): n is a, c, g, or t
agcacgagaacgtgagtatgaggatattgctcacgggtgataccgaggagaccaccccaatgattaaaggcagattatgaagacaggaacgaaaaatcaaggaatacttaaagaggagaggggaataagtaggaaagggtgagctaagtgaataatttaaggacgaattaagaaataagaagagaagccataggcagtaatgcgttgcgcaaggccttaatatatggcgccgaggattttatagtaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711797 - DNA, 314 bp, Homo sapiens
  misc_feature (275)..(276): n is a, c, g, or t
  misc_feature (294)..(294): n is a, c, g, or t
atccatttccgagcgatgtgtagtgatatggggaagacaacttggtaaggaaaacactgaaacacatgcggacaaagcaaagtggccaaccccctatataaactaatcgcggcagggttaagagttgaaaaaaagaacaagctctcactacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711798 - DNA, 377 bp, Homo sapiens
  misc_feature (338)..(339): n is a, c, g, or t
  misc_feature (357)..(357): n is a, c, g, or t
ctcctgtcgccagtgccacgcgcccgcgccgggggcagggggcgtaactaatatcggtccagaggtagagacaagctgcgcgaagggtgcgtataaggtaagccaaaagaaacagggagatttgggaggtaagtgggaacaagctgcccgcgtaaagaaatagaaacgtggtatgtctgtgtgtggaatttcgcaagaaaacattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711799 - DNA, 392 bp, Homo sapiens
  misc_feature (353)..(354): n is a, c, g, or t
  misc_feature (372)..(372): n is a, c, g, or t
ctcttataagcgtacgccgcagcgcgtgacctcccggccgacgtgcgggggggcggcagactgagtgtgtacagggccacccggcacgagtgaggtaggtgggacgaggggatgagatgggtggagaaggcataaaaattagagctaatgcgggcggagaaatggtaggaacccatgtaccggggtggaggaaaagagagctgaatacgagggagccattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711800 - DNA, 451 bp, Homo sapiens
atctgcaatatgtttgcttatactgttgcaagcatttctaaaactaactctcttcaacattgaaagtaaattgtttgctgtctattatttttcgcatgctcatctatgcgtatattggcattcaatgaaaaaataactaggttgtatttttgccaagaaatgatagtttctttttatttctaaacaggcatgtttcatgtttttcaacaaactcaaacctggcttatgttctacagaaatgagctttctggttgtatttcttcctttattaaatggttgttttttgttttattaatggcttgtaaaaacagatgtttttaaatacagatgttccaaactaagaaaaaatacaaattcagaaaaatgataatggtcaacatttgttttctgtacttattccaatattttttgtttagtctgttgcctttgtcaataaaattgtcaaaaatga

SEQ ID NO: 711801 - DNA, 643 bp, Homo sapiens
acttacaaggggatactaaactctcacggccagtgctgggcttattgccttgtcagggaatttctccattcaagggttttatgtttggaggatgtgctggccctatttttttgtctgtttgttttttgagacggagtctggctctgtctcccaggctggagtgcagtggtacgatctcggctcactgcaacctccgcctcccaggttcaaacgattctcctgcctcagccgccgatagtagctgcgataacaggctgccgcgccaccacacccagctactttgcatatatatttagtagacacggggtttcaccgtgtaagccaccgatctcctgacctcgtgatcctggccacgctcggacttcccaaagtctctgaggattacaggcgtgagccaccgtgctcaggccgcatggcatctagtatatcaccgactagcatttgagatccctttcttccccgaaggcaatacagaggcctccagggcaagccgtgcgagaaccggatggcgacaggatcgtaggataatgacgccaaagaccgatagcagtactcggaatcgcgcctggagcatcagtcgcgtgaacagcacaagtgtccgacggagcggaggcaaaggatcctggaccaagccccgacgacc

SEQ ID NO: 711802 - DNA, 304 bp, Homo sapiens
ggaaatcaggcttgggtgcagtggctcacaccgtgaaatctcagcactttaggaggctgaggcgggtggatcacttgagcccaggagtttgagaccagcttgggcaatagtatagtgagacctcgtctctactaaaaacaaaacaaaacgaaaaacaacaacaacaaaattagccggacaagcgcctgtgatcccagctacttgggaggctgaggtgggaggatcgcttgagatggtcaaggctacggtgagttgtgatggcaccactgcactccagcctggatgtgagcaagaccctgtcttg

SEQ ID NO: 711803 - DNA, 299 bp, Homo sapiens
tcgcatgggtgtaacatgagaagtatgacaacagctcaagatatcagcaatgcctctgacagcaatgcttagaccctggccaaggtcatccatgacaactttggtatcgtggaaggactcatgacacagtcatgcatcacttggcacccagaagactggggatggccctccgtgaaactgtgcgtgatggcgcggggtctccaggaacaattcatccctggcctctactggcggcttgcaagggctgtgggcaaggtcatccctgaagcttgaaccgggaagctcaactggcattggcc

SEQ ID NO: 711804 - DNA, 169 bp, Homo sapiens
ggctctagagggggtagagggggtgcagtgggcgagaatccttgcatttggccgggcgtgatggccacacctgtaatccaagccctttgggaggccaagaagggaggattgcttgatgccggaagttagaagtcagccaagataacgtagggagacctcctgtctctac

SEQ ID NO: 711805 - DNA, 208 bp, Homo sapiens
gccccaaggcaaaaaggtcctcacagaggacaagggcctccagcgccaaaaccgttttaacggccaaggggttgggtttggttcaaacctgcaaaaaaagctgggcaagcaaaagtatttcctggggggtgcgggggccattggctgggagctgctcaagaactttgccatgattgggctgggctgcggggagggtggagaaatcatc

SEQ ID NO: 711806 - DNA, 137 bp, Homo sapiens
atgaagaacagccgagcggacgagggacagccagaagtagcttgtatctggaatgacaagaatgttcgaacacgagggaaacaccgaaaacacgggcaagagagttgaggaaccgttaaaggataaagaaaagccag

SEQ ID NO: 711807 - DNA, 177 bp, Homo sapiens
catgaagtatcacctggcagagatttcccgggctgtgcgtcacacaggtagacactgagatggttggatgtgcacaactctgcctgcgtgggtgtctgtctgaggctgcgccacattggggggccccacagtgccacgctgtgcccacaggccccatgttgctgccccgggggaggc

SEQ ID NO: 711808 - DNA, 168 bp, Homo sapiens
  misc_feature (168)..(168): n is a, c, g, or t
aaatcctgttacttccattggtcttcccaatttaggtctttaggtgcaagaatctgaattgattaaaactagtgtattggatccttggggttaattggtatggttctaacgtttaggtgtaaggaatttgggtaggggttatatagtttggttacggaactgggtggn

SEQ ID NO: 711809 - DNA, 1126 bp, Homo sapiens
gcttgctagcgggcgtgtgcagacgggcggcgaccgctgtcggcgctactcgtgcttgctcgtatgcgcgcgcttgctgttggggcagttccacgcgctcgtcgtgagctaccctgcgttgtgtgtgcgcagcccccactgctgtgtggctcgcccgcccgcgccagtctgccacgagcttcccgcctgtggccaggttgcgcgccgctattcgcgcgggttcggcagccgttccgacggggccctccgacctctctatgagctcctttacgggctttagtgggcctccccaggcggttttccgggtgtgcgccgcgcggctttgccgcggcctcccggcaataggatgttcccccgcttcttggagaccctgcttacgtggaagagatccctgggggaagactcccttgctttcttgtaagtgcggagttcatgaggagaacgtattgcgtacccccagaagaaggtggtcgtccccgcgcaacatgggtggcggagagaggtgcgcatccagaagggccaccccccgatggcaaggggagaccctggtattatggcccctttgggaagaggatgaaccatttcccagaagtgatccagtacctgggccgcccacgtgggacacccgtgtcccccgcggcaccttcagcttccgttccccgtatgcctcttggagattttctttgaaggaagagaccaccgccccgagggcttcccatgggtcccgcttctccgcccgaggagatcccctcgaggattccggccattactggccaaacggggtcgacctcgaaaccctgagaaggcttagactaaggaagtcccccaggtgaaacggggtcgaggtcggcccacctaaggtccaaaatcccttgagcttattggaccagaccagacctcccgccccctctaagagaacttggaggccccaagaaacctttgaatgatggaggattaacgccaagagttgctataaagccaagaagaagattgaggccagaaggttcaaccggggagagttgtccagactactatccacagggccaggcccagaaattagccggaaaccagagacccagagctttaagcagaaggaagcttagaagaaatcccaggcttagaaaga

SEQ ID NO: 711810 - DNA, 671 bp, Homo sapiens
cctcagatgagtttggccaacagcctactgggcccacttcctttaccaatcagatttaacagagctgcatttgcattcttctgcagtcggctcaccatcttccatttcagtggcagaagaattttttaagggtttcaatcacttattaatgcagagagtattgaatgtaaatcagcgctctctagtcttcattaaggcagcgacgtctgggttgtgaaaaatgatacttagagatgaggcgacatgaggcgagatattattcatcatagatggctaattggagagtaccttgctatatatacagatactttcatggacattctgtatgtatgctaaacgagtacgagtattttgcagcttaaagtctctagtatgtaagatgcataaagtcaatctaatagcgttgagttttgttatgcattatgatcgtgaagatgttataacaatttctagaagacaccttggtgtatcacagcatgcatgtcttatattttttagtattaaggcctataggactatgggtctctatgttatttggttcacttattcttttcttatgtgatacaacatatgatttaagggcatgaataagcatctttccacacaatggacatttggactgtggttatggtttctggttcgaacactgatttgtcagacggtatttttgg

SEQ ID NO: 711811 - DNA, 249 bp, Homo sapiens
gagctgctctagagggtaaactgacgccgagaaacccaactcaacaccatttcaggataaacacatttaataaacagagataaaagaaaaacttccttaacacaataaaggtcatatatgaagaacacacagctaacaaaatactcagttgcgaaagactgaaagctttttccctaagatcaaaaacaaaacaaggccagacacagtggctcacacttataatcccagcacttctggaagcaaacatag

SEQ ID NO: 711812 - DNA, 142 bp, Homo sapiens
  misc_feature (135)..(135): n is a, c, g, or t
tttttttttttaaacagggttttgctctgttgctcaggctggtgtgcagtggcatatcatggctcatggcagccttcactgcctgggctcagccatcctcctgcgtcaacaaccccacaacccccagagtagctngggacta

SEQ ID NO: 711813 - DNA, 622 bp, Homo sapiens
aaagttggcagtcaaagattccctcgaatcctcgtgctccatctgaatcgattttttgcctcccgaggctccatcaaaaaagttcagtaggtgtagactctcccctgcagcgactgagcctaggggactttgccagtgacaaagccggaagtcctgtataccagctgtatgccctttgcaaccactcaggcagcgtccactatggcccctacccagccctgtgccggtgccagactggttggcatgtttacaatgacttttgtgtttcccctgtcagtgaaaaccaggtggcatccagcgaggggtacgtgctgtttttccaactgatgcaggagcccccccggtgcctgtgacccctttaagctttggcacctgtgaagcccttttaacacccttaagccccaggctccccgttttcctcaaagacgtttatttttgtgtctttttaatcggggaggggggagggggtggttgtagctcccttattttttttattaaaaaaaacccttccccctggagggtcccttgtttcccagccccatgtacaaagctccccaagcccctgcccatgtacagcccccagaccctttgcaatatccctttttgtgaattaattttttta

SEQ ID NO: 711814 - DNA, 80 bp, Homo sapiens
ttcaagcttctaacgatgtacggggacatgtctgcaatgaagagatttattaaattgtaaacattaaagtggtcaaaaaa

SEQ ID NO: 711815 - DNA, 467 bp, Homo sapiens
ccgttgcatccaatagtgagatggtgcatgaaaccttgtaatccaaatattttggtgtgaaaaaagggataaagagactttgcctacacggaaaattgggataaagtgaatactaatataaaaggaagaggaaaagataaaggcatgaaatatattataactgaaaaggaggggctgcaaggcgcggctgtagtggtataaatggagaaaactactaagcacaatatacgcttgccaccgacttatataattattgactgattaaatattgttatttgccggaccttgccacattttgtacctattacccttgccgcctgattggccaatacacggctactacggccgcttacataaacaaacactactagacgagaggggaaagaaaatatatgcaataccgcctacccggcaatggcgatggccacttcttcacaattgaaaataccacggccattggatatact

SEQ ID NO: 711816 - DNA, 394 bp, Homo sapiens
  misc_feature (355)..(356): n is a, c, g, or t
  misc_feature (374)..(374): n is a, c, g, or t
tgacgcttggcactccatgatacatgttgcacgtgcacgcccccttgacacggagtttaatgtatgcgcgttgggtcacgttttgggcgccgacaagaatgccgccatacactgcgtgaggaggcggagctatcagaaagaacacaataagtacacacatgcctgtatacatgatatgaaaggtaaagtggatgattacagcccagcgagtagaagaagattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711817 - DNA, 381 bp, Homo sapiens
gtagagagatcgcccacgccccgacgaggactagatctctgaatgtatacagtgttaaaaaccatctgccttcctgtgaaccggggcagatacaagatggaccacaacttgcagactaactttttcaatttccaatgtacctgctttaacacacaggggagttagtttcaacagtgctattttcaatgcattcattatttcaaaacttactggaatatttgacgattacttgctgcaagctggactcatgtgaaaataaaccttgacttcacagagaagtctacattgataaatatatatccgttgaattaataacagtgtaagcctcacatatgtatacaaaaagtaaaatgacaaggacgagaggagtttttcatggaa

SEQ ID NO: 711818 - DNA, 121 bp, Homo sapiens
  misc_feature (1)..(1): n is a, c, g, or t
nagaccacattagaaaggcaacatccagctctgagcggatttaggggcggaatggggctggaatcttcctggcagacagagccaaccaatcgaggccctggaagaagggatggtaccagga

SEQ ID NO: 711819 - DNA, 383 bp, Homo sapiens
  misc_feature (344)..(345): n is a, c, g, or t
  misc_feature (363)..(363): n is a, c, g, or t
gagtcgtccgtgctgtctctaggtggatacagatacagatgagggtaaataaattatataagaaagataaatgcgacaaagtgcaacgtgactgggaaatgcaacattatttgttggtgccacgctgtgaaacaaataaaaaacggaacaggaggaggtgaaaaataataggccgcataaggaaatagagcatgttgccggtacaacaagctctcactacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711820 - DNA, 110 bp, Homo sapiens
cagggatcacagaagtagagttgaggtgtctggtcacagtcgcgcttccgcacttgaggcagatgggacatggtctgctctgcgtagtcgtatgcagaagccgctgcccc

SEQ ID NO: 711821 - DNA, 360 bp, Homo sapiens
  misc_feature (321)..(322): n is a, c, g, or t
  misc_feature (340)..(340): n is a, c, g, or t
aaagcgtacgccgacgtacaacatagctatgcgtgatattatacaaccagtgttgcgatatgattatatatgttagtaaggcgcacatgtatagctggaatatatttaattatttgtgaagatggagaaattaaaaaggtaccgatgaataacatgcggggtgggtgactagaagatattatgatattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711822 - DNA, 349 bp, Homo sapiens
  misc_feature (310)..(311): n is a, c, g, or t
  misc_feature (329)..(329): n is a, c, g, or t
acaatgcgatggcattacacgctcgtacgatttgtgacccgcaagtggtagacagtgcgacgcacgtctaacggtttggctaattatctgcttatattagttatataaatttcagcgcgaaccagacgtggcggtacgccagcgtggggttagctaaaaaccacttggtgctgcacctgtttatacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711823 - DNA, 358 bp, Homo sapiens
  misc_feature (319)..(320): n is a, c, g, or t
  misc_feature (338)..(338): n is a, c, g, or t
gtcccacatctataataagctacaataagccagctatcataccaaatcccccataagctaaacctatattaactgggcaagaaatagcaaggaatgaagactgcggccagagccccaagcattaactagagaagactaacctagaggaaaaatgataaatttaactccagtagagatagaactcttgcccaccagatgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711824 - DNA, 399 bp, Homo sapiens
  misc_feature (360)..(361): n is a, c, g, or t
  misc_feature (379)..(379): n is a, c, g, or t
aaagcgtacgccgccgatatacagttatagatgtgagacccggcgcgggtaataacggggtggatggagtgcggcccgggtaagccaactgatgcagaaaacggcatttgggactggaccccgaggtttgggtggaaactaaaggcctgcagggtggaaagcctatggtgatgcaacgcggtgtgcagcaagtataagggggggggaataggggtgttaaagcgattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711825 - DNA, 351 bp, Homo sapiens
tggatctccagttttccaatacattatgctaagtgaaagaagccaaactcagaaggccacatactaagtgagtctcttcatatgatattctagaaatatccaaaaacctgtatggaaacagatcagtggtggccaggggctgggggtgaggggattaggttttgacttcgaagggacacaagggaactttgggagtagtgggaaacttatgtatcttgattatgatggtggttacgtgactgtgggtgtttctagctgcacagaactgcaaaaatttgatttatccataaaattggatacattttactgtatgcaaattttacttcaataaatctaaaaaatataaaacac

SEQ ID NO: 711826 - DNA, 362 bp, Homo sapiens
  misc_feature (323)..(324): n is a, c, g, or t
  misc_feature (342)..(342): n is a, c, g, or t
aggctatcctgttgggatgcttggctgcatgagatgcaagggatgacggataataaaatgaaagctgtgcaaaatggcacatgattgagaacaccagtgagaaggcgtaatgaattaaaaagaacttgggaggagaattgaacacagctagaagttgtgaaaagaaagtctgcatgatgctagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711827 - DNA, 424 bp, Homo sapiens
tgtgttgcaacaagagtgaaacgctcgtctcgtaaaataaaaaaaaagtccgggcttgactggctcacacctgtaatcccagcactttgggaggccaagacgggtggatcacgaggtcaggagttcaagaccagcctggcctagatggtgaagccctgtctctactaaaactacaaatattggctgggcactggtggcatgcacctgtaatctcagctactcagaagtctgatgcaggagaattgctaaaacccaggagggagaggttgcagtgagccgagattgcaccactgcactctagcctgggcgacagagcaagactccgtctcgaaagaaagaaagaaagacaggaaattccccaggaaagtacctcggctgatttcataaacaggtaccgaagaaagcagaggcatgtggcggactt

SEQ ID NO: 711828 - DNA, 1582 bp, Homo sapiens
gggcccgggggccctggatggccctgggatggggaaccgcggatggcttccgcggaggtttcggcagtggcatcctggggcctggggtcgctggcctgtggacgtgggccgtgggcctgaggcctgcggagctacgcggagtgcaatggcctgaggataaggagtggatgcccagtacaccaagttgggccgcattggatcaaggcaccatgaagcatcacagtccactggacaggcagatctcatcgtcatatcatcccgtgccatatataaggcaatccagcagcatccattgcatttacttccatgggagagccatcatctcaaagtgattgcagagttatacgcacagcattcattgcccagattgcagcacagccagcaccccgtagcacgtgcccaagctgcacccagtgcttccaaagtgccatacttcgtctagcataatcagagagagcactcacgaatgggcacaacgatcagagaatcttggggtgcgttacaagttgcatcccgacatggaacgggtagtgcacaagcacagacagatctcactgatgaggggcacaatacaatatcctggtgaccaaagacgtccttcacaatcagtacacacccggatgactggccatgcacgggcttaaccatggagggggaaaccacaagaacttcaggcgcaaaatggacacacagcaaacaaacttggtgcacccttattggaccaaacgggtagcaccatggggcaccagacatagacagacggctactttggttagccatatggagattaacaggcacgctacaaataacacacgttggcgacaacccacacaagggggggagccacataggagcacgactacaggtacattaacacgggtgaacctatggttgggccgccctcacacagacaacggcagtgggccgtaccaattggacaatgacgccgttgaggagctatttcagcacttggaaacttggcgtaagacaacgcattacaaagaaccaccagggggggcgcttaggcacgactaagggaccaaaacacacacttggtgagtggaccacacctcttaacagacaccacaagtgagggcaccacaacacttaaatggaaattgcgaccaagttataccttcaaaagagaaagccgttaacacaggagttaaacgcttgaagacacccccgccaggacccaatcaatgggacaacaggaaagaacctaggtttttccaccgcaactcgttctctcccgcattaatcccacgggcaaggatctccgccgagagacccacacagtactgacgaaaacgaacccaaaacaacactaggaaagggtcaccccagagcagcagacggggaaacacaccaggcgcacccccgaagatgcgaggcggaacaacaacgaaacggagggttctaactaaccaaagacaaacgacaacgacggcgacatcaacgggctacaacaacaagacacaacaaaggacgggcacgcatccacaagaaaccaacaagaggacacaggcagaaaacgatcccaaacgatatagacaacagggcgactcaagcaacggacgaa

SEQ ID NO: 711829 - DNA, 356 bp, Homo sapiens
  misc_feature (317)..(318): n is a, c, g, or t
  misc_feature (336)..(336): n is a, c, g, or t
atagttgaccagtaataagctggtgagggaccaagcattggataggtaaggaaattgaatacacaaagggggaggactagcaggtgggaaatgcggcagtattaatgcggggctagtgggggtactgactgacaactggtgcgagccggcgctaataaatcagaaaatgggagaaatgtgaaatgacaaaatgggaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711830 - DNA, 144 bp, Homo sapiens
tgggtcgctagggagaatagtagtgaggatgtacgtccgtggcgcgcatatgataatgactgcgccgatgaagctggtaggggtctggattagaatggctgtgactacgagggctatgggggtgattgagggaagcgtcgcgca

SEQ ID NO: 711831 - DNA, 369 bp, Homo sapiens
  misc_feature (330)..(331): n is a, c, g, or t
  misc_feature (349)..(349): n is a, c, g, or t
ctatctagttggagtcaaaggactcgagcgggttggctgccctgtcgcaaccagaaatagcggggaagagtatggcaacgcaatcgagggcagaaaccttgaaagggacggagaaaggggcgagggcggaaatagcacctgcgttcaaaggttccactacgtaaagacgaccctaaaccgtagtgactaaagcaaagatgagacccgtgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711832 - DNA, 399 bp, Homo sapiens
tcggatatccccaaatacagaggtacccacgggtattcagtacatttttaatgttctctcccccacagacaactgaggttaagtggtgattggcttaagtgacagtcaccgcttcatgatgttgagagtagtgcctctcatattcaattccggggtccggtaggaagttagaagtggggatttctattgtgtgctaaccagcagtgtctgtctttaagacaggcttgagaactatgcttttatgagtcatacacgagttttattttgtggaaaggaatctgggtgttgaatggtgtgttggtgaccgttttcaactgtggtaatgaggcagtgagtggatttacagaaaagaaatccaataatttgttcttccgtgttgaagaggatactgaaactttc

SEQ ID NO: 711833 - DNA, 915 bp, Homo sapiens
taacggtctagctccccctcagtgtgctcttacagcctgtaccaagtgtggcttaatccgtcggcaccaccagatctttctccgtgagattcctcatgactaagaccgactggccatgcacagatagacggtaacccgctactcaccgatcgacaacctaccacaacgatcatcttctggtgccatggggtcccacctatgaatccgtggaggtcaccactcgggcctctgtacacgagccccgtggtgtctccttcgtgcttgctgcagcttggatgtcatacctgcgtggccttctcgctggtggctaagcgtgggcagcctggacgagggtccatgggcaactggtccatgttcacctggtgcttcgtgcttcgtccgtgacccttgatcatcctcatcgtggagctgtgcgggctccaggcccgcttaccccctgtacttggcgcaaattccccatcagccttcgccttgctatagcggtccctcttactagcctctacggacctccagtcatctaccccagcacctatgtaccagtatcctgtagccacggacacgatcgcggagaccacgccatcgccaggcaacttcttctcctgcatcgcgtgtgtggcttacgccaccgaagtggactggagccgggcccaggccggtgagatcactggctatatggacaccgtacccgggctgctgaaggtgctggagaccttcggatgcctgcatcatctatcgcggttcaatcatgtgacacccaagcttgtaccatggcaacaagacgagcccctggacgtgggttacggtgcgaaggaaatacggccatatgcgttcaatcctaaacggtcaacatcgcaaaccattgctgaaaactgaaaggaattggaccaaagttgctcacagaatcaccttcaccag

SEQ ID NO: 711834 - DNA, 543 bp, Homo sapiens
  misc_feature (465)..(465): n is a, c, g, or t
gcccttccaaagctcacaggccatgcaggtgagctttgaggacagtctccccagggcatttgggttgatgtgagcagctgagggaaaagggatgggcattgagcagcctaatcttcttgaggggaacagaagcacagatgaaatatggggtgaggagtaaggctagggagtaggcaggcccacagtatggagggcctggaatgcccctactgaagcatctggtttccaacctgagggcataggggaacctctgaagggtctgcaccttcccaagattaatcagccggacaacagtgtagagaagtaggcactactgggccttatctggatgcctgccgtggactagccactgggcttagcacacaacggccctagacagtggagagtgttgttatctctactttacgggtgagaaaactggaactcagcgtggtttaggaatttgcccaagttctcacagataanaagtggcagagctcagagctcagaggtcgacgcggccgtgaatttagtagtagtagtcgacccgtgaattccggaccg

SEQ ID NO: 711835 - DNA, 138 bp, Homo sapiens
gacagctctctctgtggggctcatttctgagggcagcttccaggaatgctcagctcccggagtcagtcactggacatcatggccgtgggcaacatgaggtactgtgtgcgtcccctgtggacacaccattgttctgtc

SEQ ID NO: 711836 - DNA, 271 bp, Homo sapiens
cacgaggaattgacaggttatcaactgacaggcatgaattggttggccaatctatatgaacagggtattaatggcattcttgctgatgaaatggcccttggcaaaacagtacagagcattgcccttctggcccatctggctgagagagagaacatttggggacctgtcgtaataatttcacctgcgtcgacacttaacaattggcaccaggagtttaccacatttgttcctaaatttaaggtgctaccatactggagaaaccctcacgata

SEQ ID NO: 711837 - DNA, 502 bp, Homo sapiens
  misc_feature (2)..(2): n is a, c, g, or t
  misc_feature (56)..(57): n is a, c, g, or t
  misc_feature (100)..(100): n is a, c, g, or t
  misc_feature (222)..(222): n is a, c, g, or t
  misc_feature (247)..(247): n is a, c, g, or t
  misc_feature (341)..(341): n is a, c, g, or t
  misc_feature (379)..(379): n is a, c, g, or t
  misc_feature (381)..(381): n is a, c, g, or t
cncccccaccacaaaggtagggttcggggagtttataaaaaactgttagtaccgcnnattgccggacgcccccccctttttctcccataaacaccggggncgcatccctccgtttatccagccggggggataattttttcccggagacattttttctttgctttaggccccattaaaacattttttaaaaaaaagggtgtcggtccgattccgggatttttnccaccccgcggcccgtgtggatccngggggcccctttttctaatagaacttccgtggacaaaacagggcagcagggaaagtttttttctgtccgtatgatagggtttggcccaaccccnaacacgaaagaccttttcctgtcccgggtaattagttngncggccggcaaaccccccctccccggggtttttgggttggccgaggaaggttgggacggaccccgttttaaaactttcccgggccccaggatggaaataaaacccccccccctgccctggga

SEQ ID NO: 711838 - DNA, 360 bp, Homo sapiens
  misc_feature (1)..(1): n is a, c, g, or t
ngaggtgccagaggatccatttctagggctacagtcgtctgcatctgcattagcttcgtccggttcacaataggcaactcaatagctgacatgagtgtatcagtcacagttagggctgtatgaattctgcccttcagatcatcagtttgagctacctagcgcttctgcatggtgtatgctgtagtactctcggtaaggacatctctcagatgctctgtgggtctctctggtccagatcgatgctcacaggtcctcaaggtgttctcaatggcactctcctccatcctatctattccagtgtccgtatattatatatagcccaacactctgcgagcatgcgtgtgccgatgtaatatctcc

SEQ ID NO: 711839 - DNA, 347 bp, Homo sapiens
caatactaaattataacttaaaatacacatacacacatttacacacactctcacacgtcacttcttacagaactgtgcttggggaaactccatttgttgaatgccactgaaggcatattttgctaaactgctgctccatgtatttttgtttggaacactctatcacattaaggcacagctgtttattgccatgagcagaaaataaagcatatgcttgtggccaccagaatgttttacggtctttcacgcttgtataaaatggacctgcagatacgtttaagtgttctcatgatgctatagttgagctgaaatgtgacatctaaccattttgcaaaagtgtgccaggt

SEQ ID NO: 711840 - DNA, 402 bp, Homo sapiens
ttattggtctgctctctaggctggcgtgcagtgtgtgtcatacctcactgtaggctgcctagtacctgcctcgtgcagtgattctcctgcttcagcctccccccgtagtctataactacaggtgtgtatacactgggcctggctaagtgttattatgttttggagagatggggtcttgctatgttgcccacgatggtcttaaactcctggtcttagagcaatcctcctgcctcagcttctcaaagcactgggattacaggggtgagccactggtcccagcccagcagtttaatttctgaattaataaactatctaccttccagctccacagggaaagccaaaattacacttgtgttcttggagacacttttaccttttaaaatccccaggtagatttggaag

SEQ ID NO: 711841 - DNA, 675 bp, Homo sapiens
tggcattattggaaccttaattttccaggtgatttctggtacataaggagtatgagagtaacccttttacaaatggaactaatttactaaaacaaggacaaaactggaacgtgggtatttggatggtgaactccacagggagttaacagcttcaaatccagccaaagaaattggtgtacaatctctttcagctatggcatctggataggtgctggaaatctttccatcagcccggataagtggcccaaacaagggctagggaggcgggcgctgagagacagaacatggaaaacaagaaaaggctatctctccacaactcttggtgaatccttggcagggggcacacacagttaaataacaaagataatacgcccctataaaaccacccccggacgaatcagagatcaacacaagggccacaggagggagccctttgcaaaaagagagcccaagggggcgaacgaaaatcacctggggggccccttagtgggcgatatacgaggacaaaacccatctaccaggcagctaacaaaccgccgccaccggggcacacgagaagcactcccacacaaagagggcgtgggcgagagtgtgggggacaggcaacaccagaaaggcgcacaaagaaacccgggaaagctgggggggcccaaaacagagccaagagaacacccg

SEQ ID NO: 711842 - DNA, 155 bp, Homo sapiens
agtggtgtgattagctcattgcagcttcgactatcctgggcccaagcaatcctcttgcttcgtcctctcaaagcgctgggattacaggcatgagccattgcccctggttcatttatggagactgtaagagcaaaagcttttctaaatacaagaag

SEQ ID NO: 711843 - DNA, 1452 bp, Homo sapiens
ggtggagtgaagtgtcacgccgtcggtcgcgattgacttctaaagagtcatgctagtgatgaacaagcccagaagagaaggaagagagaatagcaaaggagtacagggactggactctgtcctcagggacaacttaacatttcaggggaacgatggccatagaattctctcaggcggagttggaaatgcctggaaccctgtcacagagggctttagtaccaatggatgtgaatgtcggagaactacacggaacctgtgtctccctgggaattctctcttcctggactctgaatattaagctcgcatgtcggagcaaaggacgggagccgctggtctggttgacgagtgaacgttgaaaagtagcaataaacttcagatgggaggggatgtgcatcaagacggtgtgaagcagcagggagcaggctagtagcatgtgtgggaaggtcaaatggcagatagacgacaaagccagattagattgagaataagatctttgggacgtaatcctcgttttccaactctcacaatgctagtctggacacgtgggaggactgaagtttcgcgacgaatgggaaatagggggctcaatgaagactggcactgtaaatgcaaagatctgagacaaccagtgggggattagaagagcgcacataggattggcccgtccgtggatatgagcccctacgtggctggtccgacagggaccacactcgggtcgcgtatacgcaacggcttgttacgataaaacgcggccacaactctttctaggaagctaaggggaacctcgtatttcctggactcggaatttcttttccattcttgccactccactcaagcacaagaaggcgacgcataagatgtaaccacccgcgtttttaagcatcggaacccacagaggcacccttgttactggaacagtctgctgtcacattggaaatgggcaaattacgctatagagagggtcccttatgagctagcgatcattgcgttgtcccccaagcagcacagtggagcgtttacacaaccatgctactacaaggtgtaagcttcccacggcagtagccatgaaatgagaacaccgttttacccatacccttgtgtacacttcaccaggttggccgcggccaacagtggccacactataggaatcctgcgagcacagtgtgcggacaccccgtttggacatagtacctacagttgtggtaagaacatatacacatgacactggtggagggagcgctaaaaccccttttagaagaaacctgcgtagattgtttcttgcttgtgaacacaagggcattataaaaggagtagaacaaaatgtgtagaagctttttgtgacaggatacagatctaccaagaagctgtcgaatctccaagcagtgagtaacgcgtggaagtgaatttgactacatgaaattgtttggtaacaaagtattatacagtgatgag

SEQ ID NO: 711844 - DNA, 331 bp, Homo sapiens
cttattggccgggggtaggtgttccggccaagtggggttggttggctaaaaggggggaattaatttattccccaccaccagttgaggggaaattttggccaccgaaggagtttgcccaaaaaccaggggcagaaaatggtaaagggggttaagccttcggaaaaaagtagggggccagggcttttccaaaaaaagggaaattaaaggtaccgattgtagaactgtaagtagggaagggttgggaagcgaaaatttctggggtgaacctttaaaggcctcctttgaatggctgaataaccaatttttaaattaaccggtttttttaaccggg

SEQ ID NO: 711845 - DNA, 1226 bp, Homo sapiens
gcgctgcgcacctacctgaggctgcgggcgctgcagacggctccacatgcccagagcactgatgctctgatgccctgtgccctgtagtgttccgcctgctccctgccctgccttgtggctctctctgcctgctgtgagtcctccgaagatgtgtgtggacaacgaaagatgacaaggactcagccaagaagaacaagggcaaggagcgccgtggactgtgatgactcaagcacggatggtggctatgagcagagcacaagatgtcagtgagaagaggtcctgccgcgaatatacactgacagactgtgtgcagggctttgacccagcagcacagcccaggagatcctgagccccgggacttcggcctaaaacgcacatcgacgacatacgtcgtaccagacccgagagtagggtcacagttctagccgtgacagtctctttcgacggggcttcatcccattccttgctggtggacttcgcggcctaatcactcttgtcttccctgggacctaccgggctatcccacgagagggcaccagagctactacacccctcctggctgacccacccttgtacccttggggactctgtgcttggctggccgtcggtcgatcaatcacttggcctgccgttctccctaacttacccagagagagcccaaagacagctccatagactcaatgggagctcatttcaagaataccctgcgttgaaccccaagataggcccctgagtgaatcccgcgacacggtgacccacaccgcccgggtgaagcgacagaccgaagcgcggtgcgccgcggacccactgcatgaaacaccaacgcgcgtcgcaccaccacctccacgcccacactacccatgcgccaccaaccgccgagcaaacgacctggcaaacgtggcacaacatacccccaacaaccgcccaccaaccaacaagccagaacccaactccccacaaccaacgctcaaccatcaccaacaccgccacacctctcacccaccccctcgcatccaaaacccacccccgcccacttacttaacccactctacacatacacacacaaacccacaccaaataaatcaacagaacacaaccaacaccccaagtcacatactttactaattcatcataaactacacctacccaatctatcagattctacagtactaagacaccactccagtccacacaaccccaacacatctcgacaaaccgacccccca

SEQ ID NO: 711846 - DNA, 617 bp, Homo sapiens
  misc_feature (169)..(169): n is a, c, g, or t
ggcgctctccacccgcccacagagaagagtcccccttcgccacgagagtccccctctaaaagagaggagaccccccccctcgggaaacaaacacccttgagagagaatctcccacgtgtgagaaagcctcttaaacccccgcacatatatggcccacacagggagcccnacatgtgcgcgcccgggaacccatattttctccccaggcccaggaatctccccagactcccgggtggatataagagccacacttctgtccagaccaacggccacttaccaagccccatatccagatgagaaaggccgcgccggttctccagacgcccagaaagaccccttggtaggtaacgaaaaggacaagagaggcgtgcctgttgtgtgtttatagaacgccagagagagagccttcttggtgggagaaaaaaggccacgccagcgttcccagcgaacccacgccccctggaaagaacgccccgccagagaagagaaccctactcacagaggagaagaacgccctgctgccatataactctttataatttgattattccctaaaggtcccaatccttttggacagctttttttggataaagacctgattataccggccgtgagga

SEQ ID NO: 711847 - DNA, 425 bp, Homo sapiens
  misc_feature (61)..(61): n is a, c, g, or t
  misc_feature (64)..(64): n is a, c, g, or t
  misc_feature (66)..(66): n is a, c, g, or t
  misc_feature (90)..(90): n is a, c, g, or t
tgagacagagtctcactctgtcacccaggctggactggagtgcagtggtgcaatctcgttnatngnagcctcctcctcccaagttaaagnggttcttgtgcctcagcctcctgagtagctgagattacaagtatttgccaccatgcctggctaatttttgcatttttagtagagacgaggtttcaccacattgcccgggctgatctcaaactcctgacctcaagtgatccaccctcctcggcctcccagagtgctgggattacaggcatgagccactgcgcccagccccatcagatgattttctaaaattagagtttctttcttcagattccccacagggtcccacacaccctgtgtacaattggcactcctgtccccaactatgggttatgcaatgagggtgtagggcttgcagtagagtttct

SEQ ID NO: 711848 - DNA, 250 bp, Homo sapiens
gtcgagaggagtcccacgattgacacgttcagaatgcagtgttgaagaattatgctgtgcatcaagtagttacactgaatccacactttacctacatgtctatgcatctaggcaaatttagttggctgtataaagatttgagtagcccatttatgacaaaatatgaaggcgaaatttaaggacaactgagtcacgcacaactcaacatggagcctaactgattatcagctcagatcccgcatatcttgag

SEQ ID NO: 711849 - DNA, 931 bp, Homo sapiens
gtaaaactaggaccaaggacgtccatcttaataagcagtataacttaggcaagcatttacccaaataaggtataggcgatagccttggtggcaccttggcgcgaggagatatagataccggataagttgggtgatgataacagtgctacagacaaagactgtacctattaagcgagagggaccataacggcgcaatatacgcgttcattggcagtaaatggagagtttaggctgaagacatttacagtttgggcaggggagagcccgactatgtttacaagatccctggaggaaccagacgaggctacctgagggaacgggtaaaaagagcattagcccgtcttatcgttgcacagaaataggtcggggaaccagatgtctagtatggctaggaggcgcgaccaaagccggaacacggaggccctaggggtgcataggcatggtgtctgtgcgcaagggattacgaaatctggaggtttcactctctttgagaatttgggcgcaccaaggaaagccccttgcttaaaaatgtgccccgctggtgttaacaatttgtcacagggggtttgtgtcccaagaaggatgggatagcaaggtactttcggcgaggaatgtagtgaagaacaaactctgtgttacgcaagaggaggtaacacaggaacggttaacgagcccattatgtaggggcttaagaaagcaagacaatcgaatttaaagaaagagctgtgtcaggggatcaaatatggcgcacataaggtaagagataattcgcagaatattttgaggttgaagttggtcaacagcgccagatgtgaccgaagtttattagaccctagtaagaaagaacttggtgtgagggaatagttaggggggaaaacgattgtcctccaggataaagttgcgtagattaaacccgtggactgtcgttaag

SEQ ID NO: 711850 - DNA, 271 bp, Homo sapiens
  misc_feature (1)..(1): n is a, c, g, or t
ncccattaactccacccggctatttaatgtatctttagtaaacaggaatcgccatgtagtgcagctggatctcgaactcctgtgcctcaggtgatcacgtctgcctcagcctcccaaaagtgcatgggattatagcgcgtgagccacgctgctgcccgtggtcaaattgccctggttcttctaacggacagcagccattgcgtatttatggggccacccctaattcacgtatgatctttcatctttgcatatgattcaacagaaatactcc

SEQ ID NO: 711851 - DNA, 369 bp, Homo sapiens
  misc_feature (330)..(331): n is a, c, g, or t
  misc_feature (349)..(349): n is a, c, g, or t
gagaggctgctacgagactgtacactgctgattgcattggtattgtggataacgtggaatagcgctgcgtaaatgacagcaccagtatccggcccaaaaacagtgtagtataaatgagacacctgctgcccctgcctgataaaattgcactacgatgtgtttgtataatcatccgtagcttacgtcttacgttgcccaccagagcttatccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711852 - DNA, 141 bp, Homo sapiens
cgatacgactttctttctttctttctttctttctttctttctttctttccttctttctttctcttccttccttccttcctttctttttctttttctttctttctttttctttctttctttttctttctttctctctttctt

SEQ ID NO: 711853 - DNA, 370 bp, Homo sapiens
  misc_feature (331)..(332): n is a, c, g, or t
  misc_feature (350)..(350): n is a, c, g, or t
ctgttatataggtacgccgagacgaatagccggggagagaagccgaaaaagaaaatattgaaggccggctagtgactggggcgagtggtgagtgcggagataaagggaggtgtggtatttgcgtgcccgtgccgtggagaaaccccccccctgaatacataaactaaactagacaatagaaaaaggaaaaaaacaattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711854 - DNA, 349 bp, Homo sapiens
  misc_feature (310)..(311): n is a, c, g, or t
  misc_feature (329)..(329): n is a, c, g, or t
actgtctctagtggcgagaccggtgaaatacatgatttggccgcaagtaacgacattaaaactacatgcattttatgttttgctttagcccggttgtacaaccaaggaccagtacaatgaagcaaaacttacaatagcggatgtatgcagacactataaaaacataattcaacaagctctcactacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711855 - DNA, 1556 bp, Homo sapiens
  misc_feature (1359)..(1359): n is a, c, g, or t
cctccagatttttttctttatcatgcatccatccatatttctttctcattcattcctcttccatcttcctccatccatcttcatacattcagtgctcactctattcaatatctcaattagagattgagaagcgagagatacaagagacagcaaatgaagaggcagacacaccatacccataacatgattcacatataacaaaacaacaataagaacataagcacaactcataccaactacaatgatacacccaaaacaaaaaaaggcaaaaagcaacacacaacaccaagacaaaacagaaatagcaagaaacacatgataatatcaatgacacacaacaagtacacacactaaccaatacgaaacagcacaaatacatacagacacagcgaaaaaataacacacacagaaaaaaacaaacaacatacaacaaaaacacaacagtaagaaaaccatatcacacaacagacaagaaagagttgcacacacgccagagaagcacaacaacagcaaaagaacagaagacacaaatcaacaaaacacacaaacacaaaaacacaatggcaagagaaaccgaccagaacagatcgccgacagaacgaaatcagacacaccgacagacataagaacacccaacacgaaaaggagacacacaacggagagcgagatgaatactaaaagaagaagaaaaatcaaaggaaacaaagaccagaaaagacaacgagaagcttcacgaggacacgacacagcagagggagcgcggagacagaaggagaacataacacaaacagcagcaaacgcgcaagcagcgaaacgagggcaacgagctctaccaccaagcaagggacggcaacgaacgacagcaaacagacacgcaactgagaagcacggaaaacaggattactacatcacgacataccacaggaaagtacgaaaaaaatcgagaaccaacagaatagacacacaccagaggagaataccgagacgacagcacacgcaacaagacatccaaacagaagctactagaaagagagagacgacaccacgcctatcgataacagcgaagaagaccaacgcatgagcaccacgcacagaacaacgaaagccacacaagcgaagatactcaagacaaaagcacaaccagcaaggagcagcgaaggatagacacgaacgggaaccacacgacctcaactagaaaggaaaagcaaagacggacgagcatgcaggagagaagaaagcagatgcgctagcacaagctcagaactatacataagcagactgcgagcgaacagctacaatcagacactcaaagagcaacaggaagagaggagacagatgacgagagagtacggggatgcngcgacgaggcaagcagaaacgagccgagacaacgaggctagcgagcatcggacataacagcgcaagcctcagaaccacgacaatcccagacaggagagagaagcatggcagcacaacgcgtagacaacgccactagcactcaggagacagaagcgagagacgtgaagcaggtagcacaaggagacgaagcagcaaac

SEQ ID NO: 711856 - DNA, 201 bp, Homo sapiens
  misc_feature (25)..(25): n is a, c, g, or t
  misc_feature (41)..(41): n is a, c, g, or t
  misc_feature (162)..(163): n is a, c, g, or t
  misc_feature (181)..(181): n is a, c, g, or t
tagtgcatatctagtgtggcaatgntgaaggtccaccaganccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711857 - DNA, 364 bp, Homo sapiens
  misc_feature (1)..(1): n is a, c, g, or t
  misc_feature (325)..(326): n is a, c, g, or t
  misc_feature (344)..(344): n is a, c, g, or t
nctaaataacccgcccttaccctttacgcaataaattattatggtttgacgcctgttggggtacgccatgtcaaacattacgatgctgcaagattttgccatggagctgctgatgcactatttagttggctaagttatgtaccatactaaattaaagcgggaaactgaccagcaattaagaaaataacaagctctcactacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711858 - DNA, 813 bp, Homo sapiens
atcagctgttccagtccctataagcttcgagctgtccaagacatgaggcctttttcgaatggagttattgggcaacctcattccccaatagccctgatctcacctggttctcatcgctgtggggcagaactacatgagaggaacgcaaagggcttcagacctgtcaatggcctctcatcctctggtccttctgccttgcaatcttcagtatcctgggggcagtgaggatgtggggcattatggggactgtgctacttaccgggggcctaaagcaaaccgtgtgcttcgaatcaatcttcatcgatagattccacagtcaaattctggtcctggagtctttgcttctcatgcgaaggtcatagaactcggagacatcagccttacatcatcctgctgataagacggcacacatctagtctatcatttcatctggtaccgacctacatgcgacagtgctctgtgtacacaagctttggatacaagaacaaagtgcctgcaggaggctggttcgtcaccatgaactttggtgttcatgccatcatgtacaacctactacacttactgaagagctgcacaacagtgaaggccccccaagatgcatgcccatgctcatcaccagtcgctgcagatcttgcagatgtttgtaggagcaaacgtcagtgatcctcactgtacatctggaggcaggatcacggatgccacaccacgatggaacacttattctggtccttcatcttgtatatgacctatttcatcctctttgaccacttcttctgccagacctacatcaggccccaaggtcaaagcaaaaca

SEQ ID NO: 711859 - DNA, 334 bp, Homo sapiens
  misc_feature (295)..(296): n is a, c, g, or t
  misc_feature (314)..(314): n is a, c, g, or t
attccagctgtctctagtggggggggtataggtgaataggaagcgagcaaaatgaacaacctagcacatgtagcggaaaagggcaagttaaaaggcaaataaagttgtggaaacgcatggactggctgcgggcgggggtaatttgaacgcatattaacaagctctcactacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711860 - DNA, 341 bp, Homo sapiens
  misc_feature (302)..(303): n is a, c, g, or t
  misc_feature (321)..(321): n is a, c, g, or t
gttacaccgacgtaaacatgcataatagcctagcggccctaacattgggcatgccgatgcgggagccatgctatgatgactaaccaaaacaagccataccagcaagcgaggccatggccctaacaaaatgacgcccgcgcgaaccggtgtatctgccacagtcggcattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711861 - DNA, 143 bp, Homo sapiens
acggccgtgtattactgtgcgagagaatccaccccatattattactatggttcggggagttattataaccaacctttttttacggttccgaccttatactactactactacatggacgtctggggcaaagggaccacggtcac

SEQ ID NO: 711862 - DNA, 340 bp, Homo sapiens
  misc_feature (301)..(302): n is a, c, g, or t
  misc_feature (320)..(320): n is a, c, g, or t
tctgttatatagcgtacgccgcatgcaagagacaaacacgaaaaaagccagcacccacaacgctaacggtctaaataaggaaccacctactaaaagccttagtagacccacaagggaaaaaagtatatatagtggccaaaaaattagtcacattggggcgctacaattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711863 - DNA, 345 bp, Homo sapiens
  misc_feature (306)..(307): n is a, c, g, or t
  misc_feature (325)..(325): n is a, c, g, or t
ccgttgcatccaatagtgagatggtgcatgaaaccttgtaatccaaatattttggtgtgaaaaaagggataaagagactttgcctacacggaaaattgggataaagtgaatactaatataaaaggaagaggaaaagagatgagctgctgtgggtgggcgtgcctattaatgctgctaatgtgcggccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711864 - DNA, 346 bp, Homo sapiens
  misc_feature (58)..(58): n is a, c, g, or t
  misc_feature (307)..(308): n is a, c, g, or t
  misc_feature (326)..(326): n is a, c, g, or t
gttattcgctgcggtgactaggcgtaatgttgcatgggctcggtagtagagtatggancgattggaggtaacgttggtccggtggcaagtttagcccgaggtgctctggattagaatagcgcattgagatggtggagcccaaagtcgttatcgacaaccgatgccgtgatttccaccagatgcttaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711865 - DNA, 428 bp, Homo sapiens
tgagatgtagtttcactctcgtcacccagcctggagtgcattagccaatctcggctcactgcaacctatgcctcccaggtccaagcgattctcccgcctcagtgtcccgagtagctagaattacaggcccgtgccaccatgactggctagtgtgtgtgtgtgtgtgtgtgtgtgtgtgtgtgtgtattttttttagtagagacggggttttgccatgttggcaaggctagtctcaaacccccgacctcaagcgatccacccacctcagcctcccaaagcgctgggaccacaggtgtgagccaccacgcccagtccaatacatcctttaaaaacagacgcaaaaaaagccttaacaaaacagtcgcaaatcaaacccagcaacacacagaaggactacacgcccatgatcaaagtttatgtattctggc

SEQ ID NO: 711866 - DNA, 542 bp, Homo sapiens
aaaatataaacccaagtggagagagtactaaaagacacaagatttttttttagagaatttatcaatctaatatgagcaattaattatttatgatggttcctatgtttcacagagaagttgaagaaataagattagaaccatcttatgggctctgggtaaggctctgcaatctttcaccatttttttttttttattataccaagtagcatgacagatgtttgcaatttgacttgaacattttcattgtctttgctttttttgtttctttctttttaaaaatccatggttttttaatttccttttcaatatttgtatccttttatggaatataagagaccacttatacgcacaagagttatctcttgtgggtctcactattattatcatcaaaatgcctgaaattacctgtgagggaacattataaagtaaatgataaagaaataatttaatgttacacattaggtaacctctaggaatatatgctggaaccataggaagacattgggcaggaagaacaataaaaatatttggattggaagtaa

SEQ ID NO: 711867 - DNA, 166 bp, Homo sapiens
tcttagaggatcccccagtctacacttgctgcagctcattggggtcaagaagaagcatttcgcattctagtggaccatctgtgtgatatggagatggtcaacaaagtgggccaaacagcctttgatgtagcagatgaagaccttttaggatatttagaagagttgc

SEQ ID NO: 711868 - DNA, 326 bp, Homo sapiens
tttggggccctagggggggcaaagttgcagaaaactcccccccccaaattttcaggggtcccgggttcacccccccccccattttattggggggtttaggggttcccaaaacccacccagcatgttatacccctttggggcttgggccccccagcggatttttttctcgggtttttaaaggcccctttcccctttgtgggcccgggcctttaaagggattttttttgtaagggggttaccccaatttttcccattttggggggcttgggttttttgggggggacccccctgatttttaagggggcccggccttccccttcccccca

SEQ ID NO: 711869 - DNA, 183 bp, Homo sapiens
  misc_feature (26)..(26): n is a, c, g, or t
  misc_feature (70)..(70): n is a, c, g, or t
  misc_feature (72)..(72): n is a, c, g, or t
  misc_feature (129)..(129): n is a, c, g, or t
  misc_feature (150)..(150): n is a, c, g, or t
agtgatgagatgcctgctgacttgcnttcattagctgctgattttattgaaagtaaggatgtttacaaancnatgctgaggcaaaggatgtcttgctgggcatgtttttgatatgaatatgcaagaagncatcctgattactctgtcgtnctgctgagacttgcagacatatgaacactctag

SEQ ID NO: 711870 - DNA, 171 bp, Homo sapiens
  misc_feature (1)..(1): n is a, c, g, or t
ngtacatactgacacacacttcattggttagaagagaataattttaaaaatcaaataaaattgaggctggcatagcgaagtacagattacctacaggttaaatagctaccagaaacacagaagaggtggttactaaaaactgagattgcttcagaggccaagcttgtctgc

SEQ ID NO: 711871 - DNA, 892 bp, Homo sapiens
catctatttacctagacacttatgcaggagtacatgctaggtggctttattcagattcgggtacatggaatcacatcatgactttgagtctgatggctgtgtagataaagatttacgcaagtgcctctgctgtgccgctggaaaatattaaaactcatcttcgggtgaaagcttcccagatgatgataattaatagcacttctgccttatttcctggagtaactcttcacgatcgagtcacatatgatacgctataaacacgtccacaaaattttctgggtttaccttggcacctattcttcacatatactatattcacctgtctgcctggaacatagcctcggtttacctctattctcttcgtatatgtaaaactattcatatctgaatctctatcccaatattatatatgatggaaaagccagaattgtctggcagaatttaattcttccttggatctctagcttctgtctccaatatcaggttccttcatcaaattctactactgtagctctgtgattataatctccatttctcgtccaatctatggtcacatatagacaagtacttggtcacaattagctcaaagaatcccccatttctttaagggtgctcagctcaaatcagcctccactcctggacgacggtacggcgcaccacggcacgcatcactgaactaggcttcgtgaccgaataatcccctggtgctccactcataacgagcgtgagcctcccggggaaaactcaagacacagcaccaagccgagacaccaaacgaaaagggaacccacccgcggacgccccgcaccgcaagaacggccaacgcaccgctagccactgctaaaaaacggaagacagacgcacaagacccccccagggtcaccaaacaccg

SEQ ID NO: 711872 - DNA, 424 bp, Homo sapiens
tggacgcatcacatctaaaaagtcaacaaatagctaaactctgagaaacttcagatatccactaatttgcaacgttcgtcacgcaactggaggagcagactgatggaattatccactgaagttcagtctttgtacagagagataaaggatgctaaagagcaggtaagccctttggaaacaacattggagaagttccagcaagcaaaaagaagaattcaatcacccaaaaaacaatacaagcaacaaaatcagcacaggataaactgacatgatattaaagagccggttcacaaatcttcctggctatatgcaaagacattgagaattcatattccagatgggcaaagcacgactataagaagcaccaaagaaactgaacttcaataaagtaatcagctcacctaagtgaatgcgtcgtcgcaag

SEQ ID NO: 711873 - DNA, 135 bp, Homo sapiens
cccccccaaaaaggggggaaaggggggggggggggcccccccccttttttccgataagggtttggcccccccccccttttccctttttttgggggggttttttttagaaaaaccaaaaagtttttccccccccca

SEQ ID NO: 711874 - DNA, 1060 bp, Homo sapiens
tgggcaggctccgccctcctcccctactccaggcccactgcagcctcagtcccatggagccggcagatctcccaacatcaatggtccgatacctgcgtgattgagcctgagcgatcgctcgcacgaggtgtactaggcgatgcagttgcatggtgcaagagcgaaggacatccacggccaacgatggatgcaaggtgctgagcccgtgagcacgtcgaggtctactgagagtgaccgcatgtgcctagttctcactataggcgcagacactgctctcgaaggaggctgctaccggtatccacagtgcgtgcagtcatcgctccgtgcagaaggcgcacgaagacgctcctgcaggctccggaggaggcatcgcagaggctgcagaagccagtgaagagaacatgcagaaggcactaaggcttcctgggccccatcacccccagctggaaagttcatagcaatacaagtcgtcccgaaaacgacgcaagttgaggccatgagcagattccccttactatcagaatgctcaagccccctaagctggaagttacgagacacagtcacctggcgcaagaaacaccgagtgaggccataggcaactcccctacgatcaaatgtcgtcaagcgcctgaggttgccgccgagaagcccacaagatctgagtgaaatgcgcaaaagtcacctgcccaggtaaagctttgactagacaagagaaaagaagtcaccaagaagagttcctaatcccaggaaaacacgaggggacagacaacgaaaggcgtgaggcggagccatcaagcagacacccaaggaagcttgccaagcactagagagaggcccaggggaacaaaaagcccacagagcagacgcaagccgccaaacacaccaaaccacgcaaggacaacggaacagacagaaaaaagggccgtacgcacacaatgacaaacacagatgcaacgacgagaaaccaccagccaaaccgacagaggaacaagagaagaaagcggaacactaagctagagggtgggagaaagacggaagggacgaaaaagcaacaagaagg

SEQ ID NO: 711875 - DNA, 318 bp, Homo sapiens
ttgcgagatccctatattttacttttcttatagagttttttttccattcttggctagattcgtttttttttaacaaaaccccaggggttattcatcttttagttcttccaaaattgaaaacatcaagtcttactgctaaggggaaaaaacaaacaaacataaaatccgagacccctccccattttttttaaagtcacagagcatggaaggaactgcagtgggacaggtgggtgcagagaaccaaaaggggaggatggcaatataaactccccaaatgcttgaaaagctgttcaacagaaactgtgataaatacaggac

SEQ ID NO: 711876 - DNA, 480 bp, Homo sapiens
tgttcggaggatcccctccataatgtgtgccaggctggagtgattgcgtgatctggcttacgctaccttgcctcctggattcaagcaattcttcttcctcagcctcccgagtagctcggactacaggcatgcaccaccatgcctggcaaattattgtatttttagtagagacagggttttatgttggtcaggctagtcttgaactcctgacctcaggtgatctgcccacctcggcctctgaaatggctcagtgcaagtcttactatttcttaaataataagacttaaaagtcaaaattacttttggatctgtgtgctgcagaatgaatgttgtgttagcaggtgtgaaaacattaatctgtttgtacagctccatcagagttcttgagtgaccacgtgcgttgtcaatgagcagtaatcttttgaaaggaatcatttttttttttggagcaggtctcaacggggggcacactttagggag

SEQ ID NO: 711877 - DNA, 130 bp, Homo sapiens
gcacacccgcttcccggagaggtccgcgggcttgcggatgtcggagtcgcgggcggcgaggatgcgctgtttggcggagaagtactcggccgagaagttcaccagcttgaggcgttcgcaggtgatgctc

SEQ ID NO: 711878 - DNA, 693 bp, Homo sapiens
  misc_feature (88)..(88): n is a, c, g, or t
cacaccaccccgcggtagagaatccaattcccaagccggaaaaagttcccctataaggtaaagacctttggggtttcccatcccctgnaccagtagagagccggttccaccaaaatatggaaaagagttaggttttcacctagttgtaaagataagtggtttccagaactcgcctttttttgcccccggcatgcctactttcggcctagaggcagtaattctctctccatattgacttttgatttgtgctgagggtcagcattaggctcattcttcctgaaacagtggaagcaatgccagctgtgtggcttctgccctgggcatggccccgtctcctggatcggaaagtgaggctatgagcccccctgcctgtgggcagcaggcctaaaggacggtcccaatcccggttcagagtacaggccatttgcacaatcccagtggtacttgtatcatataccttggggtggcagggttataattagtcacagcttaagggacattaccagggttccttaggacttgaaacatgtgcattgtaggagtttctacatagggtagcatcttagcaacatccatatttcctgccttagacagtttaaagggtgattaaataatctggcttcccacaaaacgctcggaacccatgcctccctgtgaaagctatgtaccgtctctctgtttaataaaactaac

SEQ ID NO: 711879 - DNA, 287 bp, Homo sapiens
cccaagttgttcaccgacagacagcttacaggtctctcccgtcatacggtagaatcgctcttctttcttcctcacagaagactcctacagaggcctcagcactgactcctggtaagagaaggcctgaaagggaatcacacacaggaaagtattagcctactctgttaaaaaaagagcaatgctgtttagttttttgctgaaaggccatattaccttctcactgtgtttctcctgcagctcctcccttgcctgcttttgtctttgttttgcctcctcatcttgtcgac

SEQ ID NO: 711880 - DNA, 313 bp, Homo sapiens
  misc_feature (274)..(275): n is a, c, g, or t
  misc_feature (293)..(293): n is a, c, g, or t
gtggcgagaaaaatgataatgtggtgaatgggcgactataaataacgacttagaggggacggcatggcaataacactacctgaagggccacgtattgcaatgctagcggctattacgaacagatagtagataagtaaagtttacagttttgacccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711881 - DNA, 266 bp, Homo sapiens
  misc_feature (227)..(228): n is a, c, g, or t
  misc_feature (246)..(246): n is a, c, g, or t
ctacaccaaaaaaacaaactgtctgctgcgaagtctctgcgggggggccgatatggcggcgattaaacgataaaatagtccccatacgtctatgcaccggtcggggccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711882 - DNA, 163 bp, Homo sapiens
  misc_feature (146)..(146): n is a, c, g, or t
tttagcggtgcctttccatagaatcactaactccttgaggtagtctttctcatgtaacttctcctatagtagtgatcaacttattgcttacataagaacaggctagaatttcggaagtctgtgctacgctaaacgtattgtggctnccacataacttacaaag

SEQ ID NO: 711883 - DNA, 275 bp, Homo sapiens
  misc_feature (236)..(237): n is a, c, g, or t
  misc_feature (255)..(255): n is a, c, g, or t
acgtattgacacaccagcccacccccctgatgagagcatgtattgccaaagaccgcccaataatagtagaagccgtaaaatctaatcggctcggcctaatatgggatgacggggaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711884 - DNA, 305 bp, Homo sapiens
  misc_feature (266)..(267): n is a, c, g, or t
  misc_feature (285)..(285): n is a, c, g, or t
gcggaggtgttgagttgtatagagttgtagagttgtttagtgttgtgagagttgtatagagttgttatagagttgtttagagttgtttagattgtgttaaggggtatgtagttgcagtaaatatataaatctataccaccagagcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711885 - DNA, 308 bp, Homo sapiens
  misc_feature (129)..(129): n is a, c, g, or t
  misc_feature (132)..(132): n is a, c, g, or t
  misc_feature (269)..(270): n is a, c, g, or t
  misc_feature (288)..(288): n is a, c, g, or t
cagggggtgcgaggcgaggcctgtgagcttatatgcgacctgagatgactagaggggattatactaccgtgacagaaagctagtatagatacagcatagaagattagacccaatgaattagcatataantanaattatgcatagcgcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711886 - DNA, 328 bp, Homo sapiens
  misc_feature (19)..(19): n is a, c, g, or t
  misc_feature (24)..(24): n is a, c, g, or t
  misc_feature (26)..(28): n is a, c, g, or t
  misc_feature (32)..(32): n is a, c, g, or t
  misc_feature (289)..(290): n is a, c, g, or t
  misc_feature (308)..(308): n is a, c, g, or t
aggcggtcctgactgttgngtttntnnngatngcgggcgctagatggatacatggattacattcacattcccttcccacgccaaatttcacaacgcatgggaaggcttctgcctattgtattaccaccactttaattcatggaattaaaggcaaatgctaaactggttccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711887 - DNA, 271 bp, Homo sapiens
  misc_feature (232)..(233): n is a, c, g, or t
  misc_feature (251)..(251): n is a, c, g, or t
gtatccagttgtgtagttacctacgggccctgtgtcgccctgagcatttgcagggtctataaaattgctatccgcattttgcgcatttgaagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711888 - DNA, 288 bp, Homo sapiens
  misc_feature (249)..(250): n is a, c, g, or t
  misc_feature (268)..(268): n is a, c, g, or t
ggtaccgatatgtgtgctccaggcgattaacgcgcaaaatcttttcggcggtcaaaattggacgacgctgtaaaagggcaatactagacacctctccagaagatttcagaacgtcttccctggcgctgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711889 - DNA, 283 bp, Homo sapiens
  misc_feature (244)..(245): n is a, c, g, or t
  misc_feature (263)..(263): n is a, c, g, or t
agatgctatcctattgggagacgacaaaaatggactgaaaaaaatgacacgctttaaaaaaagcttggggagagggggacctacaggagaaaggggtaacaggtgataagaacaagctctcacccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711890 - DNA, 313 bp, Homo sapiens
  misc_feature (274)..(275): n is a, c, g, or t
  misc_feature (293)..(293): n is a, c, g, or t
ggttattacgagttttatagagttgtatacgagttgtttagagttttggcttgtactaaacaccgacacaggggagagggtacgtgaaagaaaaacaaaagctaacgcgttggatctgagtacgcgcgaaacaagcgccggcgccaccagagcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711891 - DNA, 388 bp, Homo sapiens
cgcgagcgcaggagctgcttatacacgagactcgtgagtcacacgcgcagagacatatggactgtgggcgctcctgcttgacaccattctgccagaagacgcagtgtcaagaggggcctcgcggtggagacacaagatctgatgcctagatgagctctgacaaccgaagtgccaagcggacaattatggggacctgtcctttgttgacattcctatataacagtgctctttgcatactctgtgatgaccaagtgcaaggggaactgttcacctcccatggctctcaaggacttacaacgcttcaggaacagaccatataagacttgactggctccagaacgcaacttgtggaacggcagaacctcttggctgcagaggccgcctggtt

SEQ ID NO: 711892 - DNA, 300 bp, Homo sapiens
tagcaccacacccagcctgaaatgtatctttgactgcagaatcattgttttggtagctgatgagaatccctattctttagggctttaaaaacaaaacagtaatgttatttttgacttgaagacaaactacttttctagctttcaccttagtaccctgagtgatttcattcacgtgtatgcctcacactctccaagtatttttagggtagtgacccctgttccccatttcccgaaatcctctcagtcttggaggtagctttgtttgcctgtggctgtggagaaggcttccagcatcttgag

SEQ ID NO: 711893 - DNA, 101 bp, Homo sapiens
cgggatgttcgcagtccactgatttccagcacattcttgtctagttcctcctgttctagttcttctacttccgccatgagctcatcctccacaacctctgt

SEQ ID NO: 711894 - DNA, 643 bp, Homo sapiens
atattctctccagccaagtaactattacccgggttaaaaacagcccaatttcataaatttttttaaaacattaagatgggggaaaagcctccaaaaaaggggggggaagaggcgcctcttcccggttataaaaaaaattttttccccaaaaaaccccgtggaaaaaccccgaaaattttcccccgcgggttatttacacacccccccttctcccccccaaagagttcagagaatattttcgggggtgttggaaaaaacgccccccccaatggggggaaaaaaaggggcgggttcccccctttaaaaaaaaaaaggggggtccccccaccccttttatcttttaggttgaccaaaaccccaagttctccagtttgggaaatttttccaaaaaccgccccctttcaaaaaaacccctccaaaccaagagcaaaggagggttcgccttttcccttaaaggggggagggggcggttaagaggccaaaaaagccctattcgggcccaaaaaaattcctgtcctaaagttaattaaatcccactcagcagcttcagtaaaacagattatgtaaagtctctgtaacagaactgtactaagtgaataacagtctggccgatagataactgagctgaaagcagactccacag

SEQ ID NO: 711895 - DNA, 104 bp, Homo sapiens
ccattaagaagaaggacgagttggagcgtgtgcccaagtccaaccgttgattttcccagttgttgcccaataaacctgtttgccctttggggcagtccccgcca

SEQ ID NO: 711896 - DNA, 856 bp, Homo sapiens
gggtgctgctggagtcgccgcggccgccgtgtgatcgtgtccatcagccagagcctaggggctagggccaattgagacgttcttgcctccctctttcttcctccggttttgtctcttccctctcgtttaagtttgcctgggagcttgaataggagaacggcacggggtcgccccaaaccctttctgtcgtctgccccatcacaagtgcccactaccgccatgggcctcaatatctcctcccttcttctcccgactatttggcaagaaggcaagatgcgcatttggatggtttggattggatgctgctgtgcaaagacaaccattctgtataaaacctgaaggtagggggaggatagtcaccaccattcctaccgatgtgttgtaatgtgaaaccgcgtagaattatacgaacgttttgtttcagcagtatggaattgttggtggccaggatagaattaggcctctctgaaagcatttacttccagaatacccaggctccttattgggtggtagatagcaaccgatcgtgacaggaattccaggaagtagcagatgagctgcagaaaaatgcttctgcctagatgacattggagagattgcacgcgctgctacttttggcaaaccaacaggatttgcccatgctatggccttcagtgaaatgccagataaactagggttcagtctctttcgtaacagaacctggttgttccagccccttttgcaccccaggaactggtctgtttaaaggactgacgtgctgcactagaggcttcaacagtgaaagaattggggtctcacccaggcgcgtttggtaacatggccgcgttgtcacaccacacttcgttgcttgttcacg

SEQ ID NO: 711897 - DNA, 145 bp, Homo sapiens
agtcggctcgagttacggtcaccgtagggggtcttcagcttgtatctcctgacaaagttatttctagttaatacattatgcagaaggtataggggttagtccttgctatattatgctatggttcccaacggatgaccggcgactt

SEQ ID NO: 711898 - DNA, 568 bp, Homo sapiens
gaggatccgcctcaagtgatcctcaatgcggttggcctcgatgaagtcgttgtatttgtcatcagtgaaaagaggctcgggcagctttcggaagaaggacttgagcaggctgctgatcacattgaggtcttgccagcgctcatcctgcaggttgatgtcaccaggcccgcggttgagctgctcctgtaggctggacaccactgcattgttgccgggcactcggtaaatgcctgtggactccagccctcgtgcctccacaatgcgacagcatgcagccacgattaaggggacgcgctggttctccgtggctggctggcactcctccagcctgaccccaaacgccctcggagcggccttcttatttttcttgatgatgttgatgccccagggggtttagggggctgcagcactgtcatccttgctccctgcgggcaggtcctgagtcctgaggccacgtgccgcactctgcttgaggaactcagacttgaggccccccagtacctcatggccttggcatcctaatcactagatggctggcaacggtcctagagctagtcccccttgtgat

SEQ ID NO: 711899 - DNA, 885 bp, Homo sapiens
ggccgggtgcttgtctccctctgctccttctccaactcgcgctcaggtttgccaccggctcccgtcggcggcgcaagcgagagtcggtggccaagatgatcttccgggcggccgtaacgctgatgacaggccgctcctgttagggataggccaccgtgttcgcacggggcaacagcgtcagaagcattcgattccgagcgtagctgtctggaggagagacactagactgcatttcctcgcgagtgacgctggaacgacgatcctgtctttgcccggggaaggtatcctccgatgacgagctgtccgacagtacccggatgaagttgtcggagtccccatcggaggcagcgctaaaggactgggagaaggcaccggagcaggcggacctcaccggcggggccctggaccgcagcgagcttgagcgcgagcgcaccatgatgctggccttggagcgaggctggcggaagcagaaggagggcgccgcagccccgcagcccaaggtgcgagctccgacaggagagtggtgagcaccgcgggggcgcgacggggccagcgtatcgcggtgccggtgcgcaagctctatcgcccggagagaacgcggccgtctgggcttgggcatggtgggacggtcagcaagcggacctaccgaaagcgcatcgacaggttcgtcaagcgccagatcgaggacatggacgatcacaggccattcttcaccctagctggcttaccttacgtgcactcgctcatcacccatcctaggccgtgtgcatctatggggcatcgcgcccagtggagctcctcgcagacatgagaccggtggactcgggtgctgggggaacccggggggtcacacgagaaacgtgcaagtacgtgcaagcaggagag

SEQ ID NO: 711900 - DNA, 210 bp, Homo sapiens
ccatgctcacttgtcttcaatcctcggcctcatctatccttctgtcttgacttcccaaacccttgcgattacatgttatagccactgtaccggcataccatttcttgatcgattaattttagatattatctgttggtttcctatcatgtttcatgaggattttgctctcacttgttccatgcatatgtccatggtgtttgtggtaactag

SEQ ID NO: 711901 - DNA, 254 bp, Homo sapiens
tgtactgtggtgtaccagtccccttctacctcttgatgtggcctcctctttggcttctggagtaggatatctttttgaagctttctggtccatttgcttgaagattgctaagatgtagttgtaaactttgttgtttttaggagagaagttgagctccagtccttctattccgccatcttaataaaaaattcccactagcagttttgaattaattaaaagtattacctagcaggtagtggtccatttggattgaa

SEQ ID NO: 711902 - DNA, 314 bp, Homo sapiens
gacatgctgctgaatcaaaattaaggatgcttggaggccgggcgtgatgctcacgcctgtaatcccagcacgctaggagagagggcggaagaattgcttaagcctaggagtttgaaaccagcctgggcagtatagcaagccctgtctatacttaaaaaaaaaatacagccaggcatcgtggcacatgcctgtagtcccaactactctggaggctgaggcaggaggaccactcgagcccagaagctcaaggctgcagtgagccatgatcacacgactgcactccagattgggcaactgagtgggagacctgtctc

SEQ ID NO: 711903 - DNA, 450 bp, Homo sapiens
  misc_feature (8)..(8): n is a, c, g, or t
  misc_feature (17)..(17): n is a, c, g, or t
  misc_feature (37)..(37): n is a, c, g, or t
ccaaacantgaaatcantgtttttgaaataagccaanaacagtttaattgcctactgtccatttaatccacatgttttgtagaataaaattcctaaatgctgcaagtgacaaaactcccaccctcagactggccttacataaaaaagggaacttggcccgtgtgttggctcacacctgtaatccccagcatgttgggaggtcgaggcgggaggatctcttgaagcccgggagtctgagactagcctaggcaacatagcaagacctcatctttaaaaaaaatttaaaacaaatagctggacacagtggcgcacacctgtggtcccagctactcgggaggctggggcaggaggattgcttgagcccgggagtttgaggctgcgggtgagccacgattgcaccactgcactccggcctgggtgacagaacgagaccctgtctcaaaaaaaaaa

SEQ ID NO: 711904 - DNA, 372 bp, Homo sapiens
gtgtacccgacgctatgtgaacgtaagactgatggttattgatgagacagagatctcggtctgtattccaggctggagtgcagtggtgcgatcttggctcattgcaatctctgcctcgtgggttcaagcaattctctgcttcagcctcccaagtagctgggattacaggtgcctgccaccacaactggctaatattttgtatttatagtcgagacgggtatcaccatttaggccaggctggtcttgaactcctgaactcatgatccacccacctcggctatccgaagtgctgggataacaggtgtgagccaatgcaccttgcctaaaactgatgtatatctcttatttattaacatataacttgggacttct

SEQ ID NO: 711905 - DNA, 307 bp, Homo sapiens
aggccatttatccagggctttatcacacagcccagagagccagcaagggctgcagtttttagacgtgacagagcagggggtcagaaatgcctctccaacaccatgaggaggggtgaggggcgggggcgaccctgcagtcagcgtgaccaagattcgctcagcctgagcctccgcagcaaccgagggactggaggggaagtgaggggcttaagagagacacagtgggggacaaacaggagcctgtgtcctgcaacaatctggtctgtgagggcccggtccacccctccgtcctgggagtggtggctgc

SEQ ID NO: 711906 - DNA, 1289 bp, Homo sapiens
  misc_feature (1282)..(1282): n is a, c, g, or t
ggtgttgtccctgttaagctgctctttcaaccttcaaagcacgtgcagatgttgggtgctgggagcatctgcctccagacatcctacacagtgcatgagtgtgcagcgggcaggtgtggggagccctgaccctggagggtcccctgcgtgggccaaacgggcaatggagatgggcatacagcatcaaccaaagaattcctgcgcgggaggtgagcagatagacagccacctgagggtatgataagatgaacctgtttgtgggcatgtggacagttagaccggcagcagatgggtgagtcatgaaggatcaaagatccatgctgtagacaacaccaacatcaggaatgatcctaggactagcagagagaccagaccagtcatcacatagcaaagacaacgcgacaagtccgaaaggataagaagcgacccagtctgaaacgagggcgtcacccagagaggccaacaacaccatagacgaagacacacataagggaaatagagcggaccaacaggtacacacagatagcacatagtcacccagacaacaacaccacaaagacagtcagatagcccacgatgcattctgaggacccagttgcatgaaaatgcacactaccacagacgagagatagggacagcccggtggtaacaaagaaagaaacaactgtggcgacagtggcaccagacaaatcgtgatgagtgcacgatcaactcgcatggacagtaggaccccacatatatgtatatataaaaaagaacgtggcatgtacgaaaacgaacagggcaagaaccgaccataggcttcttaccagaggatcgtggatcagagcggacaagcgattcacacatcaatgtccgatacggagacagagcatagatcaggacagcacaacgacagagcagtgcgacatccagcggagacagacatgcacagaccaaccccaacgagggaacacccagaacaaggagagcataggccactcatcaacaacaaaacaatcaaacagacaccaccaagcaaggtgaacacgaccgcgagatacagaggagaaaaacaatcacaaacaaggacacaggggacagaccgatcatgatgacgcgcttacgaacagcaacacaacagagacactgaagagcataggacagcacggatgagcacatgacagatgactccaagacgattcacgagaagcacgtatgatagacagacatggactcacgcgacaacatcatatcggagtgactatcagacacgcaacaacgagtagtagagacgggaaancgtcaga

SEQ ID NO: 711907 - DNA, 665 bp, Homo sapiens
gacgatcatcggtcatagctgttctagtgtaccatagtatacgaaatgcagggtaaccaggctggtgtctgtatcgtctctccccacctccccatccagctctcaacttggtgtgcaggccaggacctgctctccctcctaactcccagcctgtgctgccccttctgggaccctaattttctggactttgagaaatgtgctgcccctgtggatgcctccaagagcccattagagggatcgggtggcgctgacctctctgtcttctttggatcatcgccttgtcagattgtcctccctcttgattctgaaaagatggtcctgctgccccatgaagaagcacagtaagatagatttctcatgcagccagtgaggggactcctctcttcacccatttccactttgtcctatgttaccctctgtcctgccttctgtagagatggattctcactctgtcacccaggctggagtgcaggtgtcgcgaccttggctcgattgcaagctcaacctccagggttacaaagcaattctccccacctcaggctccaaagtagctgggattacaggcatgcgaaacatgccaggtaatttttgtatttaggagagatggtttccgctagagagatgggtgttgcagctgtccgaatcctgactctgtgtcggccctc

SEQ ID NO: 711908 - DNA, 171 bp, Homo sapiens
tttaacatcacatctccgggtcgctttccgggcgtgattctcttctggtccgacgctccccgcccagcctggtcatagaaaatattaattttttggagacagggtttcattataccacccaggctgaagtgcagtggtgccaccacggttcactgcagcctcgacctccca

SEQ ID NO: 711909 - DNA, 205 bp, Homo sapiens
cgacacaggtgtgcactatgaacctgcttccctcttatgctgtttaaggtccccgggtctcccaatccagtgtgtaagcaggagccccatttgtcctaactcatgggactatcacgaggaacatatctgatcattcacaatgagcccataattggggtatgggtgagtcaaagatatctagtgattcctgagagtctctgtgcag

SEQ ID NO: 711910 - DNA, 304 bp, Homo sapiens
ggcacgaggcgaggatggccgtcatggggccccgaaccctcgttctgctactctcgggggctctggccctgacccagacctgggcggtctctcactccatgaggaatttattaacatccgtgtaccggcccggccgcggggagccctgcttcatcggagcgtgctacgtggacgacgcgcacgtcgtgcggctcgacagagacgccgcgagccagaggatggagaccgggacgccgcggatagagcaggagggtccggagtattgagacggcgagacacggaaagtgaaggcccagtcacagac

SEQ ID NO: 711911 - DNA, 248 bp, Homo sapiens
cttccccacagtaggtcacgtctatcccttcttacgtgggattgtttgggcatccgggtgcacaatctgtctagaggcatgtgtccagaatggccaagcttggtttaatgctcttatgttgccattttgaaattctttttctttttttcttttctctttttttttttttttgagacagagtccccttctctttccccaggctggcagtgcatttggtgtgaccaccagctcactgtggggacaagggg

SEQ ID NO: 711912 - DNA, 195 bp, Homo sapiens
gtcaggtgactctaaggatcccccgggagccttaccttacatttgtacttctgcctacattctgtaggcccagacactcacaggtcttactaaaaatacaaaataagccgggcgtggggcgcacgcctataatcccagctacttgggaggctgaggcagcagaattgcttgaacccaggaggtgaaggttgcagt

SEQ ID NO: 711913 - DNA, 236 bp, Homo sapiens
  misc_feature (197)..(198): n is a, c, g, or t
  misc_feature (216)..(216): n is a, c, g, or t
atttgttatacgcacgttgtgacataacagtccagaagtgacattaactcgagcaaactatgcggaccaccagatgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711914 - DNA, 248 bp, Homo sapiens
  misc_feature (209)..(210): n is a, c, g, or t
  misc_feature (228)..(228): n is a, c, g, or t
tatgtagtagcttaggctagtgtggcaatgttgatgcagaggcggtgctgtagttattgacgcggaatgtcatcagagcccaccagagccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711915 - DNA, 906 bp, Homo sapiens
gctgcatttgtggacacctgcagtggtggacaagatggactgtgtctcagggctctcggtgtcctgaggtcctggaactaggacagggacgtctggatcagctacagagtcggtgacctgtgacactctgttgaatcgtgcaatctgttcactgtcatgaaccatggggctaccagcaatcgagtgagtgggtcagtgggatgacattctctcgctaagaccctccatacaagatgtgagcactcctgactcactcccaaacctgtggggcccaagccactgtccagatcagcaactgtggagagtcctgtccttggcctccgcgtcgggatattcaagggatagaacctccactcctccctgaatcttgtatccttgcattttcaccatgcttttcctacaccctggcctatagttcccatgaatattacatggcttaagcttagtccccctcgaatcctctcctagttctccatgaaggaacagaactttggcataccataatttgtgtccctaagggcatatgggatggctgaccacacttgggtatattccctaagccaatcactccagggtggggcacggaaggggcggacgtcttgaccgtcagcctgttcattcactgaagtggcctcagtgaatttggagctttaggagtcaacgtccatcatttcaccgcaagtgtcaaggccatttccccctgtagcattggcgaagtcgacgaagggccgtctctccctggtcatccacagaagggtttcctggcaactgtgtcgcagtccattgcacttccctggaaggttggggcaaaacgtggtttaacgagctgcctcttttcactcattcactgttaggggtgcataagaaaaaaccgaaatcgtaagaacctaacttcccgtgaaatcc

SEQ ID NO: 711916 - DNA, 271 bp, Homo sapiens
  misc_feature (232)..(233): n is a, c, g, or t
  misc_feature (251)..(251): n is a, c, g, or t
cgcagcgagccagaagttgcgatgccgatagtggcggcgatactgatttgttataggcgtccgctgttgccactgcccgaccgtataaatacgcaccagcccaccagagcgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711917 - DNA, 375 bp, Homo sapiens
gtcgattctatgaggataccctgtacacactcgaggactaaagacgatccttacgtatctgtatagtgagtagtggatgtttacacacagagacagcttccggtttattccacaatgaggtgagacatctaccagcgctttgagacaaactctatcttttcctatgaactctatctctaaagcacgtcacggggaaaaaaagggtttagagagaaataacttctccgggcaaaaactgaggttagcgggcctatcagctgtttcttctcactccaccactgctgctgactggaggagcagcctggaaagcagccgccctcccgcaaacaggtaaaccacattacctattcctgtggcggaggcaaatggatggtc

SEQ ID NO: 711918 - DNA, 249 bp, Homo sapiens
  misc_feature (210)..(211): n is a, c, g, or t
  misc_feature (229)..(229): n is a, c, g, or t
ttcgataggtcgacttcgttcctcgactcctcctcaagaatttgacgtttcttccctgctaattccctggttgggcataaacccaattcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711919 - DNA, 105 bp, Homo sapiens
gtgcttagaggatcctttcggattgtgcatctggcaggcccatttttactgcctccatctagttggaaagtcctaaagtactagagggagacacaaacccggaag

SEQ ID NO: 711920 - DNA, 259 bp, Homo sapiens
  misc_feature (72)..(72): n is a, c, g, or t
  misc_feature (80)..(80): n is a, c, g, or t
  misc_feature (82)..(82): n is a, c, g, or t
  misc_feature (88)..(88): n is a, c, g, or t
  misc_feature (220)..(221): n is a, c, g, or t
  misc_feature (239)..(239): n is a, c, g, or t
aggagagtctagaacgctacgggaagtgtgctctactgacctgttgcgtaactttattggaccaccagagcncaccagancnccagancccaccagagcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711921 - DNA, 129 bp, Homo sapiens
tctagaggatcccggctgcgggcatgtcccaacggcgcgcgggtgccctgtagagccgagcccatgctcggtgctgttcgcgcagaagcagccgagcgtagggctcgtgtctaacagtgggtgcctggt

SEQ ID NO: 711922 - DNA, 255 bp, Homo sapiens
  misc_feature (42)..(42): n is a, c, g, or t
  misc_feature (44)..(44): n is a, c, g, or t
  misc_feature (216)..(217): n is a, c, g, or t
  misc_feature (235)..(235): n is a, c, g, or t
gtgataagagtttgtgtcacggagtatgaccgccagcactanantaagagtacaggggaccacggccaccccgcacgcaaaaggcccaccagagcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711923 - DNA, 1026 bp, Homo sapiens
gctgcggagagtgccgcggctcctccgtagacccagcggagcaccttcgtgtttgagtaacctggctggaggtggtggagcgtgtgctcaccgttcctgcccgccaaggcgttgctgcgggtggcctgcgtgtgccgcttatggagggatgtgtgtgcgcagagtattgcggacccatctggagctgtaacctggatctcctgcaggcctggcgtgaggcctggcacaccatggaggggcattgcttggttcgcgtggtacgcagcggagcttgagaatgtacgcatcttacccaaataccagttcgttccaccatggctgcattcagcaacactttccattcagctctggcacagcagtagtcgtgggcccatcacagccagcagccaagggacaccagcacactccagtcatagggcacaacgagccacttttggcccttatgcatgcaacagcctcattccgccacaaaacgaaattgccaaatggtccttatgaggcaattttgttggaccgccagagcgcaattcgtaggtgcactcgcacaatgtgggatccagggtccggcaaatgtccgaagcccttccacgcgaaccactacggacacacgttcgcgacggaacgttggtaggggctaccagttgccgttgtcgtactcacgtatccgccttcgatacactcttgaccacggtgacagtaccagcgcacatcacacaagccaccttatatccagtagttagacgtacaaggggacgtcccaaacagaacgtttgttaaaagacatgtacgtagaagatgagaccaagttcaaaacattatcaaggtttggacaagagcgttacagggtacagtatgatgaagagaagttcaacatcaccctgtaggcaaacttatcgaggatggttgagggtagcatttggagacatatgtggggataaaagtagaattcggctctagtatagcggtttggcggaagagcacatagtatcagaataaatcatttggaaaagcaaaagataaggacag

SEQ ID NO: 711924 - DNA, 229 bp, Homo sapiens
  misc_feature (190)..(191): n is a, c, g, or t
  misc_feature (209)..(209): n is a, c, g, or t
gctgtatctggagaataatatgtttaggtgccatgttatctaatttagtttaagtaggtgaaggtcgggccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711925 - DNA, 125 bp, Homo sapiens
ccccggggttttttttaaaaaaaaaaattttttaccgggggttccctttttgaaaaaccgggggtttggctttaaccccccccctttagaaaaattggcccaaaaaggttggcttccggggccca

SEQ ID NO: 711926 - DNA, 249 bp, Homo sapiens
  misc_feature (210)..(211): n is a, c, g, or t
  misc_feature (229)..(229): n is a, c, g, or t
taagtctagagtaaagggcgccacctactaataggcttggttattacgtacaaaagcttaatttgtaatcaaaattggccaccagatgcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711927 - DNA, 290 bp, Homo sapiens
  misc_feature (19)..(19): n is a, c, g, or t
  misc_feature (24)..(24): n is a, c, g, or t
  misc_feature (26)..(28): n is a, c, g, or t
  misc_feature (32)..(32): n is a, c, g, or t
  misc_feature (251)..(252): n is a, c, g, or t
  misc_feature (270)..(270): n is a, c, g, or t
aggcggtcctgactgttgngtttntnnngatngcgggcgctagatggatacatggattacattcacattcccttcccacgccaaatttcacaacgcatgggaaggcttctgcctattgtattaccaccacccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711928 - DNA, 213 bp, Homo sapiens
  misc_feature (174)..(175): n is a, c, g, or t
  misc_feature (193)..(193): n is a, c, g, or t
gtatgatgatgcaggccatgggtaggttgaccaccagagcccacgagatgccgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711929 - DNA, 214 bp, Homo sapiens
  misc_feature (165)..(165): n is a, c, g, or t
tgttaggggcatcaggtaggtggcagtttggcagccaatgtttaagcgggccagggagtggcatctccacacacagtcacattctccaagtggtggggcagcaattcaaacacagcaacgtatctatcaagtggttgtggcaggcattcacccacagtcaccatntgcatccagtatcagaggttgggagccagtcaaccatcatccaccacat

SEQ ID NO: 711930 - DNA, 94 bp, Homo sapiens
  misc_feature (1)..(1): n is a, c, g, or t
  misc_feature (19)..(19): n is a, c, g, or t
  misc_feature (28)..(28): n is a, c, g, or t
  misc_feature (55)..(55): n is a, c, g, or t
  misc_feature (94)..(94): n is a, c, g, or t
nacttgggatttttttttnaaagacacntttttccatgttcatggcgcacgcacntacccagtcgtttgtattccctttctttcaatccaatan

SEQ ID NO: 711931 - DNA, 178 bp, Homo sapiens
gtggcgacacgtacatggtaggaagttgaagtagattgaataccgagctggtattactccggtctgaactcagactcacggtacgtactttaatcgttgaacaaacgaaactttaatagcgggtgtaccatcgggatgtcctgatccaacatcgaggtcgtgaacggtatagcccgtg

SEQ ID NO: 711932 - DNA, 224 bp, Homo sapiens
tatacagaagatacataataaaataactactaagaaattactagatacactatatattagatcacaagtgtataaattaacttacatatacatgtaaaatctgagccttatcctctattacatcttatgaaccctacagtactgtactacttatttctaaaatagagtaactcatctacaatatctcatatcattatagtcactaaatgaatgtctgctggata

SEQ ID NO: 711933 - DNA, 659 bp, Homo sapiens
  misc_feature (9)..(9): n is a, c, g, or t
  misc_feature (64)..(64): n is a, c, g, or t
  misc_feature (75)..(75): n is a, c, g, or t
  misc_feature (83)..(83): n is a, c, g, or t
  misc_feature (95)..(95): n is a, c, g, or t
  misc_feature (99)..(99): n is a, c, g, or t
  misc_feature (137)..(137): n is a, c, g, or t
  misc_feature (160)..(160): n is a, c, g, or t
  misc_feature (163)..(163): n is a, c, g, or t
  misc_feature (167)..(168): n is a, c, g, or t
  misc_feature (173)..(173): n is a, c, g, or t
  misc_feature (183)..(183): n is a, c, g, or t
  misc_feature (185)..(185): n is a, c, g, or t
  misc_feature (191)..(192): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (221)..(221): n is a, c, g, or t
  misc_feature (230)..(230): n is a, c, g, or t
  misc_feature (258)..(258): n is a, c, g, or t
  misc_feature (311)..(312): n is a, c, g, or t
  misc_feature (342)..(342): n is a, c, g, or t
  misc_feature (351)..(351): n is a, c, g, or t
  misc_feature (357)..(357): n is a, c, g, or t
  misc_feature (413)..(414): n is a, c, g, or t
  misc_feature (426)..(426): n is a, c, g, or t
  misc_feature (437)..(438): n is a, c, g, or t
  misc_feature (454)..(454): n is a, c, g, or t
  misc_feature (466)..(466): n is a, c, g, or t
  misc_feature (483)..(484): n is a, c, g, or t
  misc_feature (545)..(545): n is a, c, g, or t
  misc_feature (548)..(548): n is a, c, g, or t
  misc_feature (555)..(555): n is a, c, g, or t
  misc_feature (561)..(561): n is a, c, g, or t
  misc_feature (573)..(573): n is a, c, g, or t
  misc_feature (576)..(576): n is a, c, g, or t
  misc_feature (584)..(584): n is a, c, g, or t
  misc_feature (611)..(611): n is a, c, g, or t
gctgcaatnagacagagaaaggcgaagaaaaaaaagtggaataaggtaggggaaggaagaaganataaataatgnaggagggnggaaagggaggngggnggggggggggaaagaaggggggggggagccagagggcnccgggggtttagacactccaggnttnggcnncggangcaaccagcntntgaatnnagcggngngnaggggcactggggcgcccngggcctccnactcccccccgtcgtcttcgtacatctngccctcttcctcggccgtcgcgtcctggtactgctggtactcggacaccaggnngttcatgttgctctcggcctcggtgaactncatctcgtncatgcnctcgcccgtttaccagtgcaggaaggccttgcgccgcgaacatggccgtgaaccgnngggagagggggntgaagaggggnnggatggccgtgctgtncccgatgaaggnggaggacatcttgaggnngcggggcgggaccgtcaaaaacggcgcgagcttcacgttgttggggatccactccacgaantanactgccngttctngctctggatggncancatctccncgtccacctccttcatggacatgcggncccggaacacggtggccaccgtcagtaacggccgtcgcgcgggtcgca

SEQ ID NO: 711934 - DNA, 1419 bp, Homo sapiens
  misc_feature (774)..(774): n is a, c, g, or t
  misc_feature (1137)..(1137): n is a, c, g, or t
  misc_feature (1386)..(1386): n is a, c, g, or t
agttgcttgtttagttggcccccgcccggcattggtgagagggatattgtctctgcactccttggggggaaggtgtttccgtttgaggagaggttatattttggtcgccccccgcccccctccctcccccccggtggggggtgagatggccgctgttcgctgtgaccacccagcaacgggggagagtctgctcttttgcttcgctactagctataatgtgaggaagtctgctcctgttgcgggcgccaccgaccacacgagtggtttgttggtgaccgccgctaaggaggactccacatgcgccggtatacaccatcgggctccccgctccggatggtttcccacctttgtggaagaggggaacatatgtttgggcgaccacagaaggtggggcgttcttctaaaaaatgggtgagcaccgtggcccccaccttggggaaatagaaaaaagggtgtgagattgtcacccctcggaggggaccctcctttagattgccccactgggagaaagttttctcggctttcttttataggggcccttcaccaagcggggagaggagagcgtctgaaagagagagattttggcctgtgacacatttttctcgggccttggggttcttctgtggcgccacagtggcgcgcccaccgctccccctttgaagagagagagagacatagacgccacaacaatagtgtgtgtgcgacacacccgcggttgtgagactttctccttggtgcgcccccagcagagagagtgtgagattttgagagagngggccgcgcgactggcgtcacccacactttgagagaaaaggttgtgagagtctctctgtgtgggtgggccgacttttggagagaagtgtcgctctcttcgtctcactgcagagaggctctgtctctgtgtgttgggggagacacacgcacaccccctctttatgagagagagtggctcactgtcacacacctacactcgcagagacccctcatttttcccccgccacttcggctccacaaggttggggacaccctataaagtgttctcccgccgctcttctgtgggccccccacgcggaggcgccacacgcgagctctctcacttctctcgccacacactgtgctctcacgggcactaacacncctctccgcgagaccgcgctctcgcgcaccctcggccccacgtgttctccacgccccacaccctctgggtccgcgcgccacaacttctccgcgaggggtggctgcctccccttcctgccctctcacattctcgtcgccctcgatggttccctcgtcacttcacctccgggtgcgtgtgtttgtatgtctgtgtatgtataggggaaagaagggatccctaactgttcccttatctgttttctacccccncctttgtttaataaaggctgaagcctttttgta

SEQ ID NO: 711935 - DNA, 721 bp, Homo sapiens
ggagacggagtcttgttttgtcgcccaggcgggagtgctgtggcgcgatctccactcactgcaagctccgccttccgggttcacgccattctcctgcctcagcctcccgagtagctgggactacaggcgcccgccactgcgcccggctaattttttgtatttttagtagagacggggtttcaccggggtctcgatcccctgacctcgtgatccgcccgcctcggcctcccaaagtgctaggattacaggcgtgagccaccgcgcccggcccctgatggtattttatagagagcccattagctgtaaagaagtgcctttccttccagatggcagcatgagcatgaaggactaagaaagcatacttggagtcagtgccaatgttagttacttttcccttgcttaatttgagtgctcttgtaagagctatcagttcaattagttgagtgcttgtgcctggagagatgggtgcagtttcaataacatcattcagagggcctacgacatatcctggctaacggactccttgctccacacaggcgtgggccgaatttctggaaccccggggatccactaggtttagagcggcccgcaccgggggggagctccaagttgtggtcctttaaggggggttaattcgagctggcggaaaaaggggaaaagctggtcctgggggaaatggtatccctcacaattcacacacaaaccagccggacctaaaggg

SEQ ID NO: 711936 - DNA, 419 bp, Homo sapiens
  misc_feature (18)..(18): n is a, c, g, or t
  misc_feature (63)..(66): n is a, c, g, or t
  misc_feature (83)..(83): n is a, c, g, or t
  misc_feature (88)..(88): n is a, c, g, or t
  misc_feature (91)..(91): n is a, c, g, or t
  misc_feature (94)..(94): n is a, c, g, or t
  misc_feature (103)..(103): n is a, c, g, or t
  misc_feature (119)..(119): n is a, c, g, or t
  misc_feature (130)..(130): n is a, c, g, or t
  misc_feature (132)..(132): n is a, c, g, or t
  misc_feature (134)..(134): n is a, c, g, or t
  misc_feature (136)..(136): n is a, c, g, or t
  misc_feature (138)..(138): n is a, c, g, or t
  misc_feature (142)..(142): n is a, c, g, or t
  misc_feature (144)..(144): n is a, c, g, or t
  misc_feature (148)..(148): n is a, c, g, or t
  misc_feature (153)..(153): n is a, c, g, or t
  misc_feature (155)..(155): n is a, c, g, or t
  misc_feature (160)..(160): n is a, c, g, or t
  misc_feature (163)..(163): n is a, c, g, or t
  misc_feature (166)..(166): n is a, c, g, or t
  misc_feature (170)..(170): n is a, c, g, or t
  misc_feature (176)..(176): n is a, c, g, or t
  misc_feature (182)..(182): n is a, c, g, or t
  misc_feature (189)..(189): n is a, c, g, or t
  misc_feature (194)..(195): n is a, c, g, or t
  misc_feature (197)..(197): n is a, c, g, or t
  misc_feature (204)..(205): n is a, c, g, or t
  misc_feature (209)..(209): n is a, c, g, or t
  misc_feature (216)..(217): n is a, c, g, or t
  misc_feature (221)..(221): n is a, c, g, or t
  misc_feature (230)..(230): n is a, c, g, or t
  misc_feature (233)..(235): n is a, c, g, or t
  misc_feature (239)..(239): n is a, c, g, or t
  misc_feature (241)..(241): n is a, c, g, or t
  misc_feature (245)..(245): n is a, c, g, or t
  misc_feature (252)..(252): n is a, c, g, or t
  misc_feature (254)..(255): n is a, c, g, or t
  misc_feature (262)..(262): n is a, c, g, or t
  misc_feature (265)..(265): n is a, c, g, or t
  misc_feature (273)..(273): n is a, c, g, or t
  misc_feature (294)..(294): n is a, c, g, or t
  misc_feature (300)..(302): n is a, c, g, or t
  misc_feature (386)..(386): n is a, c, g, or t
aatgagaaggtggatctntggtgcattggagtgctttgctatgagctgctggtggggaacccnnnntttgagagtgcaccacncaacnagnccnatccccccncccccaaggtggaccnaaagtcccccncntntntncccncnggancccangnccccntcnccnaacngcccangcatanccccccngaacnncnccccctnncccnggtcccnncccncccctgggnccnnncccncncccngagggcncnnccccccnccnccccccancctcccccccgatggcccctnccattnnnccgggtgcgtgtgtttgtatgtctgtgtatgtataggggaaagaagggatccctaactgttcccttatctgttttctacccccncctttgtttaataaaggctgaagcctttttgta

SEQ ID NO: 711937 - DNA, 335 bp, Homo sapiens
cttgaacctgggaggcagaggttgcggtaagcctagatagtaccactgcactccagcctgggggacagatagcaaaactctgtctcagaaaaaaaaaaaaaaacaacaattttttttttttaattaaaaattactttattactaaaaaatgcaattgatcatctgatcgtacccttcggcaatttataatgttttggctgtgggaaggtctggccttgatgtccatgtctgctgaccgatgagggtaagtagttgctgaaggctagagtggctgtggcaattccttaaaataataactattaatacaatgtagttttctgctattgatcgatcct

SEQ ID NO: 711938 - DNA, 135 bp, Homo sapiens
  misc_feature (2)..(2): n is a, c, g, or t
  misc_feature (12)..(12): n is a, c, g, or t
  misc_feature (109)..(109): n is a, c, g, or t
  misc_feature (126)..(126): n is a, c, g, or t
cnctgtggagtnaagtaaaccggtatggccagaacggcgacttcacgcgcgctctcaagaccgtcaataagatactacagatcaacaaagatgacgtaactgccctgcnttgtaaagtggtatgcnttatccaga

SEQ ID NO: 711939 - DNA, 461 bp, Homo sapiens
  misc_feature (16)..(16): n is a, c, g, or t
  misc_feature (49)..(49): n is a, c, g, or t
  misc_feature (451)..(451): n is a, c, g, or t
gggccccgcctcctanaaacctagtgggatccccccgggcttgccaggnaattccgggcaccgaagaaatccttgaaatattaaacaaatggttttttgacccccttcaaaaggggcccatagtaccataaacagatatataatacatttgtggcattaaagtttccctaggggtggctgggtagcgtggctcatgcttataattccagcactttgggaggccaaggcgggtggaccacttgaggtcaggagctcaaaaccagcctggccaatatggtgaaaccctgtcttttactaaaaacacaaaaattagctgggtgtggtggtgcatacctgtattcctagctacttgggaggctgaggcacgagaattgcttgaacctgggaggtggaggttgcagtgagctgagattgcaccactacactccagcctaggcaacagagggagccncctgtctaaa

SEQ ID NO: 711940 - DNA, 191 bp, Homo sapiens
caccctagcatcattctactatcaccattactaactaagctggctctttaacctctccaccctcatcacaacacaatgaacacctctgattactcctgccatcatgacccttgtccataatatgatttatctccacactagcagagaccaacctaacccccttcgaccttgctgaagggagggcccgaact

SEQ ID NO: 711941 - DNA, 276 bp, Homo sapiens
  misc_feature (101)..(101): n is a, c, g, or t
tgtggtcgtctctagaggtatcccccctgatctcgtgatccacccacctcggcctcccatggtgctgggattactaggcattagccaccgcgtccgggctnaattagctctttctttatggaacattggattccccggcataggctacatcgtagaacttcaatcacattggaattgagggagtttcgagacgttccttggcgcaaaaaggtggccctgcagtgaaacaggcggttaggcatttgtaagagttcccagcttggctacatcatggca

SEQ ID NO: 711942 - DNA, 133 bp, Homo sapiens
cggaagataccctgagggtagggactgtgtgtagtctcccttgagttcccagaactggaacacagtaggagcttaattgaagttgccagatgaatgactgacacgtctttctttggtagagattctcagtacc

SEQ ID NO: 711943 - DNA, 238 bp, Homo sapiens
ggggggccccccccccccgggggggggtttttttccccccaaaaaaaaaaatttttgttttcggggccgggcccaatttgttcaaaaaagggggggccccccattttttcccaaaaaaaaaggttttttcccgcccccgggggccccccggtttgggtttttttttgggaaaggggtttttcccccccaaatgggggttttaatttttttaaaaccccttttaaaaaggggcccccca

SEQ ID NO: 711944 - DNA, 106 bp, Homo sapiens
gtgtcgaggggtcgcattttcgcgcgcccagcattcacggtgtggctccggcggccgcggcgtatccgtgtactccgtcccgctttgtgtcctcgtcctcctcggg

SEQ ID NO: 711945 - DNA, 399 bp, Homo sapiens
  misc_feature (230)..(231): n is a, c, g, or t
  misc_feature (249)..(249): n is a, c, g, or t
  misc_feature (288)..(288): n is a, c, g, or t
  misc_feature (306)..(306): n is a, c, g, or t
  misc_feature (375)..(375): n is a, c, g, or t
  misc_feature (386)..(386): n is a, c, g, or t
cacgaaagttatatggaacctcaccactctttgggcaccattttgtgctggaaaacccagggaccatcaaagtggccgaccctgtgtacctgctccgccagtaatgggaaccgcctgtcctggaatattagaccgccttttaaaaatgttcccaaaaatgacaacacttgaccgcatggtgtttcagaactgagacctctacattttcttccaaatttgtgattttcacnnttttcgtcttttggactnctggtgtctcaatgcttcaatgtcccagtgcaaaaagtnaagaaatatagtctcaanaacttagtagggacttcagtcaagtcacttaaatggacaagacaggattctggaaaactccccggtttnaactggatttngggaatagtttct

SEQ ID NO: 711946 - DNA, 519 bp, Homo sapiens
  misc_feature (61)..(61): n is a, c, g, or t
  misc_feature (168)..(168): n is a, c, g, or t
  misc_feature (201)..(201): n is a, c, g, or t
aggcaagaggcagggacgaattgtttaccccatgataatgtaggatatcataaattcttcntcaaaggttttagcctgtaatttgttaagtacattgagttctgagatcctccccaaagaaccaatgaacaagtatgttcagctcacctgttctttgttattcatttnaacttttaatttcctcattctttatgtctccangcccctagtttcagtaaacaatcccctcctagcctctgtcacctgctctgacctgagtcacctttagtcacctggtccgtaaccatctttcctgtctaaacttctcaccccaccactctggcttaaacccctgctctctttaaaatagccagtcagaattagcttagaccgcacaaaaaaaccctagcccatagaaaaaaaacacagcagtagggggtacctgcatcagggataagaacccattcccctcccttgttccggtgtgctctcgccattgcaccatccatgagacgcactccttgtatagaagtaaaattg

SEQ ID NO: 711947 - DNA, 254 bp, Homo sapiens
  misc_feature (141)..(141): n is a, c, g, or t
cggctgttctagaggatcccttttgagatggaatctaggctctgtcgccagcctgaagtgcagtcgtgtgtttcatgcgcgtcgtgtgaagagaccaccaaagaggctttgtgtgagcaacatggctgtttatttcacctngggtgcatggcgtggctgagtcctgaaagagagagtcagcaaatgggagtttgtcatcatgtagacctgtgtcttatgagacaatgctaaagttgagtcccatcaggcgtgaa

SEQ ID NO: 711948 - DNA, 170 bp, Homo sapiens
ttagaggatcccccgcatcggcgtaggtcagcacctggtcgtcatggtcgaacttgacgtgggtgccgctgtagctgaggtcggtcaggtagaagtggccgctgtgcgattcgacgcgggcatgcgagcgcgacacgcgcgaatcgctgacacagaacgaggcttgcggg

SEQ ID NO: 711949 - DNA, 104 bp, Homo sapiens
taaatctatatgagacaagcatatgctactggaaggggtgccgatgaatagcgcggtgccgatgactagcagagtgccgaagaatagaagacggggctcctact

SEQ ID NO: 711950 - DNA, 403 bp, Homo sapiens
tctacagatccattctgcacccacagcgtggattggactggaagagtgggagggcaggtggagaaggcattgtgctgcagtggggagcagcctgggccagccagtccctgtgcctgacagtgtatgcatgatgatggtcacttctgggcgcaggatgacaggtactggttgtcttcaccatggcgataatgaggaggcaccggtcagcaggaaggtgggccagaacgagggagaagaggagggcctggggcccgtagaggcgctggaataggacgctggtctcgtcccccccgaggtgcggagaagcagtagaagacctgctgctcttggaatttggctctgaccttctccacgtcggcccgggccgtttggtaattgtccacgctgcctgggatgtaggagc

SEQ ID NO: 711951 - DNA, 310 bp, Homo sapiens
aattgtggtatatttcatttaaaatcgatcaaagacagcaacatacattaatcagaggaaagcatcaattaaatgcagaaacaagatttaaacaaagattcatattaaaacaatgataagtaatacttagaaactgcatcctagagacacatcattcgcatttttagaaaaacagaaacatattagtgtgaaaagatgttaaaaaatgaatattaaaccgtcgagcacaacacactacgccgataacaatacaccacaagcgccgtaatcctgccgacactgacacactacaggcgtcgtggcgatccga

SEQ ID NO: 711952 - DNA, 563 bp, Homo sapiens
acctatgttcagaagttcaagcgtgagttaagcaccaagtgggtgttgaatacagtgagtactggggcccatgtactgctggggaagatcctacagaaccacatgctggacctccgcatcgccaactccaagctcttctggagggcgctggccatgttgcagaggttctctggacagtccaaggctcgctgcattgagagcctccttcaagcaatccactttcctcaaccactgtcggatgatgtccgcgccgctcccatctcctgccacgtccaggttgcccacgagaaggaaaaggtgatccccacagccttgctgagcctcctactccggtgctccatctctgaggctaaggcacgcctgtctgcagcttcttcagtctccgtccacttccaaggggacatgtgccagcagtacacgctgtgggaagaactcagtttcgggtgggtggggcctaactgcccagaattggggaagagccctgttctcaaccggattatttccatttttactggtgtcttctgaactcagaaataaaactaaatgtcttgttttggaacata

SEQ ID NO: 711953 - DNA, 545 bp, Homo sapiens
  misc_feature (198)..(198): n is a, c, g, or t
  misc_feature (372)..(372): n is a, c, g, or t
  misc_feature (407)..(407): n is a, c, g, or t
  misc_feature (461)..(461): n is a, c, g, or t
gattcgaagcggacggtggtgtgtcgagtgtagagtgtgtaagcagatttgctggtcatggagacgctctcagtctgagaatatgacattcgtaagccatgggagtccagtattgggggggcaatggtgcagcgacgcctgccgggggcttaaaccgcgcccaaattggccccaagccccgccaaattttttgggggnaaaaaaaaggccaggacccggtttgggaaaggggggcgatcacctctagatgcctactcgattcaaggacaacacaccatttctccgctcgatctggccaagctgaaccaggtggcaagacaacagtctcactttgccatgaatgcaccggggccgcgcgcaaccccccccggngggcaaatttttccgccccgggaaattgactccangctctccagaggtgaaaggctattgggcaagtttggatgcatctcactcaaaanccaaaccgcgagttgggaaaaccgttcaagacgcaattttccaaataacttaattggctgcataatcgggcgccaaggcgccaa

SEQ ID NO: 711954 - DNA, 259 bp, Homo sapiens
  misc_feature (138)..(138): n is a, c, g, or t
  misc_feature (156)..(156): n is a, c, g, or t
  misc_feature (173)..(174): n is a, c, g, or t
  misc_feature (217)..(217): n is a, c, g, or t
  misc_feature (225)..(225): n is a, c, g, or t
  misc_feature (257)..(257): n is a, c, g, or t
gaacgggtgatgggtgggaatggtttaatctcttcaagtcgagccagtggttataaagccagacattattacccactcattaactccctgttagggcttggccctgtgggcagagctccccgtgccagcccaatccanaagtatgacgagtggtgntgacttccatgtacacnnagttgggtcacctcccctagaccctggacaatcccctttctcnccatctgngtgagaagggagttcagtgtggctggggtacncg

SEQ ID NO: 711955 - DNA, 538 bp, Homo sapiens
tgagtggagtttcgctcgttttgcaggctggagtgcagtggcgtggtctcgactcaccgcggcctccacctcccgggtttaggtggttctcctgcctcagcctcctgagtgtctgggactgcaggcatgagccaccatgccagctaattttggttttatttttttggtacagacggggtttctccgtgttggtcaggctgatctcgagctcctgacctcgagcgatacgcccgcctccgcctccctgggtgctgggattgcaggcgtgagccaccgcgcccccggtccaatttagtaaccagaaaggaatagatctgcctggcgtggtgcctcccccctgtgatcccaggactttggaaggccgagtgtggcagatcgcttgagcctaggagttccagaccgcctgggcaacatggtgaaacccggtctctgttttgagacggagtttcacccttgttgtccaggctggagtgcaatggtgtgatctttgcccaccgcaacctcgggctccccgattaagggattctcctgcctgggc

SEQ ID NO: 711956 - DNA, 190 bp, Homo sapiens
cacacagtactaggagacaagcacaggatgtagaggtctattcggcataatcttctccctcataatacatcttcaccatcaacagagagagcagcatacttagcttgccagaactagaactataaaaaactggatttaacctacaagttaactataggctcaggatgcagatactggagtacttagatcc

SEQ ID NO: 711957 - DNA, 967 bp, Homo sapiens
gcagctccagagcatgggatgcgggataaatgaccgggtgttgggctcctcgttccatgccgagccggtccccacaagttgagagagtgtctccccctcatcattttcctgaggaagcagacttaagtatgccctgacaggagatgaagtaaagaagattggcgatgcgagcggttcgattaaaatcgatgggaaggtccgaactgatataagccgtaccacgtggctggattcatggatgtcatcgagacattgacaagacgggagagaatttccgtcctgatctatgacaccgaagggtctgctctgctgtacatcgtattacaccgtgaggaggccaagtacgagttgtgcgaaagtgagaaagatctttgtgggcacaaagaggaatccctcatctggtgactcatgatgcccgacccatccggtacccgatccccgcttcatcaaggtgaatgataccatgtcagattgatttagagactggcaagatgttagccttgatttgcatcaagttcgagacctggtaacctgtgtatggtgactggaggtgtaagcgaggaaagaatggtgtgatcacaagtagagagaggcacctggatcttttgacgtggttcacgtgaaagatgccaatgggaaagtttgcactcgacttgccaaacatagcgttatgggaagggcaagcaagaccatgggattctcttccccgaaggaacgggtatccgctcacatggtgcagagagaggcgaaagactgcgggcaaacagagcaggcgtgaacagggtcccgggtggactggcagatccttgtccgtcattcaaaaagatggggcggttaaccgcaaaaaaaaaaggggggcgggcgaaagatccgagggcccagcaggtcaccactgggcaagggcaaaggcgtaaaacagcggggtaaacggagaacagacggtcggggaactcgggaggacacaaaa

SEQ ID NO: 711958 - DNA, 456 bp, Homo sapiens
  misc_feature (169)..(169): n is a, c, g, or t
  misc_feature (238)..(238): n is a, c, g, or t
  misc_feature (277)..(277): n is a, c, g, or t
  misc_feature (297)..(297): n is a, c, g, or t
  misc_feature (321)..(321): n is a, c, g, or t
  misc_feature (352)..(352): n is a, c, g, or t
  misc_feature (362)..(362): n is a, c, g, or t
  misc_feature (441)..(441): n is a, c, g, or t
tcgagctcgggaccccgctcttgctcccatcagactcttcccgtcctcagggctgtcctcaaatgggacttgggccttaagtgaatcaaactgtgtatctcccaaaagtcatttttttttttttagcagaaaataaagtaccttaatttatccacccacagaaagtttncagatggggtgggaaggaatggagagagaatgtgtctatgagcttccagcgctcatctctgcggctcanaagccatcaatagctcgaacagaaaacgtcctcacatcngtcacacaaacacaccccanggaaccaaaaataaaccccacacngatgaaagccagcatgtcgaaagataatttnagatctattngaagactgcagagactgtctcgctgaaattttaaaaccacaccaccagaatacccaaccccttatgattatgctcagcnctgaggggacgcagg

SEQ ID NO: 711959 - DNA, 111 bp, Homo sapiens
  misc_feature (1)..(1): n is a, c, g, or t
ntagcagcgcagcacataatgccagatccccaacctactaagcgaagccagggattgaacccgcagcctcatggttcctagtcagattcctttcccctgcaccacgacggg

SEQ ID NO: 711960 - DNA, 242 bp, Homo sapiens
tgtcgaccctagaaggatcagcctaatttcctttggacttgcgggtttgatggtaaatatggggctgtaaatggtcagtccagtgtttaaatctgacgcaggcttatgcggaggagaatgttttcatgttacttatactaacattagtcctcctatagggtgatagatgggcccaatggggtatgaggagttcagttatttttttgtggggggttcccgagcctcgattcgtatctcattgg

SEQ ID NO: 711961 - DNA, 247 bp, Homo sapiens
  misc_feature (58)..(58): n is a, c, g, or t
  misc_feature (208)..(209): n is a, c, g, or t
  misc_feature (227)..(227): n is a, c, g, or t
gttattcgctgcggtgactaggcgtaatgttgcatgggctcggtagtagagtatggancgattggaggtaacgttggtccggtggcaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711962 - DNA, 138 bp, Homo sapiens
actgtgcaagtctaggagtacctgataacgctaacgctcatgcgggtctgcttggaaattgctggcggcttcaatgacgttctatcttcatacaatttccaagcagacccgcatgaacgttagcgcaatcagggactc

SEQ ID NO: 711963 - DNA, 256 bp, Homo sapiens
  misc_feature (129)..(129): n is a, c, g, or t
  misc_feature (154)..(154): n is a, c, g, or t
  misc_feature (206)..(206): n is a, c, g, or t
  misc_feature (232)..(232): n is a, c, g, or t
  misc_feature (246)..(246): n is a, c, g, or t
acccagaccaggctcgacagctgaccaaggccatgatgagaaaggccaaggccagccgcctggtcacgcagcgagatggggaggtgcagaacttagacagcttcatctccaaagaccccatccagaagnccccgcagatgaacatagagaggcncaaagaaaaaaaaggctaacgattgggatgccacaggctaacggccacacgngcccctgtgggtcccagggaggtcgnaaacaaggattttncaacttaaaa

SEQ ID NO: 711964 - DNA, 211 bp, Homo sapiens
  misc_feature (172)..(173): n is a, c, g, or t
  misc_feature (191)..(191): n is a, c, g, or t
ggtgtgattgatagaaagcaataattggaaacaacagctgaagcctacattccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711965 - DNA, 182 bp, Homo sapiens
gtgtatgtcattaatccctacaaatctgagttaagtaactttcccaaggtcacaggactgttaagctgtcagagccaagctttgagatgagatttcgacgatcagacggcttgctcctgtcgccacaggctggcagtgcactggcagcagatctcagactcagatgcaaccctctgccatcc

SEQ ID NO: 711966 - DNA, 837 bp, Homo sapiens
tactggtgcatctttagcactagacgattgctctgcaggaaagcacacggaccttcgaacgtacccgaaatctgacttggacgtgacgagagagacggtatgaggagcgcttcggcctttcatgacgagaacattcgctccagtcgatgtcattgatacattgaagtacctttctgacctcgagaacgagaacgccagatcgtttctgcaagaagagcgtcgagttctctaggagatttcatctacggaatgccgattgggaacgacagacatcgcggagtaatgaaagaggctatagaacagatccccatcttacatagttcaggagctctgggagagagagctgcgaggtatttaacgcttataccgcaacaagacaagaatacgatactctcatctatcgtggattctgtaattgctgtgaccaaggcttgcactggatcagtaacctgtggtactatccgacaaagtctagggcaccagaatgcagttcagtgcggcaagcttctgcaggcgtggagtctgtatatctctattgtattggccaggtacggtgtcggtttgctctctcctgcttgattggtgattgctgaggaatacgtatacttagtgagtcaccaaaagcataatcgatgatagatgctcgatacagacattgaggaagctgccttcgaagacagtggagtgactccattccatcaagtcgagggatcgtgacccctagggtgaaacctgatggggtctgtgttactaacatttattccgtacgaccctgtaccaggagctaccagtacctgttgtaacttgggctggaaacagaagatataaaagggcaag

SEQ ID NO: 711967 - DNA, 551 bp, Homo sapiens
  misc_feature (16)..(17): n is a, c, g, or t
  misc_feature (512)..(513): n is a, c, g, or t
  misc_feature (531)..(531): n is a, c, g, or t
aagcttcctattgggnnctttggctgcaatgaggatttgtgcgaacagctaatcttttgaacctattatgcttggctgtgagtgttgggacatacggttactccaattatatcagtacgctgccgaagttgacctggtggtgtgatgatgcagcccaggggtaggttacatatgtcgtccatagggtttgctatgtcaatttagaagcacccacggtggattggtctaaccacggaatactaatgtggacgagcccggtcacgctacccaaagcgttcatcacgcgtgccaagcaaaagtttagtacgacgacacaacaacttgaccaggattactatgcagtcgcgccggttctgccaatgcgtgaaacagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711968 - DNA, 953 bp, Homo sapiens
  misc_feature (54)..(54): n is a, c, g, or t
  misc_feature (82)..(82): n is a, c, g, or t
  misc_feature (94)..(94): n is a, c, g, or t
  misc_feature (96)..(96): n is a, c, g, or t
  misc_feature (110)..(110): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (126)..(126): n is a, c, g, or t
  misc_feature (145)..(145): n is a, c, g, or t
  misc_feature (147)..(147): n is a, c, g, or t
  misc_feature (153)..(153): n is a, c, g, or t
  misc_feature (158)..(158): n is a, c, g, or t
  misc_feature (164)..(164): n is a, c, g, or t
  misc_feature (214)..(214): n is a, c, g, or t
  misc_feature (216)..(216): n is a, c, g, or t
  misc_feature (220)..(220): n is a, c, g, or t
  misc_feature (241)..(241): n is a, c, g, or t
  misc_feature (255)..(255): n is a, c, g, or t
  misc_feature (280)..(280): n is a, c, g, or t
  misc_feature (292)..(292): n is a, c, g, or t
  misc_feature (299)..(299): n is a, c, g, or t
  misc_feature (303)..(303): n is a, c, g, or t
  misc_feature (363)..(363): n is a, c, g, or t
  misc_feature (376)..(376): n is a, c, g, or t
  misc_feature (378)..(379): n is a, c, g, or t
  misc_feature (385)..(385): n is a, c, g, or t
  misc_feature (390)..(390): n is a, c, g, or t
  misc_feature (397)..(397): n is a, c, g, or t
  misc_feature (407)..(407): n is a, c, g, or t
  misc_feature (422)..(422): n is a, c, g, or t
  misc_feature (426)..(426): n is a, c, g, or t
  misc_feature (443)..(444): n is a, c, g, or t
  misc_feature (447)..(447): n is a, c, g, or t
  misc_feature (450)..(451): n is a, c, g, or t
  misc_feature (457)..(458): n is a, c, g, or t
  misc_feature (463)..(463): n is a, c, g, or t
  misc_feature (467)..(467): n is a, c, g, or t
  misc_feature (469)..(469): n is a, c, g, or t
  misc_feature (472)..(478): n is a, c, g, or t
  misc_feature (484)..(484): n is a, c, g, or t
  misc_feature (487)..(488): n is a, c, g, or t
  misc_feature (490)..(491): n is a, c, g, or t
  misc_feature (504)..(504): n is a, c, g, or t
  misc_feature (540)..(540): n is a, c, g, or t
  misc_feature (562)..(562): n is a, c, g, or t
  misc_feature (566)..(566): n is a, c, g, or t
  misc_feature (924)..(924): n is a, c, g, or t
agcagaagagttttaattgcttggttagtattaatgttttttggttttcttctngggtgggaagtagtgtagctaagtatanatttcctttgantntatggctggaggtnctgtgntncgnatccntgcgtgtggggggtggaangnctgagnccatnatctgngtgttttgtctttaccatggcgcagtatccagatgtttagaaatgtgggntnattngcagtggtgttctttttttcntttgggtgttttgngtcacttggattttttgccttgctnttcttcttaatncgttgtnacantgcactaaaatagcttgaaataatagttgtcgagtttttgtcctcgtgcgcagttttgcnatttctgtgtgtncnncgagtngcccngttgtgntctctatctnaagttcttatcgagntaantcttatctctagggagnnttnacnntgtttnntcacnatgntntannnnnnngggttnttnnannggacacgggaggnggagataaaaatacttaatccaatccctttttagtnattgattgaacatcttccaaantttngaagacgagaaaattgaaaactctttggccattggagaggtatagacgttaactgcaggtgtctgcctgttccttgacctcaactcagaagtaaaattaagagttaagagtaattaattctaccatttaagccagaaattgaaatctctaatactatttcctaggataaaattgtgaaaccaaatagtgtgtatcagcaattctgaatttgaaattccatatattgatttttccataaaatattttctgcactcagagatatatcaaatagatctgctaatgtaggaaaaaacaaagatacaaatttgcttatataggattcacaatagggtaagaattactagcagcatctttttgntttgattaggcttttcctttccttttaaa

SEQ ID NO: 711969 - DNA, 517 bp, Homo sapiens
  misc_feature (16)..(17): n is a, c, g, or t
  misc_feature (478)..(479): n is a, c, g, or t
  misc_feature (497)..(497): n is a, c, g, or t
aagcttcctattgggnnctttggctgcaatgaggatttgtgcgaacagctaatcttttgaacctattatgcttggctgtgagtgttgggacatacggttactccaattatatcagtacgctgccgaagttgacctggtggtgtgatgatgcagcccaggggtaggttacatatgtcgtccatagggtttgctatgtcaatttagaagcacccacggtggattggtctaaccacggaatactaatgtggacgagccggcgcttcgtgatcggccgatgggggctcgtcatctagacggtctaaccttcttgtggcttgcaagatttcacaccaggttaaagataccgaccagatgccgccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711970 - DNA, 574 bp, Homo sapiens
cgtctgcccaggagggcgcttggatttccttctccgcggcgcgtatctaacccttcctgcatgtatttcactgcaggctgaagaaagctcagtctcaattgtgtttcctgcctgtcagcctcttgcctcctaaacgtgtaccatttccacttgatgtcatcacgcagaaggggtgaaagagactcggtgacagatacagaaatgaacacaagctgtgagttactggatgcctgttgagacttgccattactctgcactggaaagacacagggcggtggcgctctgagaagcagactccttccccttcacctgtggtcttgcccttcctgctcacggtccaccatggagacagcgtgtcccaggactctcgtgctggaatgtcagatctgtattcaatgactacagcccccggcgcaggcccaagtagtctggactgcaagcacacctgctgttcatgtgtgcctgacagacagatgaggaccagccagaaggatgtgcgggtgcccctggtggcgtggtgtcaccaagctgcactcccgagcattctccgtgtcgcagcgtcccggacgagccg

SEQ ID NO: 711971 - DNA, 122 bp, Homo sapiens
attaggcgcgttctgcgtgacccagtagtgaccgggatagaggtctgagcctggaaaggcagctgtgagggtatttctctacaagatgtagcttgagagcttgtacgcagaacgcgcctaat

SEQ ID NO: 711972 - DNA, 410 bp, Homo sapiens
  misc_feature (16)..(17): n is a, c, g, or t
  misc_feature (371)..(372): n is a, c, g, or t
  misc_feature (390)..(390): n is a, c, g, or t
aagcttcctattgggnnctttggctgcaatgaggatttgtgcgaacagctaatcttttgaacctattatgcttggctgtgagtgttgggacatacggttactccaattatatcagtacgctgccgaagttgacctggtggtgtgatgatgcagcccaggggtaggttacatatgtcgtccatagggtttgctatgtcaatttagaagcacccacggtggattggtctaaccacggaatactaatgtggacccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711973 - DNA, 376 bp, Homo sapiens
ctcgcttagaggatccctggagtgcggcggtgcaatctcgtgctcactgaactctgcctacccggccttagtctccccagtggctgggattacagtgctcaccaccgcgccagtaattttgtattttggcagagacaggatttcaccctgttgaccagagctggtcttgaactcctgacctcaggtgatacacccactttgggaggccaaggcgggcagatcacaaggtcaggagatcaagaccatcctggctaacacggagaaaccccatctctactaaaaaatacaaaaattagccaggcatggtgatgcacattttgtaatcctagctactcgggagactgaggcaggagaatctcttgaacctgggaggtgc

SEQ ID NO: 711974 - DNA, 450 bp, Homo sapiens
tgggtcaagagctgaagcgaccgtccacctccttcttcctcaggttgaggacttgagggtttctaaagggccctgaacaccacccaccctccccaacccaccgcttctccgtccctccgttgccttcatcgacgtccgcagaattcagattctgaaggtgggcgtggatgtcatttggccagagccgggcttttgataagctctaagctcacgggctgcctctggagggaacagctcagggggctccccacgcccaaacatttgcctctcactgtggctacttcaagaggaacgagccatgcagagggacgggtgagttccaagaagcaccagaacccctgggaactccaagcacatatctgggtgtttgggtggggttttgggggattttttgtttctgcttttgttttcagacaggatctcgctctgttgcccaggctagagtgtagc

SEQ ID NO: 711975 - DNA, 459 bp, Homo sapiens
gctaacccggcgcggggggttcccctaggggagagcccggatgggtgaaccccttccggagaggggggtttttttctccccgcgggggcccggcgcctttttttttaaaatttttccccccccccggggaggaaaaatcccccggggggggggaaatgcccttttaatatttttccgcggaaaaccccccgggggggggggggtttttttttttttataaagggtgccccccccaataaaaaaaaggggggggttttccctttttgggggggggtttttttttttttttttggggttgggcccccccctttttaaatttgcccccccccctttttaggggggggggtttttttgggccccctttttccccctttcccctttaaacccggggggggggggaatttcgggtttttttgggcccgggcccccccataatcctttgggggtttttttttttta

SEQ ID NO: 711976 - DNA, 397 bp, Homo sapiens
  misc_feature (358)..(359): n is a, c, g, or t
  misc_feature (377)..(377): n is a, c, g, or t
ggacgctaccattgggacttggctgcatgagctcgtcatctaaaaacgattaatcgacatcctataattagatgaacacggctgcggaatgttggctcaaccgaacaatgtttgtaggagcccggtcacgctacccaaagcgttcatcacgcgtgccaagcaaaagtttagtacgacgacacaacaacttgaccaggattactatgcagtcgcgccggttctgccaatgcgtgaaacccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 711977 - DNA, 247 bp, Homo sapiens
aaattttgaaattgaaaagggggaggttttggggcccaaaacccttttggggggaaaactttgtttttgttttgccccggaaaaaacaataggccgggggtttgtttttgggagggtaacaaagaaagctttttttttttttttttttaaaaggggcccattttcccccccgggaaaaaaatttctttggagggtggtttggcccccagggggtggtttttttaataaaatttttcccctaaggcca

SEQ ID NO: 711978 - DNA, 392 bp, Homo sapiens
ggtttataaaataatgggggtaacccttgttgctttcctgaacccagcctgtttcccgtggttggttagaatatattttgttttgatgtttaaattggcatgtttagatgtcaggtttagtcttctgaagatgaagttcaccccttttgtatcaaccagcccaaccagggtctgtccctttccacgcataaagtttagtgagatgttatatgtaagatcgatttcgctagttctcccctgtagagttataaatggaaagattcccctatctgattaatagtttcttcatcctccgcatataatttgtggctcccgaatattgtaatttgttgccccctatgtacccaaccccctgaaaatatgtttaataaatattgtccttattggaagta

SEQ ID NO: 711979 - DNA, 378 bp, Homo sapiens
agcccggtaatcgcataaaacttaaaactttacagtcagaggttcatttcctcttcttaacaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaacaatatagcccctttggcccaactcaatttaaaattaaaaaaattttttaaatgggcccaaattaaggctcaattggaaaaattcccctaaaaggggtctaattataaaaaaatggcccgtgtttaaaaaactttgaaatggaaacccttgtgttacctctctttg

SEQ ID NO: 711980 - DNA, 477 bp, Homo sapiens
ctcttttgcccagactggagtgcagtggcgccatctcggctcactgcaacctacacgtgcctggatcaagcgattttcctgcctcaagcctactgagtaggtgggattacaggtgcacaccaacacacctggctaactatttgtatttttagaagagactgggtttcaccatgttgggcaggctggtctcgaactcctgacctcgtgatcctactgcctacagtctcccaaagtgctgggattacaggcgtgagccaccgtgcccggctgctcattgataaatgatggaaacttctaacaaacttgccttttggttagtaaatgctagcttttaacatgccacctttaagctgttctgtgcttagatatcgaaatcaaaatgatctttcgggttgattgtctatcaagctctcttggtagtaagataattaaggtatagatatctggggggatctatctatttgcaagaaataatac

SEQ ID NO: 711981 - DNA, 892 bp, Homo sapiens
gggtggacgaagctctctctagaaagacatcctgagaggacttggcagactccaggttcttcagttttggaactcaaactggctctccttgcacctcagcctgcagatggcctattgtgggaccttgtgatcatgaagtcagggaccctgaatggagggatcggccagagctgaggcagaagaacataaattgtgaagatttcatggatatttatcacttcccaaaattaatacttttataatttcttatgcctgtctttactgcaatctctgaacataaattgtgaagatttcatggacatttatcacgtccccaattaacactcttatagtttcttatgcctatctttactttaatctcttaatcctgttatcttcataagctcagaatgtaattcacctcaggactactattgcacaaatggattgtaaaacatgtgtgtttgaacaatatgaacatcagtatacctggaacaaagaacagaatatcagtgattttcagggaacaatggaagataactataaggtctgactgcctgcggggtcgggcagaatagagccatatttttcttcttgcagaaagcctatagaaggatgtgcaagtaggagaaatattgctgaattcttttcccagcatggaagaaccctggggccaggaatgcattcctgggggtaggtctatagatggcctctctgggagtgtcgtcttatgcggttgagataaggactgaaatacgccctggtgtcctgcagtaccctcaggcttactaggattggggaaaattccagccggtaaattctagtcagagtgggttctctgtactcaaaccctgttcctgtgacgcatgtttcatcaagacaatgtgtgcccagcaggacacatagacctcac

SEQ ID NO: 711982 - DNA, 186 bp, Homo sapiens
cccggatctacggaacatatacgtttcatctccttacggagaaagcagctgcagaggttctgtatttcctgaattaccttaaaacccagtaagagtaagacctgttgttttggaaggtctgctccaccatctaagagcactgtatatatattttggatggtagttgtgggggaacccttcataaag

SEQ ID NO: 711983 - DNA, 920 bp, Homo sapiens
gagacgcgtgggtgtaactgaaaaatcggaatatctacccagctatctataagggttgcgttgacagcattatagcttctggccaaactagagagaagcaagaaacgtgcaatgttcccttcggtcttcgatggggcacatcgtctgagatgctgacatttacatgctgcgtcttcggcactgcatgaagtagaaaacactcccatgtgtagcatcaccagagcagccctgaggcgaagtactcgcacaagtggcggacagcgggacagtcaccaaacaccacgagactgatgacatgggaaagggtgttttccaagaatgaacatcacattttcagtctgtctctaagatgcttactactgaccaagtggtttacgtgccaactatgttaccaaagtaaccaaagagtcattcctggtattggattatgacacttctgaagctagaagggacctcagaccacctgctccaatccctgctgcctaaggtcttgggggctgagggctggaaacccaggagctgcatctcccaggctcttggcctcataatcgccttctgtgagactgagggcaattaagatatgaatgacatgaactcgcttctctccatatcaacataaaccagagagcatacatctgtgggatagtcaatacataaacatcctaatcttgatatgggcctatgagatgataacttcagtgtccctatgaaggtagaagggggtcgcaccgggttagcaggaaggctcgaatccggacttcgtgacgagcgctcggctcccaggagtcccttgacggcacagcaatcggaagagatgttcccccggagatcgcgggtgtgctaacacccccgggggtgatatccgctggccaaaaacgggtagccgtaccaccgggggtggggccgctgcagaagccgcg

SEQ ID NO: 711984 - DNA, 922 bp, Homo sapiens
  misc_feature (221)..(221): n is a, c, g, or t
  misc_feature (224)..(224): n is a, c, g, or t
tatttgggggcttttgcttaagttggagcccaaagggcctctcggctcccgggttccccggccccccgaacctgaggaggtctctccaaggccgtttgttacacaagtgccgaagctaggtttgctataacatttaaagagaaaacagcgtcagaggccaaaacgttgtgctggtagctccccgggaaatttgcagaatctattcacgcaacaccaatcgngtnagtgttatgagaactattagcactatcggaacaccctaagggaggtccactgaagctaataatctaatcctaaccttctccgaaggacaggggccccgcttccacaaagccttcctgtcctgtgtaccccaaaagcaccttttccagcaaatgtggacactcacgaacaatttccagaaaagcacaaggccaaaaaccgcccccactttacaagggctcacagagccaagaagtgaccagtagaagtggagcgcatccaataggtctcaactcccattatttatcgcagcggacaacaaggacagagatatgaggggaggataaaaatatacaacgatgcaaacagcggcaccattattaggcgcacccaaaaaaaccctctttgggcacatggcgacaccaagagaaccccaagaggggccctcactctataatgttgagagcggaaagaaaccaaactttagagagccctctgatcagctcgtgcggctctctctcaccaaaaaaaaacacatgtgtctgagagagcatcaagtaagcgccacccagaggcagagctatatagcaaaacgcgaccgcaaataaatgaaaagagagagttatccaacgagataaagaaaaaggctacccttcatcaggaagctatcctcaaagagagtaagacaagcgttgggcgacacacaaccaaaataggtggg

SEQ ID NO: 711985 - DNA, 153 bp, Homo sapiens
gccagtatcactcatcgttaccaaatatggacaacagtagtagactggatacacccggacttaacgtatagtaattgacatactgtggactacgacactctacttttccatgagaaactacaatgcaggcacttaccaaaatgacatcgcttt

SEQ ID NO: 711986 - DNA, 1168 bp, Homo sapiens
  misc_feature (410)..(410): n is a, c, g, or t
ccacgagagtggcaggcagcttcactgccctgtcactgtgcgagaagtgacctggtcctgaaagctgtgtcagaggctgtggctgcgggagtaacctgccctggtgagatgcagccaccaccgtcacaacacgaccatgaattcccactgcatctagcttgaacttgtccctagcctcggagtactactggcagactgacatgaagttccccgtgagtcatggactcgccctctttgagacgggggccttgggtgcttggcgcggtgcgcgcagatcattggaatttagttatctcaaatgatgagtcgtgtcaggaccgctccaggcgttcggaggaagactcgtcgaggatttcgcttgcgttctcgtctgtccgtccgttcctccccacacttctccctggcatccntatgcgacgggcgccctcatgtcctatgccgtgtcttacctttgtcactctggtcttgtgcggtccgtgcctccccggtgcgagagccgaactgctctctggtcagcagagtgcatgccccggcgcctcatcctatgccctgtgggtggcgatgtgttgccgtgcatggaggttgccgcaacccgcatggctctgtgaggagggctgtgccaattgccctgttgtggcctgggcacgaagcgagaaggggccctcgtggatgagtcccgcagcgtttgggagggtcctggtggtccttcggtgcatttcttgctcgctgaggtaccattgggcgactatctcaacccttggtgctcgggctggcaccgcgcgaaacttggcgccgttccctataaggctcttagggggacgtcctggggcgattttagttggcgcggctggtcccatttggcgccccacacgatttggaattttgtcgttccccttgcccaacaaaagggcccttgacccgtaatcttccgcgcaggactcccggtcctgtttggtggccccacatccgacatgttgagctgtgtgccttgaggaagccctgttggcccttggcggcgcagtcgggcgctccctggggccctcttgcatgttagggggacttgcgttcccccggacgaagcggtggccccccttcggacggaagagttgaggccaagggtcttttgtaggcgccccccctgttgtgttgtgcccccgttcctccgcta

SEQ ID NO: 711987 - DNA, 947 bp, Homo sapiens
ttgccccccttccccgtaatgtgcggggcgtctatttctcgcgcccatgccccttggggatattgggaacccaagaagcccctcgttaagttctgcggacttggattggacccagggaaatggggagaccgtggaaaatgtggggaacacccccagtgtgggtgtctgtcctggtgttccccccccccggatgggaaagttattgggacttgttatccaaggtcaattgcatggaaaatgcgtcacccaaggagatagtatgcctttgttcaagccccggattcaccgaggacgtcccatccctcttcgagaaccccgctccgggaatttgggaaaggcgtcgacccctgaagacttactgaatagttcacttactccgccacgaaatgagaaccccaaggatttgacctattcccccctgaggttttcaccccgagagacccacgcggtaatttataagggagttccccgatacccacggaaagtggacccgaccgagttttccacggaggttccccgcaagattgtgttttgtaaaatgggttcctacccactgagttaatgtggagggaaatttcactaaccactgggaaccaccccccacccttggcccaaggaatgcccccttatcccacggaatatggagaccacaccctccaccacccatcccttactattcacgcacccactgctccaccctcctcaagcttcactcccccttactccacggacactcatccacgtaccaccactgaagcccagataccacgagattaaccgacgtacatgattatgatatgagggtggatgatttccttcgtcgcacacccagctgttgtcacgtggcccgcgagaagtagacccccctgaaagagacccgggaaacgagagcgagacccccctagagattaccgacgagaccgagagcgagatagaggacgtgatta

SEQ ID NO: 711988 - DNA, 350 bp, Homo sapiens
  misc_feature (105)..(105): n is a, c, g, or t
gttgtgcacttctgatcgtaggcttcagacttgctgcatttgctgtcggaagttaatgggcatggttcttggacctgaactgcagctcctggacaagtacgcggnctgtggcagccctggaggaggtgctgcaggcggagcaggagttcttggccaatgccaaggagagcccccaggaggaggagatcgatcccttcgatgtggattcagggagagagtttggaaaccccaacaggcctgtggccagcacccggctgccctcagacactgatgacagtgatgcgtctgaggacccaggtcctggcgccgagcgcggaggagccaagcagcagctgctgtgaagaggagca

SEQ ID NO: 711989 - DNA, 1644 bp, Homo sapiens
  misc_feature (1005)..(1005): n is a, c, g, or t
  misc_feature (1093)..(1093): n is a, c, g, or t
gtgaagtggtgtgtttggttatgtgttcgtctttgtgctgtgtgggttgtattgtgtttgtgttttatgtatgtgtttgtagtgtgtggtgttgttaggctcgtagtggtcttgtgcgttggttgatgtggttgttcgtttggtgacggtgtgggctgtgaggtgatagtgagtatgtggggtgggttgttggttagggagttgggagtggtcgtggggcgtgggtgggtggagagtgcctattatcgactattagcgcgtcacgtgagtggtttcccctccttttaatccactccgctctgtgggtgtctcaagaacacacctaccccgattttttgggcgcacccacctatttaggacccttctcgcaaggggggccccccacaacacggtggtggaccacacaaaaagcccaccgccgttttgttgtaaaacccgcctgcctccccccggtaccttaattatcccgggtctccttataagagggttataccggaagaccctctctgggggattgtcacgagaaaattctctcgggccaaccgaggggccgttttcttttgccacgagagaatatttgttaagagaccatttaattgttgtttcctcagcaccccaaatttcatagagaaccgctggtcggcaccacaaatctctcctcacgagagagaaatggggtcggcaccaccagtacctcttctcgaaaaagggggacccgcccccccacccgttatttcctcttgaaaaagggtgtccccccccgaggggggaatcccctctcccgcgaaggggaaacttttccacaatgcacccacgctcacagatgggtgatggaggatcctccacccgccctctgtctctgtgagaaaggaggagaaaaaatatagaggagggggctcctcccgcgcggttagacacacacaattgggtggggggttatacaccacgcagaaaaggagaaacttgtgggctatcacacgcctcttcgcgagcacttatattttngtgtatagtcccacatggtatcacacgcagacccacatgtagatctctaaaggggggtgttataacacccactcgggggctttttccnctcgtgaccacacaatagtgagaggtgtctctgtggtgatatgctctcacactctgtccgcccactatcacacacgctgtggtgtgatacccacgcgagagaatatggggtgtctttctcttgtgtgtgagaatatcccagaatatttctcttgggtgtgagaaaataacacacacccgccaagggtgtccggataggaggacccccggtggttttgcgtttgtgtccacggattctccaaagcgcccacgagaaagatatgaatattaatacccttgaaaggaaatatgaccattggagcctttgtgttccacaattccagcggcgtttgattccacgccagccccccaccacgtttaaaccccaggataatccacgggaatttttggatgggatattatagtcttcttgaaaaagggactgttccacccaggcgtgatgaataagatctaagagttacccggctaccagaaagaagatgcccgatgcaccccttaagacctacttgtgataattaaatgaacgcccattaaagacctattgaatttggg

SEQ ID NO: 711990 - DNA, 534 bp, Homo sapiens
gaaggctatgagtaaaggccgggcagaagctgcggcgggagccgccgggatcctcctgaggtacctgtcaggagcagcaaccggccctacagctcccaggatgtgttcgggaacctacagcgggaacacgtgacatgggctacacggcggtgcgctggtgaagacagctggagcagctggcgcaaccaaggcaagatcaaccgagaagatgtacggcaagcagaagatctatttgtgcggatcaggaccagtttgacactggtgtagtgatgcgtgaccttcaagtcctagatggcaaaatcggtggaccctcactgctaaggtgcagagcttgcagcaggagctgccgctaccactggaggctgagctcaagggaattatctagtgccctgaccacaccgagagcatgcacgcaacgaaactccaggagttaaaggaaggaagtgcgcatggcgtacaggaggagcagactcgacacgaacacttaacaagcagccttaccaaatcactgatgaaatcccagcaaagaggcaa

SEQ ID NO: 711991 - DNA, 128 bp, Homo sapiens
atgcaggcgtacgcaatctatattcgacaccatgctggtgtgcacctccacggctttcctgctgctgtccaccgtcatgtacaacgtgtaccgcgagctcacccgatggcggcgtgcagaagctggag

SEQ ID NO: 711992 - DNA, 206 bp, Homo sapiens
attagctcttagtcagattacacatgcagcatccccgttccagtcagttcaccctctcaatcaccacgatcaaaagggacagcatcaagcacgcagcaatccagctcacaccgttagcctagccacaccccacgggacacagcagtgatttacctttagcatacacgagtttactagctatactcaccccagggctctgtgctcct

SEQ ID NO: 711993 - DNA, 434 bp, Homo sapiens
tgctaaccaccattaggcttccttccccaagggttaaatggaaacctgccttttgaaagacttgctccattcctgagatcaccagctgtctgatgctgccccttccttttgcaggttcgacacaaccgaccagcattccttcctgataagagacccctgaccatggagtggctctgactagcctatggaggctgcacacagacagtcttcgcatccttggcttcaccctctgacatatagggcctactgtaatccatttaaaggttaagtctccaccccagcgtgaacatggatgcatgctgcacacaattagccaattatgcatgtctatgcttcctctttgtgaatattcatagctcctcctataacctgttgaatatgtacatttggccacgctgttcagcataaatccatgttcacgaagggggatggac

SEQ ID NO: 711994 - DNA, 130 bp, Homo sapiens
  misc_feature (90)..(90): n is a, c, g, or t
  misc_feature (124)..(124): n is a, c, g, or t
gtcctcgatcccgtcgaatgcagaggcctctgttcgcgtcagcgtaccagtgcggctgaaccggtaaggcgtacggaaatttcctgctanagtacgaatccgatccggtgacgacgtggctttngcccct

SEQ ID NO: 711995 - DNA, 295 bp, Homo sapiens
cctacgcattcgctcgctcccagctcacactgcaccgatcaacaccagcgtcgtctccgacttcttcttcctcctcctctagcgctactcggttcttgattcctctcatccgtcgctcgttcgctggtcggtggtctcatccatcgtccggtcacgggagaagagcagccggcgtctcttttcgtgctttccagcgacccctccgagcccgacttccatggccatcgcctcccgcatcacgaagcgcgcgctctccaccttcgccgccgcagccaagctcccggaggcggccgtc

SEQ ID NO: 711996 - DNA, 422 bp, Homo sapiens
  misc_feature (124)..(124): n is a, c, g, or t
gggtgtgttggcacacgcctgtagtcccagctactcaggaggctgaggcacgataattgcttgaacctgggaggcagaagttgcagtgagctgagactgtgccactgcacctccagcctgggcnacagagtgagactccctctccaaaaaaaaaaaaaaaagaaaaaaagggaactccaaactaattggttgttataaaattgttaaatggggttgcgcatgatagctcatgcttgtaatcccagcactgtgggaggcttaggcaggaggaggatagcctgagtccaggagttctggaccagcctggacaatacagtgagatcccatctctacaaaaaattaaaatttaaaaaattagctgggtgtggtggcttgtgtacctgtagtcctagctactcaggaggctaaagcagaaggattgc

SEQ ID NO: 711997 - DNA, 146 bp, Homo sapiens
  misc_feature (1)..(1): n is a, c, g, or t
  misc_feature (79)..(79): n is a, c, g, or t
  misc_feature (100)..(100): n is a, c, g, or t
natctagaggtccctcataggtcgcaggactcctaagtctgtgtctgggccacccttaaccttggcaaaaataagcttnctaaattaattgaatcctgtntctgatatttggggtcacaatgggttgctaccctgcgaacctatga

SEQ ID NO: 711998 - DNA, 445 bp, Homo sapiens
agggtaaacgaccggcgctgaattcgagaccatggggcaactggacgctgagggagaacaccctgcatacacgttctgggcaggctgctgcccgcgacattgtgcagatagtaccctaccgccggttccagaatgcccctcgggaggcattggcacagaccgtgctcgcagaagtgcccacacaactggtctcatacttcagggcccaaggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacgctccgcaaactgggtacc

SEQ ID NO: 711999 - DNA, 371 bp, Homo sapiens
gaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaaaaa

SEQ ID NO: 712000 - DNA, 694 bp, Homo sapiens
  misc_feature (195)..(195): n is a, c, g, or t
  misc_feature (284)..(284): n is a, c, g, or t
tgtcactcaaaggacttttggtgggtcacccctcaagtctttaattcgaacaaaaattggttggaaaacccctggggtggcaatttttttaataatggctcaaccaaaaaagccaaggttaatgcagcttgacaaaagttacagttatgtggtgtccatgtaagccccctaatagctactgtgtaataagtcccnctcaatgtatgtagccagaattaaatatttctaccccagacgtagatgtagcattttgtgaataattgatatccatatcactgtcatcnacaaagagagtgtattggtttatgacaaaagagagtgtattgcaaataaagtcagatgcaagatccattttttaaatttccgttgtgtcactttttgtaataacagatggccatatgatgcgttttcggccccatgtatctcagtcccgcatgcagatgggctaagtaaataggaattggtttatcgcgtgagacaattagacgctttggaagatggcataccctgtctcacctgaacttaagcgtctgtctgtaatccaaagtgctcctttatcctctctgtatccaggttacctaacagagaagccgccagttctcatgggtggcactcagtctctgttctctccagctgacttaagtttttttttgaaccagttattttttccgagtgctaatagaataaaggcagt

SEQ ID NO: 712001 - DNA, 1547 bp, Homo sapiens
agcattcttttctgggggggcgcaaaagcagtagtgtatacgcctatgtggaggcgacagacacataacaagcagcggtgctgtgtcacgcacagcaaccagcgttgggagggcctactaataaataaacagcaccgggtttttataaagagcagccccttttggtggtgtgcgccgaaagagggcgcccgtgtctgcgccacaatagcgagccgcagcgccgccgggtggggttgtgcccactacaacaccccggcgactgttttagctccaacggcccgacaacgcggttctcccggcggcgccctcgttttatttggcggccggagaaagtgggtaaaagcctgttggtgggttgggaggaaaaaatatttgcgccccacaagcggtgtggaaattcgctttgtaaagaaagcgtgttttggcaaaggagggagctcccccctcctccgtttggaaaaaaggggacccaacccccgcccccccggggtgaaaagaagaaaaaggggggtgttctaccccggggaaatgtaggaacagccctagtatatggcccccccccagggccttgaaagcccgggaaaaaggaaggggaggaagaaaaaaaaagggcccggcggttggcacccccctgggcgtctcctggaagcgaaaggaaagaaattgtgaattgaaaaaatgcttgagagcacttcggcctccctctgtggcctttcttttgagggcccccccaacagggcccccacaacagggagcccccgcccctgtcatggggttcaaaacccacgtggccccccacaaagaagggtaaccccctgtgtgggtgtttttgtgaaatgagatatttttatatagcgcggcccagcgtatgacttccccccacatgaagcggagaacccacactccctgtctcgggggcgcacactggcccaaatatatttttctttgggagacacaccctcttggaataaaaggagctcgcggcctcggttgtccctctgtggggtaaatctctcacagagagtatttgtcgcgctctgtcccctcgaagaagaaactctcacctcctacagagcctctgcacttgaggctccgcacatattgtcatatcaccttggaatatgtgttccaccgcgaacttggagacacacagctcgagaggaaaagagataggcccttttccgccacactggtgcatatcctctttttggagaacccaccaaatatgcacgctccacattttctgggaatttctgggtttttccgaaggccacggaagcttgccttttcccctgaagtcacagaattggcaaggtggaactaacgaagtcaaacaacatggcggaaactggatcctggcagcgaggagaccccagacgctggttcgagaagtacattttcctgggagggggccttcccagccaagtgggccaagaccttccaatccagggcacgaatcttcaagatgaacctctcttgccatcacctagactgcctgcacctgcccttcagggagatgggggtccttaaagggaactgaaccttga

SEQ ID NO: 712002 - DNA, 760 bp, Homo sapiens
gtatcaacgcagagtggccattacggccgggatgctataccaaaaacctatactgatttcgcggtcaccctgaacgttgtatattgctgtatcctatcaggtgtcgataataagtctcccgatattgtcacttactactccggaaaaaaagatccattatggcatacataggtagtggtctgagctatgatagtcaattggcttccatagggtgtatcgtgtgagcactacccgatatattatacagtaggaatagacgtagacacgcgagcatattgcacctccgctaccataatcatcgcttatgcccaccggagtcaaagtatttagctgaatcgccacactccacgagaagcaatatgaaatgactctgctgcagtgactctgagccctagtgattcatctttcttttcaccgtaggtggcctgacttggcattgtattagcaaactcatcactagacatcgtactacacgacacgtactacgttgtagctcacttccactatgtcctatcaataggagctgtattgccatcataggaggcttcaattcactgatttcccctattctcaggctacacctagaacaaaactagccaaaatccattcactatcatattcatcggagtaaatcttactttcttcccacaaaactttctcggctattcggaatgcccgacgttatcgggactaccccgatgtattaaccaaatgaaaatcctataacgggggggccatcattttctctaacaggggataa

SEQ ID NO: 712003 - DNA, 119 bp, Homo sapiens
cctcctgggttcaagcaattctcgttcctcaggcttccaagtggctgggactacaggcgcatatcaccaagcccagcttctttgtgtattcatagtagagacgggctttgaccatgtca

SEQ ID NO: 712004 - DNA, 849 bp, Homo sapiens
  misc_feature (22)..(22): n is a, c, g, or t
  misc_feature (64)..(64): n is a, c, g, or t
  misc_feature (97)..(97): n is a, c, g, or t
  misc_feature (106)..(106): n is a, c, g, or t
  misc_feature (112)..(112): n is a, c, g, or t
  misc_feature (161)..(161): n is a, c, g, or t
  misc_feature (165)..(165): n is a, c, g, or t
  misc_feature (169)..(169): n is a, c, g, or t
  misc_feature (189)..(189): n is a, c, g, or t
  misc_feature (192)..(192): n is a, c, g, or t
  misc_feature (194)..(194): n is a, c, g, or t
  misc_feature (202)..(202): n is a, c, g, or t
  misc_feature (207)..(208): n is a, c, g, or t
  misc_feature (210)..(210): n is a, c, g, or t
  misc_feature (214)..(214): n is a, c, g, or t
  misc_feature (231)..(231): n is a, c, g, or t
  misc_feature (289)..(290): n is a, c, g, or t
  misc_feature (436)..(436): n is a, c, g, or t
  misc_feature (473)..(473): n is a, c, g, or t
  misc_feature (480)..(480): n is a, c, g, or t
  misc_feature (490)..(490): n is a, c, g, or t
  misc_feature (599)..(599): n is a, c, g, or t
  misc_feature (623)..(623): n is a, c, g, or t
  misc_feature (663)..(663): n is a, c, g, or t
  misc_feature (766)..(766): n is a, c, g, or t
ccagtacttaggagactgctgnaaccgcatgagcaggaggagctgggggaatatcaacgcccgngattccttctgttgaccccactgatgtgtgctnttcgagcgngccagngtgcagctgtgagctattctcctgggccgtggggctgcctgggtggggntctntganctgagtggcagggatgcggntcngnttgctgangaggnngncctncctgagaagcccgcatngtcagggagagccatggagagacaaggagcccggaaaaccggtctcctactccctccnnccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgntgagggggggctgggagccaggaatggggctgggacnccggggngagggccgtnctaatcccatccccactgtcctcaagagagaccaggaaggactaggctacagatcagcaccccagccccgagtgacacatttcccagcttgggatacccgagctgtggntgggagggagagaccccgtcgggnggccacactgagctggagggaggagagaaggagggagganaaagacagggcttgggagtgggatctaaggacttacatgaacctcgagttctgactttggtaaagtctgaccctagtctgctgctgaagtctgaacttgggcntctgacctgggccctttgacttccccttcctagggatctgctcagatgcagatcctgaagtttttggtcaagtaggctctgtc

SEQ ID NO: 712005 - DNA, 146 bp, Homo sapiens
cattcgctccctcagtctgcggcgtgtggctcggcgcggttccgccctcatcacggtcacaccgctggtccgtgttccgctccggctccagctctggtctgcttctcctccctctactctttccactcgccacgcgtggacctcgg

SEQ ID NO: 712006 - DNA, 405 bp, Homo sapiens
  misc_feature (278)..(278): n is a, c, g, or t
catgcccgtggctgcagagatagaaaaacctctggcccatttggataaaacttgtacaaacctccagctcactcagataaggaacaagaacgacctagcacagaaatgcctttgtttggccagccacggtggatcatgcctgtaattccaacaatgtcggaggcagctgtgggcggatcatctgaggtcgggagtttgagaccagcatgaccaagatggacaaaccctgtctttactaaaaatacaaaactagccaggcatggtgctgcatgcctatnatcccagctacttgggaggctgaggcaggagaatcgctagaacccaggaggtggaggttgctgtgagccgagatcgcaccattgcactccaggctgggcaacaagagcaaaactgcaaaaaaaaaaa

SEQ ID NO: 712007 - DNA, 999 bp, Homo sapiens
gcctctagaagtgctcatagggcaccatgtgagtacatattacatataatcacccatggctccactctgtttatagtgtaggatgacttcactatgatgctcttacgggaaatctcacgagtgcagtcaacatcgtaactcagtatgagcgtgcatactgtgtactaactagcctggatgaatagatagtatctaatgatacctagatagcactagtctgtagtggcagagtcttgtcctttcgacacactagagcacacactgttggttgatcttcatcgctatggtcttcttgttgcaaaatcatgtgagccatgactacttgtgtatacaccaggtagctggaatagaggcctgcatcgtgttgcattcatcccacgaatcccagagggcactgtttccgcgagacgatattcctaagtcggtactagtgataaacctgtattgctataaattgtcatgacaagcgctctcaatatggccacatgtaggttggctctagagagagaagttacatgcaattgcataaagttgtactaagggaatataagttgatagtcgtcttatcttcggagtacttaccatttggagaaacccaaataatttcttgcacccaggaaacgggagtgattaacgctattatgtctcatactgaggtgggcagattcttgcttacaaagtttgtgaatagccatgattagtagcctttaggcagcatatatcaagatactgtcttagaatgtacgtttgaaggcaaggagagggtacgtgttctgacggtacgagattaatgtgacgaatctgtagagggtcgaaagaatgggtcttatgggaataaatctctggctctgataaggaccacgaagttgcttgatgggtgtggaaactggttttggtcctggttacttggggaactgaatgttggggcctttaaaggatggtgtatgaaatttggacttttgattgggggtggtaagattgggaatctgggggaaggag

SEQ ID NO: 712008 - DNA, 2061 bp, Homo sapiens
ccacgcgtccgcccacctttccccaggatatggttatgttcaaccaccgtcttcccccggtcaccagcttcacccggccggcggggtcggccgccccgtccgcccagcaaggcggtgtgatccgtccatctacctccagcaagccaccaggcacgctgagccacgcgcgcacctccgccgagccccgggacgatgacgttacaaggaaggagcgcgggcggcactgcatcaggccgacggtccatgtcacccgtgcgccagcagtgaccacatcccaggagggggataccagtagccaagaacattatgaagggatataaggcaagtcaaagagacacgcgaaaggacaacaacacggccgggacatcccaggaagagaacggcagggcaagaatcaccaaacaccagcacaatcacgaatacaacacacaacaccacagcacaacgtaattcaggagcgagcagagcgctagggcacaccagacactgcggacacaggccttcggaaccagcaacgcacgacgctccagtaccccaagagggcaccacataacgcagggaagaggccagcacgtagcaacaacagagcagagcagggacacagatcacaccacgagacacggtacccacattcgaccaacgaggaaaacccatacgaaagcgaattatacttacccaccaaccaccacgacgagttggtcccgcacaggcaagaacgcgagaaaccaagagacacccgcaaggccacagcgacaaacaacaggacggaaaccggtgcatgaaaacctcaccgaagacacaagaccacacagtctgcagcccagatgaggcacccagcgcgacacgaggaaacccccggaaccgcaagatgtggtagcgcaaaaacactgcagacaagaagacacgaagcacaaataagcacaaggggagcacccaaccctacaacagattggtcgcccgcaagagagaagaagagggacacaaaaacacgagggggcccaagaagaaggacccacgcgacacaaacgatcacagcgacggagaaaaagcacacaaagaagagcccacaaacacaagacaaagagaacaaagaccagaaaacggaaggcgaaatacattagacgacaaacaaagcccagtatacagtaaatgcgggcaacgagaacagaagatgggaacgagaacaaaggtgtgccgcaacagacacaaaacaataacagccgcacaaaacagagtacgagaaaagacacgccggtaccaacaaacgtacacaaggcatgaaataccaaccggtgggcaacgaacggccacagtgaagagcttacacccagcagacagcagccccaccaccaaagctaacaccgagggcacgggcgaagaaacaaacgtggacacgatccagacacactactacgtcccgagacgccgacacagacgccacacacacgcaaggatggacagcacacaggcagtagtatagaacactcagggaataaaacaaacaacaagataacaaaagacgaaacgcacatgaaccacaacgatcgagacggaacaacagcatacgcgaggaagacgagcagacagaagagtgaacgaaggacagagatgagcacatgcaacgctggagcgcacgcgaagcagagacacgagcgacacgacgaagacgagtcttggcagagacacgcagcagcagggagacagaaaccagcagaggacaagacacagacgagcacagggcgaaggaacagcgagcgcgaaacaaagagaccaggagacgcaacggcagcgacgaacacgcagacgagcagaagatgcacgaacaccacgcacacgaggcagcaacaacaagacgacaacgagaagaaagcagacagcacaccgaagcggcaccagccagaaaccacgcagcagctagcaacgcgcgacaaaggcacgacgacaccgagagagagcacagcagagagcaagcaatgacacacacgaagagcacacacaccgacgcacggactacgaaccgcgcaacaagacacgcaagcgacactagcaaagaacaaacat

SEQ ID NO: 712009 - DNA, 218 bp, Homo sapiens
  misc_feature (175)..(175): n is a, c, g, or t
  misc_feature (198)..(198): n is a, c, g, or t
cggaccgagtgtggctagcagagcctctgagtggaggcggccccccagaacagagtgctccctctgcctggggaggtgcaaatgggctggtaaacaacctgactgctgttatttacaaccccccagcctagtgggcctgagtggtgtcatgtctaatgtgagtgctgagtgctcncctcttccccatgcccagccctncttccccatgcccagtgtgt

SEQ ID NO: 712010 - DNA, 257 bp, Homo sapiens
aggggcagagctctgctccaaaattcctcccttcatgggtccaaacatttgaagactgattgttgtaattcccaattatcattgtatgcttccatcacctcctaaaattgcttccatcattaccaaatccattatatgccatccccactgccaccatatccaccaccaccacggctgccaccaatatgccaccatgaccactgaagtttcctccacgaccgaagttgtcattcccaccgaaaccaccacgacgacga

SEQ ID NO: 712011 - DNA, 434 bp, Homo sapiens
cccccccccctttttgggccccctttttttcttgggggtttggggggttccggggcccctttttttttttccaggggttttggggcccgggggggcttttttttttggggggccttcgggggcccccctccggggggccttttttcccccccccctcccccggttttttggtgggggccccggggccctttttttccctttttccgggcccccttttgggggggtttttttttttaccccaaaattcccctccccgggttgttttgtttccccccccaggcccccggggggcccctccattttttcccaacccccgccggggttggccctttttcgggcccttttttggtgggggggttttgcccgggggtttcctttttccccccccttttgggggctttttttggggggaaaaaattccccttttttttgga

SEQ ID NO: 712012 - DNA, 220 bp, Homo sapiens
actaggagaagacaaggagctattgctgatgtctaggaagaagctttggcaagcggcctggcttgcttggtatttgggctctgcagcttctctgtcctcattctgtgcagtgacatgaggcatgtcactcacatagtctttgtttccaaagcattggtggtaggtgcatgacttactgtctgtctttgttcatttctcctgtcaaaaagtagttttttta

SEQ ID NO: 712013 - DNA, 224 bp, Homo sapiens
ccacttcagattgtgcaggcatccaattcatgcgcaatagtcggcgcttatttggcctggatggttcgagggatactcatcctgagtcagtgaatgccatcgtgcttccattggtgggtcatttttgctgtcaccaggaacgttgccgcgaccgaacatccttaacatagacattcttggatcatcgaagcccacattgtccccaggaagagcttcactcaaag

SEQ ID NO: 712014 - DNA, 175 bp, Homo sapiens
gatttgccaatctcccaatcagtattacagaaatcggtgagagaggtcttgattcacgttatggtagtggtgatctggttgggaagtcgacattatcactcattattcctcacagatttgtattctccagagtatccaggtccttctcatagatttaaaaagactgtacaggtgg

SEQ ID NO: 712015 - DNA, 646 bp, Homo sapiens
gcggcgatcattagttacaaaggggccagcaaattgccttcttgatgatttttccgacaggtaccagaggcaaaaagctacgcatcccctaaggcctttgccactatctgttgccgacctgccagcgtctgacgataatcgccgcgctctcccacactcacgcaaggaaacgccgtgaaaaagcttctactgttgaccccattactcgcgctgctgttgcaaggttgcggcgtcaccatgacgcaatacgagccgaacttcgacaacgtccaggtcctcaagcgcgcagcgccgctgcaacccgtcagcaatgcccaggtgacggccgcaccgggcgaaggctcgttgtccgtacgtgccaacccgatccgctcgcccagtggcagcatcccggcgcatatccaggctgcgatcacccaggaactgcaactcgcaggcctgctgaacccgcaagcggaacgtcatctgcaagtgctggtggtgaagaattcgctgtcggcaggcatgggctccggcaacggcacgctggccgcgcggtttaccctgctcaagggcaatgacgtggtgtacgacgcgaccaaggacgtgactcacacctggtccagttcgttcttcgggttcattgcgatccgaacgccgccacgcc

SEQ ID NO: 712016 - DNA, 844 bp, Homo sapiens
gttcccaatagccaactgcgacacattcgcctagagaacaacgagaataaaccagtgaccaactctaggcgaatgtgtcgcagttggtattggaacaggagaataaccagtgaccaactctagggacactcaggaagtgcctctggaaaaggctaagcaggtgttgaaaattatagccagctacaagcacaccacttccatttttgatgacttctcacactatgagaaagccaagaggaagacagacaagtgttacacacggaacgtcaaggtcgtgggaaataacaaggcagttctacacagactgcagcaacggttgcatctgcatatcctaagaggaaaaaatgaccttcaagagaattaggacttttttcttaatttcactgacttcagagacgattgcaagacttgcggtttaagtattgcaatttcacaaaagacatatggacttaactggaaatgaccacacacccgaccacgacaacataaacaaaaaatccctctaggagttaggtgcaaaatgtccctttatattgcttgatcggattcagaagcatactgctatgttgtggcctttgactatggtgtcggcatataagtccgaagttgcctacagcgtttctctaatttttaaaaccctttgccttctcccatttgaaattcgccttgggaacacttgactgggaaaggttggtgttccccccaaacgggagtgattatccttcccacctggagaacagtgttacgaattggtgacggagaaacactggcccacgcggacttaggagggccagacttcgcgcgtttcaacaggatgagcacgaaggtcgttggtcttcattac

SEQ ID NO: 712017 - DNA, 128 bp, Homo sapiens
  misc_feature (24)..(24): n is a, c, g, or t
  misc_feature (34)..(34): n is a, c, g, or t
  misc_feature (95)..(95): n is a, c, g, or t
ccagtcaggacttagaccacctgncggcctcctnaccctataaacccaccactcccctccttctttcccaaaccacttggggtgttctaagcccncactgccccaagcccaaaatatcaactaagatc

SEQ ID NO: 712018 - DNA, 133 bp, Homo sapiens
gctcccatagcagtcagttattttaatagcagtacttttagagccctgtccattttttatgtgtgcgaaaattatataatttctaagctgaattggctgctatagttttacatatctgatgggagaagactgg

SEQ ID NO: 712019 - DNA, 212 bp, Homo sapiens
cccccccaaaaaaaaaaaaaaagatggccccccccccccaggccatggcccgggccccctgtggtgggtggtgctttggggtctccggtagcccccccccccccgccccccccccccccgcccgggggggcgggattttgggttgcccttcccggtttttaacccggtttgccggaccccctttttttttaagattttttttagaaagggga

SEQ ID NO: 712020 - DNA, 331 bp, Homo sapiens
tagggtcttagggaggtgtattagtcagttcttgcactgctataaagaaatacctgaaactagataatttataatgaaaagaggcttaattgattcagttccacaggctgtacagaaagcatgcctggggaggcctcaggaaacttacaaatggtggaaggtgaaggggagcaggcatgtcttatgtggctggagcaggaggaagacagcaaagagggaggtgctacacacttttaaaaaaacagatctcataagaactcactcactatcaaagagaatagcaagggggaaatctgccccccatgatccaatcaactccctactccctaag

SEQ ID NO: 712021 - DNA, 384 bp, Homo sapiens
  misc_feature (296)..(296): n is a, c, g, or t
  misc_feature (346)..(346): n is a, c, g, or t
  misc_feature (363)..(363): n is a, c, g, or t
ccaagaggtcctggcaggtcctacctcatgattttcatttattaatttaaaacaaaataacaggaatcacttgtttctagagaggaggggtggaatacctgactagtagagggtcaggtgacaatggcgaaggtagaaactgactaagtttggaccatgtggcaaggagtatcgttccagttgggtggggtcaccttgcagagtttttaaaaaacattccttgggtttgttgggtgggtgggtgggtaggttaggaaagagatgcggtgtggctcaggctagtctcgaaatccggngctcaagcggtccttcccagaggtgtgggattacaggcatgagccaccgnacccagaatcacctggncgatttggaaactacccttcc

SEQ ID NO: 712022 - DNA, 507 bp, Homo sapiens
atagaataaacatataaatggaactgaacatacatccaaatcttcacactgctatttgctctcatacccggcaccacacttgagttttgtgaggccagttggatgacttaagtttgtaagccttattattagttttatattacatatcaaaacacatagaaatgtccctatccttttagctttttatttagtctacagcccttaagtcattctgcctaaaaatcatcaagctcctcttcttattaggtccaatatcccatataaaataaaattgccttgattgtagtgcatgctcaatacaaacttatttttctggaagtatcacttcctgtgagagcaggctgttataaagtgaagttgctttgaataatagaatgccgaatttccccttccaattctccaacatgttctccaaatatatgtaagtatcagagacttatatatatcttttgtgttcctagtttgtcttcccaggaaattacctttccacacagtctgagagtctgg

SEQ ID NO: 712023 - DNA, 893 bp, Homo sapiens
  misc_feature (33)..(33): n is a, c, g, or t
  misc_feature (72)..(73): n is a, c, g, or t
  misc_feature (78)..(78): n is a, c, g, or t
  misc_feature (87)..(88): n is a, c, g, or t
  misc_feature (116)..(116): n is a, c, g, or t
  misc_feature (132)..(133): n is a, c, g, or t
  misc_feature (146)..(146): n is a, c, g, or t
  misc_feature (149)..(149): n is a, c, g, or t
  misc_feature (170)..(170): n is a, c, g, or t
  misc_feature (183)..(183): n is a, c, g, or t
  misc_feature (191)..(191): n is a, c, g, or t
  misc_feature (195)..(196): n is a, c, g, or t
  misc_feature (200)..(200): n is a, c, g, or t
  misc_feature (212)..(212): n is a, c, g, or t
  misc_feature (217)..(217): n is a, c, g, or t
  misc_feature (223)..(223): n is a, c, g, or t
  misc_feature (229)..(229): n is a, c, g, or t
  misc_feature (239)..(239): n is a, c, g, or t
  misc_feature (245)..(245): n is a, c, g, or t
  misc_feature (248)..(248): n is a, c, g, or t
  misc_feature (268)..(268): n is a, c, g, or t
  misc_feature (277)..(277): n is a, c, g, or t
  misc_feature (288)..(288): n is a, c, g, or t
  misc_feature (295)..(295): n is a, c, g, or t
  misc_feature (326)..(326): n is a, c, g, or t
  misc_feature (331)..(331): n is a, c, g, or t
  misc_feature (335)..(335): n is a, c, g, or t
  misc_feature (342)..(342): n is a, c, g, or t
  misc_feature (345)..(345): n is a, c, g, or t
  misc_feature (368)..(368): n is a, c, g, or t
  misc_feature (374)..(374): n is a, c, g, or t
  misc_feature (388)..(388): n is a, c, g, or t
  misc_feature (391)..(391): n is a, c, g, or t
  misc_feature (443)..(443): n is a, c, g, or t
  misc_feature (452)..(452): n is a, c, g, or t
  misc_feature (552)..(552): n is a, c, g, or t
  misc_feature (781)..(781): n is a, c, g, or t
  misc_feature (890)..(890): n is a, c, g, or t
tgtacaaaatgaagctcacactatcccaaaggngagtagggactgaggccggggatccattactggcctttnngggtnttctgaggnnagggggaaccaaccctcccactccaganttgtggccacaggggnnggaaggaaagggnacncacctgggtttggtcacaganctcagagcctggnattagggnaggnnaganaggtggatgggngaggngggggntcaganctcccctgcncagggngcncagggggtgctccaccggtnccacttgtnatgtgcttggnccagacntagactcgggctggtgcaaagggaagggagnaaagnaggngggaggnganactgatgtgtggtgggggagggngggggncctgggcctgtggnggngggtggctggggaggtgggctagctgcctagtggcagctagcagcgagtttnataaatgcnactgcgggcaatgtagcgcacccatttgatgacatcatggtcgctgtagttcagcttcggttcaaacaccttcaagtagcgcaccttgagggcagagggngcgaatgggacctcaaagttcatggaaatggggggtcgagccatttcttcttgtcgttggtaggcagaagctcaatctctgcgctgatctgcgattccttcatgcctgccatgcgcttgatcttccacacgatggcattctcgctggccttgtacttggccttccccttcatgcagatcacctgcaccccgcttgtgttcagtggggttgggatctcacctcgatcttntgagccagcagtgagggtttaaagttggacttgatgaccaccttgacctccagtttggtgcgtccacttctcgcactagcgggatcaccgggagggaaaggatgatgtnctt

SEQ ID NO: 712024 - DNA, 444 bp, Homo sapiens
ggagaagggggataaagattgaaataatgatatataaagtgggggccaagacacggaacagaccgggtgatactggggggagagagggagtaaggaaataaacggtcaaaaaacgacacccgcgtgggtaataaaacaggatttttttattttggcggggactttggtgttaaagagttgggcaagggtggggaggcaggaaaaatgcccagtgagtgaaaattgaagtcggtaggggggtgaaatagtgggaagtgatgggggcggtggacaggtgggccaagactatgacggacatgcaaatgcccccatggctgctgaacacaccccatgacaataggtgttggaggaagctaaaaagagggcacaaacagtggaaagggaacagaaaatggccggcctgggcgatgacgactttacagccttaacgctaggggcgaaagg

SEQ ID NO: 712025 - DNA, 188 bp, Homo sapiens
gtgcccgccacacacctggctcatttctgtactttttatagtcgagacggggtactcaccatgttggccagtgctggtctcaaactcttgagctcaagtgatccaaccgcctcagcttcccaggatgacccgggcaggacgaattgcttgacacccgagacggtggcggttgcagtgagcttgactta

SEQ ID NO: 712026 - DNA, 159 bp, Homo sapiens
  misc_feature (31)..(31): n is a, c, g, or t
  misc_feature (41)..(42): n is a, c, g, or t
  misc_feature (52)..(52): n is a, c, g, or t
aggcagctcttacctgtgatgatggcaaatnccggcgggtnntgaagccatnacagcaagatgttgacatgtcgcgtcttcctgagcacctgcatctcattcttgaaagcctgggcctgctcagctgtgggctggacacacttgagcaccttcacgcat

SEQ ID NO: 712027 - DNA, 257 bp, Homo sapiens
ccaggtcagagataaatgtatcttcagtctatccccgaacgatgagacaccatgaagccccaaacatttggcctgagacagctagcacgcctgaagagactcggtcacggagccaatctggtagactttgagcaggaggcagtagcaggacttctcgttcacggccttggtgatcctctttgggttggtcactgtgagatcataccccactacctagattcctgcactggctgtgaacttctgacaagctccccagt

SEQ ID NO: 712028 - DNA, 144 bp, Homo sapiens
  misc_feature (2)..(2): n is a, c, g, or t
gnatgaggaattgaattgactagtagatgtagcgtatgtgatttcttactttggaagagaggccctttgttataataaaaaaaaatcgagggagagaaaacaaataaaaacaacaacaataaaccaaactcctacttccaattt

SEQ ID NO: 712029 - DNA, 364 bp, Homo sapiens
cctattgtttatgtgaaaatgcagattcactgagccagactaaggcatcagtgactgttcctctacctgcctctcacatggagattgtgtgttcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattg

SEQ ID NO: 712030 - DNA, 227 bp, Homo sapiens
gagcggtctatcgggatgcttgggccatgctgcataaaatccactgcatttaatcgggatgcattgggccacgctccatggaatcaactgcattcaatcaagctggatggaatccactgcatttaatcgggatgcattttaccacgctgcaaggaatatactgcattcaatcacgctgcatggaattcactgcattcaattgggatccattgcaccacgatgcatgg

SEQ ID NO: 712031 - DNA, 575 bp, Homo sapiens
  misc_feature (6)..(6): n is a, c, g, or t
  misc_feature (213)..(214): n is a, c, g, or t
  misc_feature (216)..(216): n is a, c, g, or t
  misc_feature (248)..(250): n is a, c, g, or t
  misc_feature (272)..(272): n is a, c, g, or t
  misc_feature (314)..(314): n is a, c, g, or t
tcatanaataaagcaatgacatctgtggcaggcagcttctgacatcggaacccaatgagccatctgcaaggaacccccttggagaatccctttcctttgtgtgtgggctggatctagtgacttgcttctcataaatagaatatggcaaaaaatgatgggttgttacttctgagattaggttataagaggcgaatttctgttttgctgtaattnngnctctctaacctcttgctttcctgtgctcatgnnnccagctgctgtgttgtgagccnccttatggaaaacccatgtggcagagaaccgagggtggtggntggccaacagcaagccaggagctgaggcccacagtccaacaactggtgaggaaccacatgctgccagcagccatgtgagggaacttagaagcaaatccttccccagttgagccttcagatgacaccagagccttggctgaccccttacttttacccttgtaagagactttgagccagaagacttggctaaaccacacctggattcctgacccacagaaacttgaaataataaatgtgttgttttaagtcaaaaaaaaaaaa

SEQ ID NO: 712032 - DNA, 504 bp, Homo sapiens
  misc_feature (89)..(89): n is a, c, g, or t
  misc_feature (201)..(201): n is a, c, g, or t
  misc_feature (243)..(243): n is a, c, g, or t
ggataagaggaggcaagactttgtcccccactccgcaagataccctctctgttccggagcggtgggtccctcccctgttaggaccttgnctccctcaggactggacctggatcctgggcctgcagtcagattgccagtttcacttagaggtggaaatgtcaacccactggttggaatgggaagctgctgtgttgtgagccnccttatggaaaacccatgtggcagagaaccgagggtggtggntggccaacagcaagccaggagctgaggcccacagtccaacaactggtgaggaaccacatgctgccagcagccatgtgagggaacttagaagcaaatccttccccagttgagccttcagatgacaccagagccttggctgaccccttacttttacccttgtaagagactttgagccagaagacttggctaaaccacacctggattcctgacccacagaaacttgaaataataaatgtgttgttttaagtcaaaaaaaaaaaa

SEQ ID NO: 712033 - DNA, 230 bp, Homo sapiens
ggccacgcatgtaatcccagcactttggaggctgaggcccgcagatcacctgagctttaacagctgcaggcgcacttccctatcaggcccagaggaggctggtagtgtgactcagcatacaccacgcagctcgcgttcagcactcctgccgagggggcttcctgcaggggttccagcaggggcccactgtgtccctaccaccccaccccccctagccttgtcccagctgg

SEQ ID NO: 712034 - DNA, 320 bp, Homo sapiens
ctatcagtatatctatcacattatcctttttttttctccacaactttcacagactattcttagacatgcctcaactttctgacttgccgcaaacaccttttttttttttggaaatggattccccctctgtcgcccaggtggaattgcgttgttgccttctaggatcgctgcaactctgcctccggggttcaggccatttctcctttcctcagccttcctgagtataggtggggctacaggcacccgcaaccctttttttttttctccacaagttttcacaagattaagtgtgatagggatcgcgagcctcgaatttcgta

SEQ ID NO: 712035 - DNA, 548 bp, Homo sapiens
aaatgagatttggggtgggggaccacagtcaaaaccccattccaatccatgtttaaatgttgtccattatatcctacctactccccctattatatcctcctacaggactccctacaatctggagagaaatccaaagtaggaaatgtaggagtgaaaatgaaagacaacagcctaataaaatgcctacaatgagaaaataactcctcagagggattttggagtagtaaattattattgttattatttgattccaggacctcacttcaccccatgctggagtgcagtggcattaacttggctcactgcagcctccacctcctgggctcaagtatcctctgcctcagactcctgtgtagctaggactacaagtgtgcctacactccctcataaagaaagctggctacttggtgattgcacaggaccattgatctggatactggctattacatgtgtttagtttgtaaaaattaatcaaactgtatatttaagataattgctgttttctctgtgtattttgcagtacttcaataaggttaaaaaaacaagaa

SEQ ID NO: 712036 - DNA, 1491 bp, Homo sapiens
ggtcggccggcccggctcgcctgccccgagtcattacccagtccccggacccgccgatatgcctctactgcctgctccgcgcccttacccgagggctggattatggtgctgttgtcgctccatgaaacggtgtgacacctgatgctgactcgctggactcggtggactggtgccctgctgcaaggcttgcattgcacctgctggcggtgctgggactctaccaggcttgcgtgcggctgagaggagcggacttggctgcccccaggaacaacgggtggactggaaggttaaggagcctcaggtaccagaaaggagcaccgacgtctatccatgtagcagctttgcaatgacagacgaaattacatattccacacctcctgcatcggaggtccccagacgacacagatatcttctgcaatccttgtgacattgacacattgggtgtcaccatcacccggttgggcttgtgcccattgcccctacgtatggggcctttggcatgatttgaccacggttcggtactcccgattaaccaacttgcttcccggcctggggttgggacaacttcgtgaacgacacgaagcccaccggtgctcttgggcggcccactatgatcccagtgccattatagcccccttggatgggcacaccaggagggatcactgtgcatatagatcccactagaatttttgggtaccaacgatggggacaacacgttggacaacgcggtgcccctgggggatcacacccaaaagtaccccttttgaaaggaacttcaataccaggcacagattggaacatcccacaacggggcacgggcataccacacacatcccattgactttggctgacactatgcagaccgcgagtggcccacacaggggactggcacgtaaccagcttgcggcctcgacttgggccagtgtgcagcgattcgacggttacagcacatgcgacaatcagacatctagcgttcgcgatatctcacagtattacccatggcgcaacttccccacagcacaaatattcggacagacagtaccaagaggagcggccacacagaatcgcgccccataaccgtagcgcgagccggcattagggcgacaacctaaagggcgtaaccctcagggagagcagagttaccacattagaacaccagggcacgacatgtaaccacaccagccaaactggggcgattgatgatttcccagccacgctccagagtcgcacagccccctcacattcggtggccagccacctacacctgtgggacagccggggaagacgctaaaaggcagtggaacaagattcctaaatgtgataggacaacaccgacaaacgcatgcaagacacacctccatatgtagagacatcaccgactgggacacacgggatagggatatatggaaccacaggtggtgacaggtttcacccacgcacacagccatcattcctgtcgatcgcaccgatagacgacgtagagctgatgga

SEQ ID NO: 712037 - DNA, 491 bp, Homo sapiens
gatcacgtgcattgtggcagcctccggtcttttcttgttcatgattttcagaaccgtcaggataaccaagatgccacaggtggcatatctcttggagtgtctaatgaatattatcccctgggttatcttctaagaagacaggctgaggaggaagagtgtagcctcacagaagaacaactggatgggttaaggcctggtggaaaatttcctcgcataccatttgtcttagaaagctaaccttttagaaaattaaaattattttttcacaaaggaacgcgtatacactgttgatgggagtgtaaattagttcaaccattatggaagacagtgtggcaactccttgaagacctagagacaaaataccatttgacctagcaatccattattgggtaatttaacccaaagcaatgtgaatcattctattataaagacacatgcatgcgtatgtgcgttgcagcacaattcacaaaggcacgtggaagggtaccgag

SEQ ID NO: 712038 - DNA, 665 bp, Homo sapiens
agccctggtcagcaggaccggcagacattctgagagaaccgtgagcgccggcaagggcatgcgccacctccaactggaagaagacgcccctcagcagcaggcgggacccttgcgtttgtcagcccaagcctggcggtgcacaatgagctccatcggacgtggactcgccagcgagagtacctcctgtgacatgatcccaccccgcgtccatcccctcagttcagccacgtggaaatatgtgcgatgccaggcccccgtggaaagacgggctccctctctcctcccacctggccccctggtctagaaggacccactgcaccagcctccgctggcctccgggaagacaccgttgcccgcacccatagagcaagcaccggccatgctgcagaggcaagacctcaattcttggctgcaaagtttcatcagaggctagtgcgggctggtgccgcctcgataggcagaccgaggatcatcgctgggggacctttcccgtgggctttcttcctttctctctttgcctttagtttgccgagaccagcagaaacagtggaccttgggggctggttctgctccgtggccccttgtccagcccctgccggcacacggggcggtcaacctggaccactgtgatgcgcatgggcaggcagcgcccggggcttctgaac

SEQ ID NO: 712039 - DNA, 403 bp, Homo sapiens
  misc_feature (225)..(225): n is a, c, g, or t
  misc_feature (274)..(274): n is a, c, g, or t
ttacagggtaatggtttgctagtttaaaactgtaaccaaacgaactggtcagcccacatatatctaaaacacttaaaatgttaggaagtttgggaatgttataacctaaacgtttttgctggtaaccttttgttatttatacatatttgtgtatttaacatacatacttcaggaaatatatgccttttcttaaccttaaccatgcattcaacaccacggcctatntataccactgaatattctggaccctgttatttgcggcacactcacctgntgtgtttcagcgcaaccccactacccgttagtctttcccttcgccctacacacggtagaaaccatgtgtacgttatgttcgtctataaaagaaaaaatcctaatatttaataattttttccgaaaaaaa

SEQ ID NO: 712040 - DNA, 679 bp, Homo sapiens
tccaccatcctgtctggggggtccctgggctcttttggcccgtatgccgaaaacgccagacgttggcccgggccatacggaaactaccaaaggctttagaaattcttctcttcctcagtgatgactcgagctttctccttcttatagacgtcccggacgggcatgaccggcccggtcagcttgggtggccagtttcagtccttcagcagaatctgtctcccttctggggggccgagggctcccggggggaaagaggatagatgttgggagcggtacctcctttcagccgcttgcactttgcccttgcagggacctccgtggacttgtcccggccttccttcggactccacagaaattgccgatggctccgggccacctttcttgtgacatgccgggccacccttgagctccctccaggctgaagccgcggccggggcgcaccatctcggtggtggtcaccgaaaccggtggggcaagcgcacagagtgggccggaatgggaacccgacgcgagggcgccggggcaatgcggcgcgccttggtttgccgggcctttacgtccgtggggatcttacgggccggttggtttgacccatcgttgggccacgcgccgttgcccagttcctgttgaaagtggggcttcaagaccttgccatttccggttgggcgccagtggctgc

SEQ ID NO: 712041 - DNA, 423 bp, Homo sapiens
atggagaccaggctgagatggaacaggctgaggcagaagaatcgcttgaacctgggaggtggagattgcagtgagctgagatcacgccattacactctagcctgggatcactgccattacactctagcgtgggcgacaaaagcaaaactccatctcaaaaaaaaaaaaaaggtcggacatgggggcccatgtcttgtaatcccagcacttgggtaggctgaggtgggcggatcgcctgaggtcaggagttcgagaccagccgggccatcatggtgaaatcccatctccaccaaaaatgcgaaaattagctcggcatggtggggggtgcctgtagtcccagctacttgggaggctgaggcaggagaattgcttgacccggggagacagaggttgcggggagccaagatcacactagggtactct

SEQ ID NO: 712042 - DNA, 964 bp, Homo sapiens
gctctttcccatctggcaagagggcgggtgaaaaagttgagaagccagatactaccgagaagaaacccgaagccaggaaggtagatgctggtggctagggtgaaaatagggtaccatctgatagctaaaaagcccatagcaaggcgtgaagccccaattgcaagcccgtaacccctggtgcattgtcagagcaggtaattggccaggtcattccacgatctgccgatgtattccataaaggccttgtacaagaggaaagttctcaagccggtggaattctccaaggttgcctcaagcatccaagacggcagagaggttctccgctaacttgtttactatacaacagattggtgggttgacacagtaacgggggaatacgccggggtggtgaagagtttggcaatatggctagatattatcccataactgtaagatggtgtctcgaaaatgctgtggagctgggagatatagaagccgttcgtgtcagggaacagtgagagaaactgctgatggaatgaaattaagtcccctgggaatcaatttcgtgatcaattgcgcttctatggatgggaaatggggcagggatgggtggaattggttgaacgcgaggtgggctaggtgtgcttacttacttcggtgaactggaccctctggttcccttcagataggaggtggcgtcataacgagggaacgcgacctagacacttggtcaattgcctggttcaatgctaaaaatccggatattaagaccgtaaggaattctcatggaacatgttccagtgaaggcttggtacagcaagaaagaacgtggcgggagcgcagaaccccaggacagggaacacttccgcccgggcaggctttggaaatttcggccggccaaattgtcaccaagcggggcccccattttcgcacatcacaggtccccgtcgggcccgcgcggtggcgcgcccgtttctcccgggta

SEQ ID NO: 712043 - DNA, 739 bp, Homo sapiens
cagtgtggggtggcggtgttgtgtgtgggggttgggtgtggtttgtcgcggctgtccgtcgtatcgactccctggtgccgctaatgatgggtagcgtccccgcgacgttagagaaggtcgccgtggcggcagcccggtgtctctcgagttgtgggggtgtccgagggatgatctgcgaggaggttatagagagtgatgtgcgctcgggtgttttgattcggtggggggctgcgagggtgggtgtggggtcgtggcggagcagcgacagtgtacttgttaggtgcagtctctgttgtggcgagcgcgtggtggatgaggtaggagcctgccttgcttggatggctttctcgccgcgtcttcgcgagggcacgcgtggcgacgatttcttctgtggccgtggcgggaggctcgaggcgtcgtagccgcgccaccgtgttgttgcactggcgccggtcgttcgttgcgcgctctcctttcggtctcgggcacctgaggcaggggtcgccacattgttgcagttttctgtttttgccgtggcccgctcttgtggggatgagcgatgatgtctgctgtcaatggtaccagatttgttgggtgcgagccgcgtcgctgcgtcggcctctgtagccgcgctagtggggcggcacgtatcgagcggcggggagttggcgggacggggggggggggagttttccccttaatccctttttttgtaaaaaaaaggaaaacctttttggga

SEQ ID NO: 712044 - DNA, 418 bp, Homo sapiens
ccactgctgcagacacctgccttaacacacacacctctaggactccacagttgtgcggggaggggcgggggggggctgcctgtccctgtctggcttctccctgaagaagagagagatacgtgtggaattggggcgggggaatgagcatgaactgtccttccattggggatgagtggtgcgattagagtgagagagggaataaggagcctttcttatggaagaagtgggggaggggagacggggttctgttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaaaaa

SEQ ID NO: 712045 - DNA, 191 bp, Homo sapiens
ctctgtcttctgaggtactatttttagacagcgtggctcttgtacccaggcttgagtgcaagccacgatctcacctcaccagaacctccgtctcccgagttcaagcgatactcctgcctcggcttcccgagtagctgggctaaccggtatgaaccacatcatcccggataacatagtataatattaataaa

SEQ ID NO: 712046 - DNA, 244 bp, Homo sapiens
cgactctagaggatctggatgacgtcctcatgctccatggtgtgggtcacgcccacccgctgcagactgtacttggtgctgttgccccaaacgcatggcgtactattaactgcctggcgagtgatcggtgaatgcggtgggagtacttggccctgacctgcatctacaccaagaagagaggagagacgccatacttcacatatgccatcattctccggataggggcctctgtgcatcacgtgtt

SEQ ID NO: 712047 - DNA, 253 bp, Homo sapiens
gaagagatcgagcttcatcgagaatgatgcttgcataatgtcgagccaacgacataaactaagggcgctacttgggaggcaacccaatcctgctactatcacttcctcttgttatttcattttattttcttactgttctctcagttttacactcatcattcatgctttatgtttatcatagctaggaaatttagtcatattctaacttatttttgctccttgtcccccagcaccatgccaccttcacatctca

SEQ ID NO: 712048 - DNA, 136 bp, Homo sapiens
gtcacactactgtcaacactggacatgtggaccgaactactatgagacaccctgttcacaactgtttaatgaggaggttttccaacattagtgaatgcatttgatccttcagtcaaccaatggatgtctgaagggt

SEQ ID NO: 712049 - DNA, 310 bp, Homo sapiens
ttttcttttttatttgggggggggggttttttttttgggggaccccctttttggttggctccttttaaaaaggggggggggattttttaggggggggttgtttttttttttaggggccggtttggcccttggatttttgttttaaatggggttttgggttttttaaagccaaaaggggggggggggaaattggttttttgcccctttttttttcgggggggccattttggggggtagaaatggggtaaaggttttttttttttgtttttttttggggtttttttttttaattttttttttgggtttccca

SEQ ID NO: 712050 - DNA, 1581 bp, Homo sapiens
tcagtttccttaaagggacccccatctccctgaagggcaggtgcatggcagctaggtgaggggaagagatgtcactgtgaagatctggcccgtgatggaaggcttggcccacatgtgcgtggaaggcccccttcccgaggaaaagatactctcgaaaccaggcgttcggggctctccttcgcgtggccaggactccagttttccgccagtggtgtagtgactgcgatagtccacctgtggccaacctctgtggaccttcagcgggaaagggcaaggctctcgctgggcctctcggaaggacccaagactctccaagacaatgggaggcgtgcatatgtgggtgggtctccaaaaagggatggaccactgtggcagaaggggcattctcatctcctctcgagctgtgggtcccagagtctcggcggcgaaaacaatatcccagagtgtgcagtggaagaatgtgccgaggcctctaggaagaggctcgtgagaggggagttctctctcccgagggggaaagcggaaataacctccgtggagtctcaccaccgaggggaaccacaggcgcggtcccttatattcaaagaggtggccctccgcgaggaaaattagtgggacgaggtgcccaacgagaagagaggtggtgtctcccctcatctggggcagtatcacgtgtggcgccttataaaattcccattccccaacgagcaaaaggggataccctcttcgtgggggccatggtgtagaacgcgcgacaggggggggtcccgttgggcgccccttggggggcctccagcgcatcggcccagggccggccttgtgcgctcaacacatttctccaactcacatttcttccttccctccaggggaccccagtgggggggcaattggcctggcccatttatattgatacacataccgttatcccgggctttcaagcgccgtggggggggcattccctggggcgtacccattcattctcacccgtgggtggcacacccgcattttaccttcattttacacccgggtgggggtgggtgaggcgcccctattcatacacacgggggagggggggggtcccatcctgtggggcacaacacctttattagtataaacgggcatctccaacaaacgtttggggggccgcagactctcataccctcaacagacacaaagggtatcgtcaccacggtattacccgccccccccaaaagaggaaaacaggtccccggtagcagaaccgtcggggggcgcgcgggggcgaacaacacgtcgccgcgggggctgacggcgggcaccccccacgcgggggggtgtgcagggatcgttggcgcgggaaaaagacggggcccgtgtcgtcgggaacacaacacaggggcgtcctagcaaacccctgttggtttatagacaggccgccaaccacgggggtgcgctgaacacactcgtgtgtgtcgttctaccgaccaagttgtctactcgttcgtcgcccgcaaaaaaaaactgcctgattccaaggtagagcacctcgacgacgcacaaaaattggcgtagaccaccccatggagcgtcaaaacgacgact

SEQ ID NO: 712051 - DNA, 150 bp, Homo sapiens
acggcacggaagtcataggtgaggcagcagctctacacttacctacagaaaaagacactcaaccattaccctcagcctaggggaccccaacatccaggccctaccaagaccccaaacctagcccagaccagccctgaaacatgcaagtac

SEQ ID NO: 712052 - DNA, 898 bp, Homo sapiens
tgccctcgggctggcaagaaggccactccaggcctccacagtgatgtactaatgagtggccctgctgcctgctggcctggcctgccaggcctccccatgccaccacaaaggcccttttaagtggccaccacctgccctcatggaaatgagctgagcctgcttcagactgctggggcaaggctgggccgcggtgtctcccttccccatccgccttctctctctgctctgcattcaacaggcgcggggtgacacaatatagactaggcctagcgaatcagatacagcgcacatctgctaacctgcatgtaagaagatagacagccaaggcctctaccagctaccgcgacagtaacagcaacaacagaaacaacgcgacaaccggcggcacaacaccagcgaagcagaagacacaatcgtacacagagaacatgacacagaccaccgaaaacagcgaaacccacgagtcgacaacctcacaaacaacccaccgcaccgacgaacataagcaccacgagagcaaagcaacaggaaaaaacagaaagaggaatagcgcgcacgaccgaagacacaacacacagtaatctcgcgaacgagctagccccacaggaaaagaacgcacgaaaacacgtaagcagcagacacaacgtagcagcccactcgacagagccatataaaaaaagcacaacatccaaaaagcagcaagcacacaaacgatccaaccagcctagcacaagactcaacctacactaaactcacaaccgaagtacacaaagtccatagacacagggaaccagcacacatcaccacgacagtacaagcgacaacaagcacaaccagacacgagcagaacgcaacaagagaagagcagccatagctgcgacgagactacttacacacg

SEQ ID NO: 712053 - DNA, 112 bp, Homo sapiens
caccgtatcctcttcttcaacacacccaaaaagatgacagactacgccaagaagcgagggtgggtccttgggccgcaacaactactacagttattgctacagcgctggggta

SEQ ID NO: 712054 - DNA, 645 bp, Homo sapiens
gactgcttgagcctctgagcctcagttaactcagaggaggttggcataacacagagggcagtaaggacagggacaatgggaaaaaaaaaataaagtgaagaccatcttggttccattatgaggagtagagtgcctggatcaaggaggtgatgatggttccatgtgtcctgggtaggtcagagagcaggacctgagagcattagaactggtggcagcctttcaggccatcttatctgattcctttcttttatatatagggaaactgaggctcagagaagggaaggaaaggctactccccccagaacagagttcagctcttaatagcacttttttttttttttttggaaatacttcttgctctgtggccctggttggattgcggggcttcagctcatgggtctcacggcagcctttaacctccggggcctcgggtgaccctccgtgcatcagcctccgtgagtagttgagcctacagttgcttgccaccatgacgggctaattttaaattttttggtaaagggggggcggggggggcggtctccctatgttgcccaggctgtctcaactcctaggctctaggatcctacggctcagtttcccaagtgccgggattacgggctcaagctgccgtgcccatcctgttgc

SEQ ID NO: 712055 - DNA, 102 bp, Homo sapiens
gcggccgcctactactactactactgctcgaattcaagcttctaacgatgtacggggacatgtgactgtattacctattcaaaataaacaataaatgggccc

SEQ ID NO: 712056 - DNA, 132 bp, Homo sapiens
ttacatatacgactcgagctagtacccaggcatgcagcttgggcatgcagcttgggtaatttctgaactgagtccaagtttttaccagtgcttttagagtcattttttttaagtcctttatctccaagcttg

SEQ ID NO: 712057 - DNA, 209 bp, Homo sapiens
tcgctatcctcggcacctcgctatacatcggcacttcgctattcatcggcaccgggggttggtgtaaaataggcgctaggtcgaagtagagcgttaaggagggtgatggtggctatgatggtgcggatgagtggcgaggtgccgatcaatagcgaggtgccgatgaatagcgaggtgctgatgaatagcgaggtgccgataaatagcga

SEQ ID NO: 712058 - DNA, 113 bp, Homo sapiens
gccgcacagacgatagcccgacagccccggctagtcggggctgtcgggctagtcggggctgtcgggctagtcgggggctgtcgggctagtcggggcggtcgggctagtcgggg

SEQ ID NO: 712059 - DNA, 910 bp, Homo sapiens
atagctactctcataaccctcaacagccactccctcttagccaatatgtgcctatgccatactagtctttgccgcctgcgacgcaggcggtgggcctagccctactagtctcaatctccaacacatatggctagatagtacataacctaaacctactccaatgctaaaactaatcgtcccaaacaatttatatgactaccactgacatgactttccaaaaaacacataatggaatcaacaaaccacccacaagctaaattattagcatcatccctctactatttttgacaccaaaatcaacaacaagctatttagctgtttccccaacctttttccctccgaccccttaacaaccccccctcctaattataaagtaacctgactccgtaccccctcacaaatcatggcaagcacaaccgcaaagtaaatccagagaaccacactatcaggaaaaaaaaattcttaccgtcttctatagtaaatctcccttaccaaatcttccttaattatacaccatttcacaggccacaggaacataaactccatattagagatatcttacttacgacaacaacacattattccaaacccttgggtatcatcacccgaggaggcaccagcagaaacgctagaacggcagggacatcactttctattctaaaccctagtaacgtccccttcccctaatcatcggataatttaaactcaaaacctaaggttccataacatctactattcatctcactgcaagactataaattctgagcaattaatatactagtaccaaagttaaagaagatcctttaaggccacttaggcttgagctgtaggcccatgggtacagacgcggcacaaaaaggaggatacgctataacggaaatccttgtcacaggaaccggcgcaaacagtg

SEQ ID NO: 712060 - DNA, 115 bp, Homo sapiens
caggctgagagtgaccacgacgatgacgaccatctgattaaacagacacaacgacaaacgacacacaaacgacgacgtacacccacaccactgaccacaccaacaggaggaccct

SEQ ID NO: 712061 - DNA, 280 bp, Homo sapiens
catctctttctgtacagtcatataaatcagaaacccagaagtcttggacactgctgtccctctgcccttgtgtacaatacagtgttagattttcctgaatatctcttgaattcattggcttccttccaccatcactgccatcaccctattcgaagctactatcctatcctgacaggacttttgtttcccacctggtccatccatattccagaatccagaagccagagtcctgttgaaaatctgatttcatcttcccctcagcctgcaatcaagcctggaa

SEQ ID NO: 712062 - DNA, 599 bp, Homo sapiens
tacaattgcactgctgttcctgccacaggacggactgtcggccggtatttcggagattctttgacattggggggaactttattcttcctgggcacactttctctctagaagggacccttttgagatccttcacaggcagggcatgtgaagcatgctttcctgctatgaaaatgagcctcaaaaaggggccctcaggtttttttattattattattggcttttcagggagaacccagcagttgacatccaaatttagccaaagcccttccctcccataataggtggggcttccccagtttgttaactggggtgatctgtaaacttcgggtggtatttctaaatttatttccagaaacctgggtgggaacctaaggggaaggtctcctttagttttgatataaggttttttaaagggaattattttgaaggtcccaaattggtcaagatattaaaaggggggatttttctttccccaaatccaaggaccaatgctgttgtaaacaaggggtaaagggcctaaaatggtatgaaaacccttttaccccttttaacctaaaggtttaacaaatttaatttttttttttaataaatttccttta

SEQ ID NO: 712063 - DNA, 805 bp, Homo sapiens
  misc_feature (12)..(12): n is a, c, g, or t
  misc_feature (21)..(22): n is a, c, g, or t
  misc_feature (33)..(33): n is a, c, g, or t
aaaagggaaggnaaagaaatnnagagaaaaatnattatttgagtcaaggaaatatgccgtatgactttgagatcaacaaagacaactgcacaagaggaattttgacactgggcctacagatatacaatgagcttacaatcagaacttgatgagatcaataaagaactcttccgtttggataaagaattggatgactatagagaagaaagtgaagagtacatggctgctgctgatgaatacaatcgaatgaagcaagtgaagggatctgcatattacaaaagtaagaggaaagattgcaagcagttaaacagctaattgtcacacatcaggaacatggttggagactatgatagacagaaaacatagaaggctgatgccaagttgagtgagaaaataaggatctcacatctctgcaatcttctcagaaggtaaatgactttggaccataaccgcggaagccaaacctctgagagcatcacattcttggctgttttaatatcatcagtattgaaacattctataaattcctttgggaaatcaactgggatgaacacttcaattaaggattttatgcattaaatattgattttggaattaagatatacattctgtttgaggttttcaagtcctaaaggaaggaagtggtgtgaactatccctatacaccccgtacgatagtctttatacctacgtttgtttggattcattaggtgatttcaatgatagtcgaatagaccttgtaaatagcagggaattataatgtgatattcaagagtaagtgattgtttatagaaatatgattagaa

SEQ ID NO: 712064 - DNA, 774 bp, Homo sapiens
gtgcatgcctgtaattctagctactcaggaggctgaggcagaagaatcgcttgaacctaagagagaaatgtagtgagccaagatcactccactgcactccagcctggacgacagagtgagactctgtctcaaaaaaaaaaaaaaaaaaaaaaaaaaaaaaatagggctgtttatggcggatgggggggaaaaaaaggctttggattgtgggcagtgaaaaagtgggtaagattctttttaggaagaagcgaaagttttccagttattctatttaaaatttataagggtgcccattttcctttagaattccagtacccggaagaaattattattggctaggggagcctaattaggaacaggttatttccaaagaattaacattatagtggggaattatttaagaactaatttatttatataggtggccagcaaggttgggaaaaacaatctaaagtggtctttcaagaaggaaaattgggctccacataatttgtttggtaccattttcccttacaaagggaagtttggtgacagctcctacagaaagaagaaattaggggcgtgattcttttaaccatttggagtgtgaaacacgatagttggattttatcggtcgaaaaaaaaacgcgtggcggggctgggcctgggggctttaatggcctaataatcttaacatttgtgggacgccatggttaggaggatcgtttgagcctaggagtagaggtaatcgtgggtacccaagtgtgagacccttttctacaaaaaaaaaaaagg

SEQ ID NO: 712065 - DNA, 317 bp, Homo sapiens
ttggctggcccatggctggaatgagtttgctgctgacaacagcgaacctgtgtggaagaaacacctggatcagtttaagaaccccctgatcctgctgctgctgggctctgccctggcgagtgtactcaccaaggagtatgaggacgccagcagcatcgccacagcagtgcttgtcgtggtcactgtcgccttcatccaggagtacaggtcggagaaatctctggaagagctgaccaagctggttcctccagaatgtaactgcctaagagaaggaaactccagcacctgctgctcgagaactgttcgagatcctctag

SEQ ID NO: 712066 - DNA, 529 bp, Homo sapiens
aaagagttcctgactggcaattggttgagagagttaaactttacctgaaaagatgaagtcagcttaagttaaagtaagggaggcttggcttaagtcatgtagatgaagcctccaggtagcaggcttcagagagaacagatgatgaatttttctttttaggccttaaaaggtgtcagactctccagaaaagacctaataagagaaggagattctctacagaatgcagtttcccccacaagagacagctttgtagggccatttcaaaatacgtcaaataaatatattggggggtaaatttcctttggggcctgctgtcatgtgatgctataccagagtcaggttgggatttggtattttattgccacaaagggtctgtttggttagtcttaagatctctgttttaatgttaatgctggtcagttgtatttaaattccaaagggaagagggtaatatgaggcaccctgtaatctgaccataatatgaagcaccctgtctttccatcatgggctagttttttaggtgccttgg

SEQ ID NO: 712067 - DNA, 241 bp, Homo sapiens
gtttttttttttgtcttcctttttttaagcctaatcatcgcttacttctttatcacgttccttctccacaaaggagtaatgggatatccaataaactgagaatgtttctacacaatctccttcattctggtgcagtagtccttgagagaacccatctcatcaccagaggcagatgtttagtacctaaacagctctaaagcttctcccgattttgagagtctgcgtatactccaagcttatg

SEQ ID NO: 712068 - DNA, 949 bp, Homo sapiens
cgtggtggctcacacctgtaatcccagcaccttggaagaccaaggtgggatgattgcctgagcaaaacggcgaaaccccatttctactaaaatacaaaaaattagctgggcatagcggcacatgcctgtagtcccagccacttgggagtctgagagaggagaatcgcttgaacctaggaggcagaggttgcagtgagccaagatcgcgccactgcactgcagtctgggcaacagaatgagactccgcctcaagaaaaaaaaaaaaattaccaaaggtataccgagaggaagcgggaagcagccccctcctaagacaatctatcatggccggatgaggaacgataagctcaccgcctgtaaaccccaagcaactcaaaggagatctgaagacgacgggaacaatgaggccacaggagtccaagacaaagccgggaccagacaggggtgaaacccccaatcgcaaccacaacaactattcaaaattcggggccagatgcaggtggaccaacacacggtaaaaacacaagcaaaatacagaggacacgaacgcacgggaccaccgggaaatggggagtaagaagaacaaacgagaacaaatggggaaaacccgatcacaaataatttagcacgggaatgggacacatggctgtgatcgagtaccggaagcgaggcagacaactgctgacccaggagcaggaggttcgcacacagaaacgggacattgcatccaccgggaacaaacgaagcggtccagacaaaacaacaccaccagaaaaaacaggcgagagaaagtgaaaccaagccgaacgaagggaacatcacacaaggcggcaggacaagacaaccaccacagcgaaggacacacgacgcaaaaaaaccatgccggcagagaacagggcgcaccagactccagcaagcagtgcaagcagcgcagagacgagacaacgac

SEQ ID NO: 712069 - DNA, 215 bp, Homo sapiens
tatgataatcactagagatactcatcagtagctgtagcaataggtgacatacagcagaatccaaggattagtgacagacaatgtacatgtcctaaggaatgatagatagatagtacccatccttacaaaagtcattgtctcatagaaactgttaagtgttcaaaaaggtatctcaatatttcacattaagtacagaagcgggcaatccggattac

SEQ ID NO: 712070 - DNA, 102 bp, Homo sapiens
ggagatctctggatccatgaccatccttttccttttgaataatcaactaagatgtatatgtaagaaaggaaaaggatgtgatgaaaatagagaaatgagagg

SEQ ID NO: 712071 - DNA, 159 bp, Homo sapiens
aaagaagacaaaaaattgaagagaaagatcccacacaaaggaggcaaaaagttagcacaaggaagaattggaggaggacttaagagaaagtaatccacccaaaattgagagcagaaagaactctagacatgttcagcgttgtcattccttgatgacaga

SEQ ID NO: 712072 - DNA, 185 bp, Homo sapiens
cttccctcttcacactgctttagcggtgatgactacaacttatggagagtgtttgatgtccagataatgcccgaagacttagacatgcggcttcaccgaattggacatctacagcaagttccgtcccagccgtgccatgcgctgccttagagtcaggttatgccgctcaattggctgcagatatc

SEQ ID NO: 712073 - DNA, 324 bp, Homo sapiens
tgaatgcctgggaaccaaaaaagctttaaggaatgctttctcggccggacacagtggctcacacctgtaatcccagcactttgggaggtcaaggcgggaggatcacttgtgctcaggagtttgaaccagccggggcaacatggggaagcctcatctttaaaaaatacaaaattggtgaggagtggctcactatgcctgtggtcatagctacttgggaggctgaggtcagaggatcacttgagcccaggaggtcaaggctacagtgagccatgatcacaccactgcagtccagcctgggctacagagcgataccctgtctgtctc

SEQ ID NO: 712074 - DNA, 324 bp, Homo sapiens
tatctctatctcagttcttgcgtagctggtactatagttgcaccactatgtgcacctaattcttaaatttttcatagacagagggtcttgctatgtggcccaggctggtcttgaactccagcctcaagcaatcctcccaccttggcctcccaaagtactaggattacaggcgcaagccactgccccttagtccatttcagtggttttttcttttttttttggaacacggagtctaagtctgtctctcaagcctagagtgcagtggcatgatctgggctcactgaagcctccccgtcaaggttcaaacgcagtgggtcaccgagc

SEQ ID NO: 712075 - DNA, 769 bp, Homo sapiens
  misc_feature (572)..(572): n is a, c, g, or t
agtgtcgtgaaatgtaatgaacctttactaccttttaggggtgccatggatactcgccagagatttccttcagccacgccaagtcttaaaaagaaaggctttttctaatccgtttggtttaagacactaaaagaagtttccattagtaaaggtgtgtaatgtatggagccggctgattttttttcctccagtgaggcattaagcacacatttattcccatagaaactatgcccttgacatatggaaatgattcttttctgaaagtattcatgatctcactatgatgtattaggttaggtcaccaaggttttatctgaggtgatttaaataacttcctgattggagtgtgtaagctgagcgatttctaataaaattttagttggccccctttagtagtcatagtgaagccggtctagaaaataagcctttggcagggaaaaagggccatgttgatttatttcagtatttaacccccttaatctggatccccttgtctggcttttgtaaattcatcccgggccagactaagtatgttgggtaatagggaccccttttttttttttttaaggctnaaaggggaaaaaataatccccccttaagctaattaatattggtcctttaatttaaaggatgggaatttttcctgtttaaaaattattccagccctctttaaacccctttaacagccccccgtcataaaaatgtgttcttttccaatatttgcttggcccccccccttgaaataaataaaactttgttttttaggaga

SEQ ID NO: 712076 - DNA, 149 bp, Homo sapiens
cttcatccagaaactgcgggagggtgggtacagctatgtaggacctagtggaagggttacatgataggacactatactacgccctgacagcgaatcctagtgtcagcgagacacgcaggaccgaggagggaggcccatgcgaagaagcc

SEQ ID NO: 712077 - DNA, 847 bp, Homo sapiens
tgaaattttccaggacatggttcatatccggacgaagcctgggcctgtgaccgcagtacgacatcctgtttgacaacttgagcagtcgcagagcacctttatctctatcgcccagctgaagggcctgtcacgtcagaagtgaccctgaagaagtcaagcgagatgctgcacatcatcgtgctggaggacaagtggaatctcacggagccgcttcctgagctggggtgcatgaggcgcaatgctctccatcggcatcgccctcatcagctaggcatccaaggtgcttgatacttgttgacgagcccacctcgggcatggactgccatctccaggagggccatctgggatcttcttcagctggcatgaaaagttgaacgcaaccaatcgtgcttgacacacccacttcattggactgatggcttgacctgcgtgggatgaccgcatcgccatcattggcacacaagggggggaggcttggcataggtggctgacgaggtcaccttcgctggtaccctcaaggcaagacaacatactggtgacctgggtatcacaatggacctgcttggtttacacggacgccggacactgcaaaccccgtgaaaaggaaccattcgtcccccacgcattggataccccacccaaacaccagggttggcgccaaaaggccacaccggcagtggaagaacgcaaaggcgactgagaggccacggaagcagggaccgtatgacaacacctccccagaacagcaagacggcacgatgcttggcacaggccagcttacggaacagactggaccacacaccacggaacgacgctgggacaaggccaacgctgaggaggaataaaa

SEQ ID NO: 712078 - DNA, 169 bp, Homo sapiens
ctgcacagctgcaggcagttcttacagcccagagtgagcctgaatccttttgatgcgcgaatcagccagtcaatcttattctttggtttcgttttctttctttcgtttcgttttctttctttctttctttctctttctttctttcttccttccttctttctctttcttt

SEQ ID NO: 712079 - DNA, 339 bp, Homo sapiens
taaaatgtcaagagagtgaaggtcttgatcctctctgaatagcattggtcactttgccagtaaatacagcatgctaagttaatgtgctttaaaatataagcgttttccgtcagactcttcaagttcttcttgaaccctgggggcacagatccatatataacctccctttacagtatggcggggtgtgaataaactacaacacatatgcatgcataagctgtgaatcctgcactactttttttttctttttccccccaaagaatatctctggggaaaagttttaagtacgtaactaaactttattgggctgctaattggcgcatggaaccggatagctgg

SEQ ID NO: 712080 - DNA, 302 bp, Homo sapiens
  misc_feature (134)..(134): n is a, c, g, or t
gaagggggttaggcagaggaggcctcatgtgggtgtgactgtgggtcgatgccagagtgagactagtctcatagattggacgctcagagagatcaagcgtatcatgatcaaatttcagagtattgtgaatatgntcatatcagatcggatagcatggagctcttgcaatcatctttcttctttctcctcccatttcttttcttttcttccatatgatcagaacatcgattcggaagcgtcccttgagtcaattaatgtctttcattcagatgctcggtacgactatcatacaatcggaattg

SEQ ID NO: 712081 - DNA, 234 bp, Homo sapiens
agggggggaactctcaagtcacagattttctttttttgttagtgggagagaaacatatccccttaggggttggactatgatcgggtccctataaccagctaaataaacttcccaagtaaaatactcgggtgggagggatatccccctaaccctcacttccatattccatacttccagataattcttggagtttcaccaggttgccagattttttcttttccctagaatttctcc

SEQ ID NO: 712082 - DNA, 667 bp, Homo sapiens
cgctccgggagctgccgacggacggagcgcccccgcccggggcggcgctactcgcccgtaaggcgccattggccttctccaagagacacaaggcactgaagctgcgcttcccggccgaggacgagttccccgagctgattcgcccaaacaaccacagtggcccaggtggctgacccccgagcgtgtacgcggagcgtgcgcgcccagagcacgccgagcggactacacgctggacgacgtcatccagacaggcgtggacaacccgggccaaccgtacatcagtgaccgtgggctgcgtggccggtgccgacgaggagatccctacgacagtggttcaacggactctcttcgacacccactcgatcgagggaccggcaacggcggcgtaccaagacccagcgcactgagccagcaagacacgaccctcgacacccgaagaacctgcagggcggcgacagaccctggaaccgaactacgtgctgatctcgcgaggtgcgcacgggcccgacagcatcccgtgggcttcgtgacatccacgccgggactgcaagcccgacggggagccgccgagccccatcgagaaagcctcgcgggaggaaggccctgctcacgacatgagaccggggacgctgagcggggaccgaatactacagcgctcagggagcaa

SEQ ID NO: 712083 - DNA, 259 bp, Homo sapiens
aaaatccactggcttccaaagaaacgatagaacagagagaagcaagcaggcgaatcgtacgtgaggcgtgcgccgccacatatgcactgtacattccccaagcactgccttcttatattacttctttctagcgtgcttaacttggtaagatgcaaagaggttggatcaagttgaaatgactgtgctgcccctttcacatcacagaactactgacaacgaaggccgcgcctgcctttcccatctcgtctcttctcttgta

SEQ ID NO: 712084 - DNA, 244 bp, Homo sapiens
tgggaagatcgcttgaactcaggagtctgagaccacccaggggatacatggccacaccctagtattctacaaagaaatacgaaaaatcagccaggcgtaggtggcaggtgctgatgaatcccagctgactgtaggtatgctggaggcaggcagaattcgcttgatacccatggcagcagaggttgcacgtagagcttgatatcatagccattgcactccagcctgggcaacagggtgagactcc

SEQ ID NO: 712085 - DNA, 188 bp, Homo sapiens
gctgtatagactcctcataactgaacactctgtcactatctcccttagcagcgccaccaggacaggaaaaccgatagcaggcggggaccaggtataggagggcaggctagagcatagcttgaagatagtgcatagatgaagatggtacaggccctaggccgaaagcatgtaggctagcaaacgctggc

SEQ ID NO: 712086 - DNA, 584 bp, Homo sapiens
  misc_feature (306)..(306): n is a, c, g, or t
  misc_feature (327)..(327): n is a, c, g, or t
  misc_feature (329)..(329): n is a, c, g, or t
  misc_feature (344)..(344): n is a, c, g, or t
  misc_feature (360)..(360): n is a, c, g, or t
  misc_feature (362)..(362): n is a, c, g, or t
  misc_feature (372)..(372): n is a, c, g, or t
  misc_feature (445)..(445): n is a, c, g, or t
  misc_feature (564)..(564): n is a, c, g, or t
atcccctgtgaaagatgtggaactgagacacagagaggtgaagtgacccacctaagagttatgcggccaacccattgggcaatgttaggaccagaccacgggtccttgacagctctgtgttcaatgactaggttaaattgcttctctgtctgcactgcaatgggagaaataggactccatttggcctcttacctgctggattttcctgtctttacgatccttgaagtagcccgaggctttgctggggagaggtcttaggacccagcctagtttggtattggttgttttatctggtaaaggtgtttngtcctccatcccactcccagncngtgctggcctgtgantgccaggaaagtcaananaatctatctnaaggtcatggaccagaagaacctgtggcaccacgcacctttctgcgagttccacactgactgtatttcaccanaagaggacttttggtgaagcagaacatctgcgtacaagtaccttggagttggtgctatgtgagccgatggtggaaacaggttgcggctgaaaatgagatgtgaaagttctagaatgatnttctagtggcttgagctctg

SEQ ID NO: 712087 - DNA, 190 bp, Homo sapiens
gtaacaaggccggggttgaatgataggtacataatactattccactccacaccacgtttccaccctcaccctgccccctcatacggaggttggatgggggccgagtgaggtaacccggtggcatttaccccctgttttataaggaattttgtacagtctttgtgaaattaaataacgtgcttcaatttga

SEQ ID NO: 712088 - DNA, 181 bp, Homo sapiens
cttgctaatcctgtctggtaaggatgtgcctcttacctgcaagtatcttgttatcggcctcctggagacaatctcacgtggttagtccattcacacctacctgtggtgtctccagtgatggagcagatactcaaggaggcactgggctcagcctgggcattaaagggacagagtcagctca

SEQ ID NO: 712089 - DNA, 253 bp, Homo sapiens
  misc_feature (36)..(36): n is a, c, g, or t
  misc_feature (53)..(53): n is a, c, g, or t
  misc_feature (63)..(63): n is a, c, g, or t
  misc_feature (72)..(72): n is a, c, g, or t
  misc_feature (76)..(76): n is a, c, g, or t
  misc_feature (81)..(81): n is a, c, g, or t
  misc_feature (169)..(169): n is a, c, g, or t
  misc_feature (195)..(195): n is a, c, g, or t
cgtctaaagctcttagctactgatacgaagccaccnagaataaagactacatntcagatttcnttgcagctnaatnggggntaaccaaatagtgtgtgtgcaacttgtgagacacatccttaaatgaaagaagcacacttctctttccctttcccctcctttttagctngaatacaaaagcaatggctggaactntggcagtcatcttgcatcatggcagaacacatgacgaagcaacgaatgactaggtatc

SEQ ID NO: 712090 - DNA, 437 bp, Homo sapiens
atggtgataacaaaccattaaaccaagcacaggctcttcgtcagcacaaggaactataagatcctgtgtacctaaagctagacctgatgagacatatggatagtagggcctctccccacatcctacaactatttcagcccgctggatgtcttgcctgccttcgtcacaccaggcacacatctagcctatgcctgctaaagtgctataactagtttccccgacttaaagcctactctaccccagatagccctagccctcgctccttcatttcctgcaggtttctgcccagagctcacctatagcagaggggcctccgccatcagtctactctcaaacagcatccctcacaccctccctgcatcctctgcaacaaactctcagcttttcactaatggattctcttgtctatcattgcattgcccttctcacgctgatag

SEQ ID NO: 712091 - DNA, 384 bp, Homo sapiens
aaatcatcagccagtttagccatgcatccatgcaatgactccagcgagagtggatttagtctccacagagaatgcaacaatatggaaatccacagtggacattgacagaccaaaacaagcgactatcagctggtgagtggaaacgcagcacggaggactcgctcacatgtacatgctcagatggcagagaatgcagaagaaggtagtggtggcggaggccgtgaagaggatcccccctgcagacaccaaagctgtgaacagaaagactgcctggccagcacaccttgggacatcagcctggcccagcctgaaagcatccgcagtgacctagagagttctgatgcacagtcagacgatgtgccagacatcaccaccaggatcacc

SEQ ID NO: 712092 - DNA, 621 bp, Homo sapiens
ggaaaaaggaactggcaaatctggctcaattagaagccttgtaccagtcttcttgggcacagccagttagtgagatggtggggaggactgttctcttcatcaaatcagttttgtgcacggtcaaggcacaggcatgcaaccacagtcgcagcaatgtgcacaacacaccttaccacctcagtctcactctgcgcaccaagcttctcttcaccagcgaaagcaagcatcactgcaacatgctcagcacacacctgcagccagtcagcaggcattgggcacacgcttgggggcagcagcaggaccatgaggaacggataccctgaacaacacgtggggagatcctctcttacacaagcagctcgagcttccatcaggcaactcccacagtctccacagatcccagtcgggtcaccaactaaaagtacaatacaggccacattaacaccttctgcatatgaaatctataccctcaaatccctcatcacaacatacacgcagcaatactgaaccatctgaactacaaaactcagcagacattcatctatgtatacgttcatgaactgtgtaacgtcataaaaaagcacatagtgtgacagtgcataagtaatgtgaatccgactg

SEQ ID NO: 712093 - DNA, 239 bp, Homo sapiens
  misc_feature (26)..(26): n is a, c, g, or t
agttgttcttcaagatcactgaaccntgaacatacccatgtgatttatacaattttcccactgtccttgggcttatgccaggcaagaggtacacccctcgcaaaacatgcatgctctgggcgtgacattggcatcttgcttgagctggttttgggaaccctgcaatatttctactagctatgctcctctgcaagctggcccaagccttagcccagacaccccaggctatttccctttaa

SEQ ID NO: 712094 - DNA, 219 bp, Homo sapiens
  misc_feature (27)..(27): n is a, c, g, or t
  misc_feature (85)..(87): n is a, c, g, or t
  misc_feature (132)..(132): n is a, c, g, or t
  misc_feature (138)..(138): n is a, c, g, or t
  misc_feature (192)..(192): n is a, c, g, or t
  misc_feature (200)..(200): n is a, c, g, or t
  misc_feature (212)..(212): n is a, c, g, or t
cacaagcaaaacttttaaatatttganttgacagttacatgtttcataactttgtatgtctattggttgtgcaggtgtaattttnnncctttttgattaggggtacaaaatttagagaccagtatgattaantgaagntccttaggctccttcggcctagtctctgcatacctcaactttacggaccaatgntactctgntgttcacaattncctcatg

SEQ ID NO: 712095 - DNA, 451 bp, Homo sapiens
  misc_feature (340)..(340): n is a, c, g, or t
  misc_feature (343)..(343): n is a, c, g, or t
  misc_feature (345)..(345): n is a, c, g, or t
  misc_feature (363)..(364): n is a, c, g, or t
ttgtaagtaaggcaatgcctggtgatgggttcttggggctcctggagtttgatttaataacaaatatttattgaccacatattgtcttgtactgtgagaggccttatgggaggtcaaaaggaattttgccctaatgatcttaataatctccataggacaaaaagtgcacatgtttaaagtggaaaacaaggaaagtctggcagatgatgggtaaatttatttgctgatcaatgtgaatgaggcagactaagaggtttctaccagaaagaacttgagcttcttgattcgagttagccatcaagtaacttgaggagaccttgggcaaagctatcttactggnctncnatattggagaaaggcccnnaaaagcccctgggataaggctagttttattatttacctttcctcctttatccagggggacccccgccccccgccaatggtccttaag

SEQ ID NO: 712096 - DNA, 980 bp, Homo sapiens
ggcgtgaggctggatcatttgtggtgtgagggttcccacgcgtgggcagcaatgagctgcacctcccagaagggcagtccatcctgacggggaggagggacacttgctctgaggcttcagggcagcagggtagcagggtaggtgggttttgcaggtcggagtccagaggttgaagccattcatggtggaaggccctggctttgtcaggaggtaggagagaggtggtctgccactgggagctgacacagtggcttgaggagggggctggatgtttgcagcagttactaaggaggtgagagatggagctggtaaaggccaatccaaagagtatcaagtggtctgggggcccaggtgaggctggagccacaggtggagttttctaagatagtgctgtgcagagccggggatgcagggccacgcagggtgcagaggagcaggctgggtggtcagccctgcagtcagttaagtcaatcgaggaggaaatagtgggagagaatagaaagatcaagaccctggaggtctctctaaaattaagaggccagccaggcacagtggctcatgcctgtgaccctagcactttgggaaagctgaggcaggaggatcgttaaatccaggagtttgacatcaggcctgggcaaatagtgagaccccatctctacaacaggcaacatgaataacataccccaggtggcatgtcctgtagtcccagcttcattgggaaagctgagcgggcaggatcaatgggcctaggaaccaaagggaaagggagcaaagatagtgctaatgatacccacgggggtgcaagtgaggagccatgtggttggggtgcatttatagcccagtgccgtacgaaggagtgcttatccccggacaagggccaggttgtgtgtgtgtcaacaagtcgcacgcatagcacgggagcaatattaacggaaagagggaaataaaggatgtgtgcgcgaaaaagcacatagaagacc

SEQ ID NO: 712097 - DNA, 131 bp, Homo sapiens
acgcacgccaccacattaacgaaacgcgttcaacgctcaacacccactacctaaaaaattcccaaaccatataacttgacctgcctcacacccaatttcgacccaatctattcaccctatacgacgactaa

SEQ ID NO: 712098 - DNA, 172 bp, Homo sapiens
  misc_feature (104)..(104): n is a, c, g, or t
cgattcgagtactctaaggatccggctccactgtgtgctgcactgtagtagtcacagctactgggcaaggggtagaggtactgaggcaggaggattgctagagngcaggaagtgaggctgcagtgagcgtgattgcgccactgtgctcagcctggtgacagagccaggccct

SEQ ID NO: 712099 - DNA, 243 bp, Homo sapiens
tcagtctgaacggagcttaagggctgagactatgaggtactatgagatatagaattcagtacatctgcagaagagacgtagtttgacttccctcttcctatttgaataccctttatttctctctcttacctgactgccctggccaggacttccagtactatgttgaataggagtggtgggagacagcattcttgtcttgtgtcagttttcaaagggaatgtttccagcttttggttatttcag

SEQ ID NO: 712100 - DNA, 981 bp, Homo sapiens
  misc_feature (34)..(34): n is a, c, g, or t
  misc_feature (46)..(46): n is a, c, g, or t
  misc_feature (49)..(49): n is a, c, g, or t
  misc_feature (95)..(95): n is a, c, g, or t
  misc_feature (98)..(98): n is a, c, g, or t
  misc_feature (101)..(101): n is a, c, g, or t
  misc_feature (104)..(104): n is a, c, g, or t
  misc_feature (128)..(128): n is a, c, g, or t
  misc_feature (137)..(137): n is a, c, g, or t
  misc_feature (140)..(140): n is a, c, g, or t
  misc_feature (147)..(147): n is a, c, g, or t
  misc_feature (149)..(149): n is a, c, g, or t
  misc_feature (159)..(160): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (185)..(185): n is a, c, g, or t
  misc_feature (190)..(190): n is a, c, g, or t
  misc_feature (192)..(192): n is a, c, g, or t
  misc_feature (198)..(198): n is a, c, g, or t
  misc_feature (210)..(210): n is a, c, g, or t
  misc_feature (221)..(221): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (255)..(255): n is a, c, g, or t
  misc_feature (324)..(324): n is a, c, g, or t
  misc_feature (399)..(399): n is a, c, g, or t
  misc_feature (406)..(406): n is a, c, g, or t
  misc_feature (457)..(457): n is a, c, g, or t
  misc_feature (488)..(488): n is a, c, g, or t
  misc_feature (512)..(512): n is a, c, g, or t
  misc_feature (516)..(516): n is a, c, g, or t
  misc_feature (523)..(523): n is a, c, g, or t
  misc_feature (525)..(525): n is a, c, g, or t
  misc_feature (534)..(534): n is a, c, g, or t
  misc_feature (536)..(538): n is a, c, g, or t
  misc_feature (549)..(549): n is a, c, g, or t
  misc_feature (557)..(557): n is a, c, g, or t
  misc_feature (564)..(564): n is a, c, g, or t
  misc_feature (692)..(692): n is a, c, g, or t
  misc_feature (771)..(771): n is a, c, g, or t
  misc_feature (836)..(836): n is a, c, g, or t
  misc_feature (850)..(850): n is a, c, g, or t
  misc_feature (860)..(860): n is a, c, g, or t
  misc_feature (866)..(866): n is a, c, g, or t
  misc_feature (871)..(871): n is a, c, g, or t
  misc_feature (875)..(875): n is a, c, g, or t
  misc_feature (883)..(885): n is a, c, g, or t
  misc_feature (887)..(887): n is a, c, g, or t
  misc_feature (896)..(896): n is a, c, g, or t
  misc_feature (900)..(900): n is a, c, g, or t
  misc_feature (902)..(902): n is a, c, g, or t
  misc_feature (906)..(907): n is a, c, g, or t
  misc_feature (913)..(913): n is a, c, g, or t
  misc_feature (978)..(978): n is a, c, g, or t
ccgccccgagggttcgtggccccccgcccccccncggtccccgccnccnccgcccacgcccagcgttgtagagaagatggtgggtcggaacagcnccnccnccnccggtgtatgcggggcccctttcnttgggtacngcntccaccncnaccgccaaanncnaagtgacccccnccnccagaacnggccncnagaacnaagaaagaaacngaagcctgccnaggagagagccgggcntnccnagttacctgaccntaaagatgccgaagccgtcccgaagttcccccctgaagaaatacagcctggtgaagagttaccagcccnaggtgaatatgagaagggcgtagaccctccgacaaatgccattgccgtgtgtggaccgccccagccgtcaccgcnggccccnccgccaaccccccccccccccgtgtccccgatgcccccgaccaagcccccnacaattagtcagagaattgtaagtgcccagngcctggccgaagatgatgtggaangagnaaccaangnccacccaanannngctccgccaancccattcnacccctnccggtagttgagcagctctgggggaataagggcaaatatgcttgttatgaactacactgaaatctaccaaagttaatgtttactttgtgtagatccatttgtctattttatttatttttcccagtganaagtgtattttgatagagaacttttcattctataaatacactatgagttactaaaatatcatggattttgtttattccngaaacatagttacatagttaaactgtacatatgacatggcttatgttaaaaatacccagtgctcngttttgaaagatangcaaaaaaanaaagtntaggngaantgaagatnnncnctttttagngggncntttnntgtaanctggaatatgaagactgactgtgttgtgaaactgagcataaggtttgatgtccttcttcctttanccc

SEQ ID NO: 712101 - DNA, 183 bp, Homo sapiens
gactgtacaacgccgtcctcacggatttttaccaagccactacgctttccctgtaggtcttaggcacactggtcatgctaggtctaggatcctctacgcacaacgcctgctcgcgctcctccgtagtggttgccaagaccaagtccgcctgtctatctatcatcactcaaattagcactacgc

SEQ ID NO: 712102 - DNA, 988 bp, Homo sapiens
gatgcccttcgatcttcaaagctgcaggctgtgatcgaagtcatctgtctgtaatcgctgggtggatgcggcgggctcctgtggaatctgtgttggatccgagctagggcgctggcacatggttgcgaagactgcgcagcagactgtagccatccgagggcaggcagacaagaatcatcatcaactgaaatccgactgaaggagttttccacgggaggcccggtgtgcgagatgtggtaacgaagtacagcaacttcgtcagattacccttgtacttgaatggaaggcggatgaacaccttgacaggccatctggatgatggaccccacaggatgtccgtgagtggcaaacatgaggagttctaccgctacgtcgcgcaggctcacagacaatgcccgctacaccctgcaactataagacggacgcaccgcatcaacatccggcagatcttctacgtgcccgacatgaaaaccgtccatgttagatgtgagacgggagctgggctccagcgttgactgtacagccgcacaaggtcctcaatccaggacccaaggccacggacattcatgcaccaagtggatggcgcttcatcgaggtgtggtggacagtgaggacattccctgaactcagcgagagctgtgcggacaggcacaccttcagggaaactccgggacgtttcaacaccatgcagggtgaatcaagattctcaactgcccagcagtaaacaacgatgctgatacgtacacaaacactaccggaagactaccgcccgtacataaacaggcgaatgacagccgcaacacatgcacgcaggagcaacacagcacaccgacatccctggtacagcaccaagaacactaacaccacctatcaaaccaacctaacggtcaaatgactgtactccccttcggttcacacttcataccaccacacacacgctacgcaccgcaccctcgcacagaccctcacccctgcccacgataaaccc

SEQ ID NO: 712103 - DNA, 365 bp, Homo sapiens
tttagcaatgtgcaacccagcaggacccccaaataagtaccaatgcatctgagagactgagaaacagagatctagaccattttacaagacacggatctctacttagccccaaacagaaccatcagcacttccaaaccccatgacagtaatcctctaacaaatagcaggcctggtttcccaagccaatatcctaaatagggagcaagcagacttcagacatggtaagtctacagcccatcatagttattgtgcactctctaataccaggtctcctgatgtcctattctagccctttctacaggataagaaatagcatcagcaggactatccaacaagacatattagatttggccttcttccctgac

SEQ ID NO: 712104 - DNA, 497 bp, Homo sapiens
  misc_feature (433)..(433): n is a, c, g, or t
  misc_feature (488)..(488): n is a, c, g, or t
aagccgggagcgagcccaggcggcagtcttgattcccttttggccagcagtttttaggtctgtcagtactgcactgcaagaatggcagattttgggatctctgctggccagtttgtggcagtgggtctgggataagtcatccccagtgggagggctctggaaaggtctgggtgggataaggcttcaaggcggttaaccgggcaatgtaggggccggcggtggtctggtgggaaaacatcaaggcaggctggttggcaatggtttaggtcccagggaaggcaccactctggcacaggtggctggaggattttgggctggaaatcggcccgggatccttcgggcctgggtgggatggtctttttctggaagggaggccaggtaggaggacaggccggtaggataacaaataggcaaaaggtggaaggacaggcantctaaaggctggtggtttcaggcccctggaactcttttctggggtcttggtgggnaggtgaaag

SEQ ID NO: 712105 - DNA, 353 bp, Homo sapiens
cgtattctggtgtactcgataggtcagctaccattggtggcccattgattttgatggtaacgggagggatcgttgacctcgatctgttatgtaaatggatgcgtagggatgggtgggcgatgaggactaggatgatggcgggcaggatagttcagatggtttctatttcctgcagcgctctgagatgttagtattcagttagttctcgctcgtgcaggtggaaggaaaagggcatacaggcactggcaagcagataaggccaatgcattatgagggcgtgatcatgaacggtgataagctcttctatgataggggaggtagcgtcttgtagacctacttgcgctgcctgtgca

SEQ ID NO: 712106 - DNA, 977 bp, Homo sapiens
tcaggtgtcattagctgaatctttagcttcaccaggcatgtacttcagtgtagagttggatgctgtgccaccaatagatgcaggaagtagtataatacagttaagggatgactctgagtgatggacgacctatgcaacatcccttccgagtatggcgcaggaatcatacgggcgtaactaaagtacacgcatcaaatactcgtcagtagtacaagtaccggtctcacttgtagatgactgtgtccgatgttgtcgaaaacatgacaggatacggagctccacttgttagctctaaacctagatgggtaaacttaggatgaagctcgttcaatatgaagctctactgagagtggacaagcaattatatcgggctgcctataaatgagctaaaaaaactcaccagtgaggccagtgtacgttgatatgacattagttatcatgagaagtctggtagtatggatctccgattccgtatggggtaggcatattacctatctctcgtttctccatgaagctggtgatggaagaggacgcctgtcctagacagccctcaaatggttttccgctctatgttcaaagcctacagactcttctctattgcttggcattctttcaatcattttcaattcatcaactccccttttcaattgaactcaatttactgggggttcagaatctggatccttctatgcttgagccttaatctcctgcgttttttcattcaaaattcaggcaattggtcttaatcaagttttgagtggaaatttcttacctaaattggtgtggacatgttcatggatgagactcaatttagtgtccgtaaaacaatattaggaagcagccggactcaacacagagaggaggagagtttttagaaaaaagttgggaacaaaagtattatgtttcacacaaaggatataggagaaattgggtctagttaatgagaaataaaaggggcgagggtaaaaaattgcatt

SEQ ID NO: 712107 - DNA, 225 bp, Homo sapiens
gtaccccgtctactacgcggctcgatctaactacgcggctcaacttaaagtcactggctgcattaacccctagaaagagagtcagcctgtcctttgaagcttcgaaaccaggtattgacttctccactccagctatgaaagtcctagatggcatcttcctccaaaagaagactgttttgtctccattaaaagtctgttgttttttgtagccgcgtagtcagatcg

SEQ ID NO: 712108 - DNA, 102 bp, Homo sapiens
tagattagtcggtaccagtatactgatatattcgcatagtttctcgtgtatatgcatattgtccaatataaagagaatgatagcattgaatgactcggggat

SEQ ID NO: 712109 - DNA, 320 bp, Homo sapiens
acatcggctgaaggcaattttattcaatagttttattaattgtgtgcatgaaataaagtttgtgttaaatacttatgtgtggaattttccacttggtggtgtcatgtcagcatttaaaaagttttgaattttggagcattttggatttggggttttcagataagggatacccaacttgtactactctactttctgtctctgtagatttcccagttttagacatttcctatgactggagacctttgatgtgtggtcttttgtgactggcttctttaactttcctggtagaataaagtccatcaaagtgtttaaaaaaaaaa

SEQ ID NO: 712110 - DNA, 145 bp, Homo sapiens
actctagaggatcttggcaacaaaaaacgcacatccccatgtcacaagtgacaatgcttcgcgaacaaaccctcggatcaggctcaccagagccgaaaatccaatcaccgctataatgacgtaatcaatccagaccatgaactat

SEQ ID NO: 712111 - DNA, 734 bp, Homo sapiens
cacctggagacctttgcgagcagaaacgggagacctgtgcagatggtgagtgcagcaggctgcctatcaagaatagcctatccaacatccagtggcttcgaagagatgagttctgatggactgggctcccgcagtcatcaatgcaagagatggtcggaaaaggagaattgtcacctggagcagtcgagcaggttaaggttgaggagccttcgagaccatcagtgtgctggcagaactctgtgtctgagcggccaccctactcttacatggcctatgatacaattcggcatcaacagcactgagaggaagacgcatgactttgaaagacactctatacgtggcatagaggaccatatttggcctactttaagcacattgccaagccaggctggaagaactccatccgggcacaaactttccctgcgacgacatgtttgtccgggagacgtcttgccaattggcaaggtctccgttcttggaccatttcatccccaggtgccaaccgctacttggacattgtgaccaggtgttttaagccactggactccagggatctccacaattgccctgagcacttggaatcacacgtcagtaaacgaccgaatccatgagctccgtccggtaacatgaccatcatgaatgcgaatctccccctgggctgcacggaggaaagatgaagccactgctatcacgggtccagctcatacctggtacctatccagttcccggtgaac

SEQ ID NO: 712112 - DNA, 332 bp, Homo sapiens
cgtcgatactcagatcccacaaaacgacggcccgtgagggagcgttgaacatcgtcgagcgatgcccgtccagggagggatggccgagctcgattctccagaaggtagctggtgacacgagtgttgagcccacccaactagggtgacggaaatttctggggttccggcttacatccccaatatcgggtgcattcgtcgacaaggtcatttcgagagcttgcgcgttggccatgtacgcataaatgagaagcgccggcgaccagcgaaagaatttggacatcgtgaaatctctacagttgggattagcttatctgagtatcgacgtaccgact

SEQ ID NO: 712113 - DNA, 406 bp, Homo sapiens
tgtcacccaggctggagtgcagtggtgcaatttgagctcactgcaacttccgcctccctgattcaagtaattctcctgtctcagcctcctgagtagctgggactacaggcgcaagccaccacgcccggctaatttttgtatttttagtacagatgaggtttcaccatatgggtcaagctggtctcgaactcctgacctcaggtgatctgcccgtcttagcctcccaacgtgctgggattacaggctcaagccactgtgcctgggcagcctgctcttaaaaattaacttaatcggtactatcacttaaaaaagtaaacccttatagacatcatctaagtttaagaagttaccaccgtgtagaccttttgagtcttatatccatttgttgagcaaatgcccggtaacg

SEQ ID NO: 712114 - DNA, 111 bp, Homo sapiens
  misc_feature (30)..(30): n is a, c, g, or t
  misc_feature (71)..(71): n is a, c, g, or t
gatctataccctgccgaactgccgtgtgtntccccaacccttgacccaatgacaccaaacacagtgtgggntcggtattatatatttttttctcattaaaggtttaaaagc

SEQ ID NO: 712115 - DNA, 151 bp, Homo sapiens
tactgaacatgaccagtcccagtccctactaagagataattatacaacaaatatagtcacttatacttttatcatactggaatgaccctattgtacctggtacgatcccaacacagtgatgcagtgcttgagtgtaatttttttaaataca

SEQ ID NO: 712116 - DNA, 751 bp, Homo sapiens
  misc_feature (623)..(623): n is a, c, g, or t
accatatatcatagcctgttccctgggtgataacccccttcccacgttatttcgtacaccccccaagatatcatattctttcctaccaacacaacaccaatttgtggtcccaaccaactgcttgtgtatagtgttgctgtcttcacacatagagcagtgccctccattctagaagaataatatctttttgtagagacccctgtctcctctacatagtctcaccttttctacgatacaatactttctgtttggtgagacacacacccccccccgcgcgcccactttgtctctctctggtctgcttgaatgactaacaccgcacgacgagtgtggtgtgtataagcggtgtgcgtcgtgtctcccgcacacatacgtagttatctatatgtgtcgccgcagtgcgaagcacatagcagagtgatttatgtataagtatgttgcgcaacaacttatatacatgtggcgattttgggcgccccacgccgatagatagtgaaagcatgtgctgcgtggccctgcccaagaataggagacataggataggcgccccgctcctccgttggtaatatagcgtttcgtagtacaatatgtagtcgcgtagttagtacacacgacgatttcanacgccgggcgaagaatctccgctctcggtctattacgtgattcttttcggcgacgttgtctcgggcggagcgccacctgcagatattcaacaaactaaggagaaacaacagcccaacaatatacaaca

SEQ ID NO: 712117 - DNA, 120 bp, Homo sapiens
caaatgcagacgtcgggcttatctacggaaccccaattcgttgtcatagccgtgtcctgagtcctggactatagtagcaaaaccagtcaaaatcctaccaaattaaaaagaagtccctca

SEQ ID NO: 712118 - DNA, 733 bp, Homo sapiens
ggggcccatgtccaaagggtctctcagaagtttcggggggacgggggtgggcaccaaaataacccccaggggagcacgggcttcccgtcgggggttttccttcccctccggggcaaaagggccggggttgcccccggatggttgcccccccgctcccccgcgagccagttttttggtaagggaaaaatttatcccccttttggtaaaaagggggagagggcccccaatttcttgagtttggggaacccccccctggtataaggtttccgggcccgccccaggggggtgagggttttccaaccatccccccttggggggcttttgtgtttttaaaataaacccccccgtttgggggggggttttccaacccggggccaaaaagggtgtggggggtggccaggtcccccagtttcccccaaagggtcagggggggaaatgaaaattttccccaaacccccccccccccctttttatccggggggggaggacgggttcaaaaccgtttgtttccattggcccctttagttttgggggaaaagacggggttaataacccccgccctctgacccccccccaagggaaaggggaattttttggggccccccttgggttttttttttggggggggccggttttaggtttttgttttttaaacccggccttttttaggggacccccctgcccccaaatttgtccccgaatttttggccccccttaaaaagttttatgggga

SEQ ID NO: 712119 - DNA, 337 bp, Homo sapiens
  misc_feature (287)..(287): n is a, c, g, or t
ggacccgatactgcagttctttctggacctttacgcacccccaagcgtgcagctctgtcccagactttactgtgtgtgagagaggttctgggttggggcccacaccctctatagaagcttgtggccagggatgaaccttggccaaccgcggtgggccccaagcctggttcccaagagctttggaggcttggaatcctgggactggcccaagtggctggttccctgaggaccaactgggggccaagccttgtgcagaactgtgtctgtcagacttccccaagggtggngggtatggggaccatatattccctgtgattaataccttagagggaatatc

SEQ ID NO: 712120 - DNA, 254 bp, Homo sapiens
accgcaaatgacccccccaaatgaattcccaaataaatcctctcggcgccctcgatgctcttagtgagtgtccgcggcccggaagcggtttactttgaaaaaattagagtgtcaaagcaggcccgagcgcgctgataccgcagctaggaataatggaataggaccgcggttctatttggttggttttcggaactgaggccatgattaagagggacggccgggggaaattcgtatggcgccgtagagggtgaaat

SEQ ID NO: 712121 - DNA, 467 bp, Homo sapiens
tctagaggacctcagtgctactccacaaacagggaaaacaaaaccagtttttggtttttttttttctcatcaacgttataaggaaacaacttggaacatggaacggacagcgttggaggacctcctttacgcggggtaaagtctcagtttccaagaacctatcgatagttaagtgagaactcaaggggaggagtgagtcatagggtgggaagtcaggaagtatgatgtagatgaggatgggttaagaatttctaatccaaatgagcggcgggatcagacatgggtctttatcatgggagcatctgagtctacacaaagttcacttaaaatagtgggtcttacttgggaacatgtgcctgagtaagcctcggtgagacagtttgggtggtatttggtttctctggcatattagggttaagtatagtttaacggttgggggaggtagcactggggataccgaagctcga

SEQ ID NO: 712122 - DNA, 138 bp, Homo sapiens
ctcaacgctttatactatctttatcatacccgtgtctcccttgcgtgtattgcgtgtcacaagttcacacgtttgaggaacgaatacttcaaacatagtctgtaccaagaggcttaactcttttctttttcctctcta

SEQ ID NO: 712123 - DNA, 422 bp, Homo sapiens
attcggcacgcggagagagagagagagagagagagagagagagagagagagagagagagagagagagagagagagagagagtagagagagagtagagacagatagtgcgctcgtttgattgagttagagcgcttccttgtcctccttgtagaccatccgtctcctgatccttcccttcttccctcctcattcgtccccatttcctctatctttccttttctgtctgtctccccctttttgtgcctcttgttcttgcccttttctttcatacattatcttcttctcacactcttcgccatacctcactctacttttttttcccggtcttccctcacttccctttccatagcccctgagcttctcttcttttcttcatttctcttgctcccctttattcttcccccgtttttttttgtccttcg

SEQ ID NO: 712124 - DNA, 177 bp, Homo sapiens
aagaattcggcacgaggaaaaccaccccagagccagtgattcattgtagaagagaaaaaggaaccaatttttttgatattagcgtctggtttgtgcgacgtcattttgtgctttctgccatttgcaatcgatcagccatgaagtttctaatactcatcctcggctttgtcgcggccg

SEQ ID NO: 712125 - DNA, 391 bp, Homo sapiens
gaccccgtaaatggaccatgccctgagccttacctctcactcacactataattcctctcttgagtcatctcatctattaccttgggcttccatccataaatacctatgatcctccaattatctccaacccagacctcacctctggctttctaattcagacataaatttgctggaagtcgacatttggatgtctacacagcactccttaaacagtgtccaaaccaaaaatcttgatccctgcatacccaaaacccattcttctacccacacttccccagctcagtaaatattcactatccagccaattatttcctcctttcctccagagcccgaaagtctgggagtcatgtcgcctatgctggaggaaaggaagaaatgagatgtaggaagg

SEQ ID NO: 712126 - DNA, 164 bp, Homo sapiens
ctgccttggtctcccgaagtgctgggattacaggtataagccatagcacccagaacaattggatgacatataaaaccatcactactatcaagaaaatgaacatattcatcatctctagaagttttttcatgtcctcttttaatcttttccctcacatcttaccc

SEQ ID NO: 712127 - DNA, 118 bp, Homo sapiens
ttaaagacaggcaaccaaccataatttgctttatcccgaaagtaccatgttaacatccaaacccatactggatcttggacatggacttctgaaaaaaattggcagtgtgtgcatgtta

SEQ ID NO: 712128 - DNA, 153 bp, Homo sapiens
atctgctgacacaccatctcatctgcttacaccagcacctcatctgctgacaacaccacctcatgtgcgcaggcaggcagagcgagcgactgggagctagcagacatggggcagagcacggatccgattgagccccaccgctccatgttccca

SEQ ID NO: 712129 - DNA, 333 bp, Homo sapiens
gcatgtgtgttgcagctgaatttaacaatttctaagcctaaaacttgacatttcagatttaagtcggtaaagcactgatttaaactggattttaactggatgacacttctgatttaataagtgtactgactggataaaatgccagtgcattcaattaacaagcacgtttaacaggcatgccctatatcattagttaaaagtgacagcaattgaattcaggtaccatttcaaaatggttgctatacccactctctttatcctccacattacggtctatctagaaatggttgcttatcccttttccttgtgtacagagcctgcggaaataagctt

SEQ ID NO: 712130 - DNA, 124 bp, Homo sapiens
atgtggcgccgggtccatcatccacaagcttaacatgaacaagatattcgaaaaatgagtgaggactactcaaacccatagctgcttcacttcaacctccctcaccaggggtcagccgagcatg

SEQ ID NO: 712131 - DNA, 299 bp, Homo sapiens
gttcccccggtttttttaaattttggggaaaaaacccccccaatagggcctttaacccgggcttttggggggaaccccccccgggggtttcccccaataaaagcgggggggggtttgcccccccccccaaattttgggggggccccccttgccccccccggtttccccccggggttattttcctgggggggggggttttccccccggccccttttaaaatttttttccccgtttggggggtacccaatggggttcccttttggcccctttttttttttttaaaaaaagattttttctta

SEQ ID NO: 712132 - DNA, 199 bp, Homo sapiens
atgtaatcagctcggtaccgcggtatgtcttacgaacagctgtaatattaataattttgatttgagaagccttcgcttcgaagcgaaaagtcctaattagtagaagaaccctccataaacctggagtgactatatgtgatgcctccctcaccctaccactacattcgaacgaacccggtaagacataactcgcggggga

SEQ ID NO: 712133 - DNA, 347 bp, Homo sapiens
  misc_feature (2)..(2): n is a, c, g, or t
  misc_feature (4)..(4): n is a, c, g, or t
  misc_feature (31)..(31): n is a, c, g, or t
  misc_feature (83)..(83): n is a, c, g, or t
  misc_feature (100)..(100): n is a, c, g, or t
  misc_feature (131)..(131): n is a, c, g, or t
  misc_feature (135)..(135): n is a, c, g, or t
  misc_feature (159)..(159): n is a, c, g, or t
  misc_feature (317)..(317): n is a, c, g, or t
gntntgaatattttatttaaaaaaaaaatanaaaaagataagatagaaacaaaaatcccagccatcccgccctaaatacttgntgtgttttttggatatntgtacaaaagcgtttaatgttttaatacatntttntgagcctttttaagaattttaatntattatttacttattttaagtttgtggtattggaagatatgaaatttatttttgtaaagaaaatgttttaattgaaaaataattaaaaatttgattatacatatttactattaaatttataaataatgttaatttatttttaaataattaaaaaagtntaattgaatgttaagtgtaatgaataaaga

SEQ ID NO: 712134 - DNA, 193 bp, Homo sapiens
tgtattgagcgagatgcaccactgcattctagcctggcgaccaactgcattccagcccgggcaacagagtgagactctgtcccaaaaaaaaaaaaggttaactttcaaaagggtatcgccaataattggtaaaataaaggctttaagaacaagcacaattaactggggcaacaggaggtaaaagtttccagca

SEQ ID NO: 712135 - DNA, 261 bp, Homo sapiens
ctgaactatgtggggagaggcaaatcgcacgagtcctaggaatccctgtatgttcctgctgggtatgacatgaatgcaagctctgtccaggctatttcacagggttgtgttgggagcaagcaaccttgagggttgaggtaatctttctctctggaaaagagtaggcttgcttccacttactataaaaatagtaagataccctaagttcagtgttcctcttctataacgtaatctactttatgcacatagttcagcgtctga

SEQ ID NO: 712136 - DNA, 323 bp, Homo sapiens
  misc_feature (4)..(4): n is a, c, g, or t
  misc_feature (25)..(25): n is a, c, g, or t
  misc_feature (64)..(64): n is a, c, g, or t
  misc_feature (323)..(323): n is a, c, g, or t
caanaataaaacatgaagaatcttntcatacctatgtctacatatctgtcttctggggtttttntgtttggttggttggttggtttttcttgagacagggtttcactctgttgaccaggctggagtgcagtggcatcatcacggtttactgccaccttgatctcccaggctcatgcgatcttccttcctcagcctcccaagtagctgggacttacaggcacatgccatcatgcctggttgatctgtaatcccagcactttgggaggccgaggcaggtggatcacgaggtcaggagttggagaccagcctgaccaacatggtgn

SEQ ID NO: 712137 - DNA, 111 bp, Homo sapiens
ttagaaagccaacacagaggtccttgaactgtttactgatccccaaatctgcactacgaatgcagctagcacatgccaggcatggacactataccctgacagacatgctct

SEQ ID NO: 712138 - DNA, 457 bp, Homo sapiens
  misc_feature (338)..(338): n is a, c, g, or t
  misc_feature (388)..(388): n is a, c, g, or t
gggaattgaattggaagattactgaagcacagtagcattccctgacttcctgcaacgcggagaatagttaaaaagaagatgccactggaagtaaaatttcaactcttttgtttttgaaacagtatagcttttcataatgtcaactaagcaataacttggctttttggtgtgttggctaccctactattggccataaaataggcactctggtacttcagttgatgaatgtttttgctaaagttggactgtaccgaatttcattcttattttgtacgctaattggtgtaaaataaggaagtaattgttggaatgcatactgtattcttaggttttattangtacatttggttgcttaaacttaagaataagagtaaacaacaactgaatnataattgaactatctttctttttcgtttttttgagacaggggtctctctctgtcacccaggctggagtg

SEQ ID NO: 712139 - DNA, 379 bp, Homo sapiens
  misc_feature (38)..(38): n is a, c, g, or t
  misc_feature (59)..(59): n is a, c, g, or t
  misc_feature (125)..(125): n is a, c, g, or t
  misc_feature (134)..(134): n is a, c, g, or t
  misc_feature (142)..(142): n is a, c, g, or t
  misc_feature (164)..(164): n is a, c, g, or t
  misc_feature (169)..(169): n is a, c, g, or t
  misc_feature (178)..(178): n is a, c, g, or t
  misc_feature (183)..(183): n is a, c, g, or t
  misc_feature (195)..(195): n is a, c, g, or t
  misc_feature (251)..(251): n is a, c, g, or t
  misc_feature (283)..(283): n is a, c, g, or t
  misc_feature (293)..(293): n is a, c, g, or t
  misc_feature (321)..(321): n is a, c, g, or t
  misc_feature (323)..(323): n is a, c, g, or t
  misc_feature (367)..(367): n is a, c, g, or t
  misc_feature (374)..(374): n is a, c, g, or t
gaaagtgaagtctgcctacctatgcctcaaactctatnatgctgctctagtaggtcctntcatctgtatttgtaattaataggtcgaccacgctagtgaacatttcagcaccatagttattgaantggaatccnttaagaancaaatggctggatattcaatgncaggngaggtatantttgngacaccaatttntggaaaaaaaaacctttttaataatatcttcacattagctttacaatagtagttgnactccgcttaaaatcgtatgcagtctgggcanatcaaatatntgatgattttttttaagaagtgaaattnangccctagtcccaactcgggggagcactatgaagaaatgattcancactgcncattt

SEQ ID NO: 712140 - DNA, 846 bp, Homo sapiens
gggcggcggtggaagtggccggcgagcccggtccccgacggcaccatgcttcccttgtcactgaatgaagaccggctcagaatcatccccatgttggtggacggctgaacaaatgggtgagacgtacaatggatcacctggtgagctgcgacaactggatgaacattaacctgcgagaagtcatctgcacttgtccaagggacgagtggacaagttctggtctggatgcccgatgtgctacatccgcggacagcaccgatcaagtacctgcgtccatccccgacgagatcatcgatcatggtcaaggaggaggtggtggccaaaggcatgtggctgtggagagcctgtgagcagccatgattgtcacgagaaatgccgcgggatgggcgcggctggtcagaagctgtgttcggtggcacgcggccagcaggtgggatccccgggcactcatgctagcagggcaaggtcagaaaagaagccttggacgagtacaagtgcgggtcaaaacagtgaagacgcccatgccaagactcggcatgcgtgcgtcccccatccatgctagaggtggcgcattccgcgtcctactagtactcgccaggggattctggtcgagcacgggacgcagggatcgttgctccgagaggtggcatgccaccattcgatgtccttgatgataccactcacgctttgattaagggttgtacagcccacattttgtgtctttggactaaaatagcagcgagaaattcctcccgggtctagacaatgtccacttaggctggtgtatggggttgtagttgcaacacgggccagtcgccaaaagctgggatggattccttaaaagat

SEQ ID NO: 712141 - DNA, 317 bp, Homo sapiens
tctagaggctccccctggctgatctcaatactcacttatgtaggaattaataaatagcaggtgtaaacggacccaggcttcatgacgcaggcttttcatgtatgcaggatgactcaatgttaaagcatttaaatggaaaccaggtgagttttaaagcccgagaaaccacacataatcttgagtagagatgagttggctgtactgacgctgcacttggtaaacagatgaccagtattttactggtgggtgtgattttttaaaatagtactttatatataattaaaattaggtttaaatatccaaaatatgagacccgc

SEQ ID NO: 712142 - DNA, 141 bp, Homo sapiens
tagaaaaatcctctccttacgagtgcggcttcgaccctatgtgggccgtccgcgtccctttctccatacacttcttcttagtagctattaccttattattatttgatctaaaaattgccctacttttacccctaccatgag

SEQ ID NO: 712143 - DNA, 422 bp, Homo sapiens
gggcacactgggactgggtgtatgatcatcgtacttcttgggccgcagcggcgtatggctgtgctggagtttctgctaccatctacttaaagtccagaagcatgatggccacgatgagattattacacgtgtgcctttgaagaagatggtggagagaatacggaagttccagattctcaatgatgagctcatcaccatcctggatgcgtacctgaagtcaggcggacggggagggggcgctagtggagcatgtgcgctgcttccagccgtccatccaccagtccctcgccagcagctgagggcacgcgctgcactccgtaacacgaacatggcatgcctttctctccgaaaactatttcagagagatttgttagggactatgttgtcagtatctctgtccctgttaaaggagggatgagcat

SEQ ID NO: 712144 - DNA, 168 bp, Homo sapiens
  misc_feature (64)..(64): n is a, c, g, or t
cactatactcccttcctccgcccacacacaccccgtgaaggccacatcagtgcccagttcacanatatgtgcattgtatgtgttggccatcttcacaccgaaagccagaggccaggtagcaagtaggagtcaggagtccacccaggtatgccaggcacactcgctgag

SEQ ID NO: 712145 - DNA, 108 bp, Homo sapiens
acatcagacagtcgatgtcacggcgtacagtacacgtgtcagctatacctacaaaaggtcactaaagtggtaggatggtctgtttaaaatattcataactgtacattg

SEQ ID NO: 712146 - DNA, 954 bp, Homo sapiens
agcagcagtgaatgtcaaatcacagtcaacaatgttaagattgtcatcctactttttcaccaaaacaacatatcacacttggcaattgttttttacaaggctcaatcacaggaagtgcaaggtgtgccaatacaggtcagccaacgtaaaacgccagttcgcgtttttagtgtcatgttcagagatccatacaagttttccaactcacgggcattttggtatgatgcgctgacattcttcgtggcattcatacagaggatcatgcccttagcaagtactttcagtacacgtctttacaattcacgagattcccaaatgcctttattcccccctcaatcttgacacactgacgatgaggtctaactgtgtaacgcaaatatttatgttaactatttctataaaacttcacttgcagtgcctactgaggccctttcaagcacccgctaacattcctttccatcattcttttcacattgcacattaaaacataattgtgcaatgttccttgatgatgtaccccagaaagctgcattcaaactcaaactctgtgggaatggcagtgactcgacacaaaacttgtattccggattcagatcctcatacccctgaactggtgtgaaacaagttactctccttctacgtgaccgcgcttggccacacaagatataccacctggcatgaacactatgaccccagcattccttaacacgggtaactcccaagcagtcttttgacccgcggatcacacctacaatttcgtggcccaaccccaaacgcacgcacaacgcacagaaggggacagacagagaacacagcaagcggccagtagcacaaggtcaacgcaaacaacaaagcgaatgcacaacgtaaacggcaaacggaacaacgaaggaacaagcagagggcacacgcaccgccacagacgagacaatcacagacacgacagtcccacac

SEQ ID NO: 712147 - DNA, 761 bp, Homo sapiens
tgcattgagacttccttgatcgctaaattcatatcaacgcccaggggtgggacgaatccagatgcgttgtctgatactaagatcgccatgattgtgtagggttctgagggttgcattaccattggaatcgtatcaaacctagggatgatccagggctgatgcatcgatagttcaaagatttactgcccccgacacttgaattttacaattggatacagagtcacagtgttttaataacttccgaagggagaagcactattagaggaaaaaccaaaaagattgccattcacagaagttgggcatttgaaccacctaaaacgagaaacgacaagccccaactatgccgttgcattgcatacttctcaggggaaagctccttcgtgttaggtgaaccttaaaaggcaaccccaaaggtctcctcgaacctccaaaaacgaaccaattgttttccagggattttgcccaagtttctttttgccttcacaacgttttaatttttgacactttactgggtaacacacagaaagatttccgggttttgcacctgaaacaaaacagctaatttgggcgctaacacaggggtaacccttcggcaaaaattccctgagacctaggcctataacggccatggcacacaggggcacccacaacaggaaatgaaaaccggcttttaacacatttgactgcacaggcctcgaaattccccttttaatgtacttgaaacacgcttagaaggggacaaagcggacaaggcttcttaa

SEQ ID NO: 712148 - DNA, 491 bp, Homo sapiens
atgtagtctcgccatcaaataagacttacactcgtatgatgcttctatcagtttgcctttaacagaaacttccaaaaggtaagagtttgtgtgatgggggagagggtgaaggaggtcaggccccactccttcctgatcgttcacagctcatcggaataaggcatggctcagatcggccacagggcggtaccttgtgcccagggattttgccccaagtcctcatttaaaagcataaggccggacgcatctcaaaacagagggctgcattcgaagagacccttgctgccttagtcccgatagggtatttgaccccgatatattttagcattctaattctctccccctatctattgactttgacaattactcaggtttgagaaaaaggaaaaaaaacagccaccgtttcttcctgccagcaggggtgtgatgtaccagtttgtccatcttgagatggtgaggctgtcagtgtatggggcagcttccggcgggat

SEQ ID NO: 712149 - DNA, 186 bp, Homo sapiens
agcggggaacattcacttgatgtgtggcagtcacaggccctgttggagtccctgggcacatcaggcactcttgcttcccaggagcctgtctacatctagcactggaagactgccttccctgcacaatgcgcctgcatgcagctcagtggcccacgcagcctgcgtgctgcgcacgtgactgttcca

SEQ ID NO: 712150 - DNA, 388 bp, Homo sapiens
cagcaaagctatgtgatttagagtaattttgtaaaatttactctctatattggcttacatagtattgactaatgcatagccttttaaagagagtacaggttttttaggcctgaagcttcactctggattctgtctttgggaaaatgtgtataaggaatattgatgtttcctttaaaacattttcagtctgttgtagagtgatggctgtgtaccaaaatgtattattgctgcgggcttagcactttactaagtcctgaaaatattttttttaaaacttggttgtgcgtgatttaattctgtattaacactgtatattcagtagttatactttaatgttgcaaaatagcttataaacttgcttattaaactaacaaaaacataaaaaaaa

SEQ ID NO: 712151 - DNA, 903 bp, Homo sapiens
  misc_feature (611)..(611): n is a, c, g, or t
gcactgtctgaatcctgatgactcgtgcatctcaatgattgacccgtcgggtcctgcctgtacttgtagctcgttgagtgtcctagatctggaggatagctctcaatcccaaattggtgccacccgtagataccgtgctgcctctatggaccttacacccatgcgtgtgatgcagaaatcattggtcgatgctggtgtttaatactcgatgtagtgtccatttgcgaaccacgcacgtagataccagtaagacagtattcaggaaatcgcttgcggacgttcttttatttcatccccaaaaattgagagtagagacccggattcttatgctcagcataggtatgccaaatccgagggtgaggcatggtgtctataatgcctcggacctaccctgtgctagtccatgccttgagatatctgggaggcttgcgtccggtctccactgtggaggagtcggcgagtgcctttctggatcaccattggctgactctcctcagcgtgctgagacctgggatctcataatgctctgactctgtgacacgttggacgagtgacgcattgacagctcgggcgtctggcctggattgtttgctcgacatgcgctgagtgangaggctactgttgcactgtgggaccaggttcgggacgacatgcgtcgtccatctgattcgcggctatggctcggtgctacactattgttctctgatgtaccggattgcgaacgggcagggcttagttgcttgtcgcacttggcagccattgaaggcttatgaagtggacagcgtactcccctgagggaagcgaggtttccctctttcagggttccaggccttgtggttctgtcacggaatagttgggccttgcttggccggtttgcttggttgcgaggttgtgtattcgtcg

SEQ ID NO: 712152 - DNA, 208 bp, Homo sapiens
  misc_feature (1)..(1): n is a, c, g, or t
  misc_feature (11)..(11): n is a, c, g, or t
  misc_feature (43)..(43): n is a, c, g, or t
  misc_feature (191)..(191): n is a, c, g, or t
  misc_feature (197)..(197): n is a, c, g, or t
nattcggcacnggggggcttggggctctgtacgtgttaattcncgccactccagcagccctgagtgggaggagccattatcccccttctttctgtagatggggaaactgaggcaggcttgccaatggtgaagtggccagtcggacacagggccagattgaaacctgcagcctgggctcccggctacaacancgccancttccacaggc

SEQ ID NO: 712153 - DNA, 492 bp, Homo sapiens
  misc_feature (6)..(6): n is a, c, g, or t
ccgtgntggccatggctggtctcaaactcctgacctcaggtgatccacccacctcggctcccaaagtgctgggattacaggtgtgagccactgcacccagcccagaaatttatcttacatgcttattcgtagaacaaggaaaacaaatatggtccagccacaatatccccatcgtagtaaccaagtcaacatattagtatagtgatctagttccttcctcctgagcattttgttcatagttgagtaaacataattttcattcctccttttgtaagtttaaattactttatatttctatacaaaatagagatggggtttcaatatgttgaccaggctgggtctcgaactcctgggctcaagtgaatccttgctcctcagactccgaaagtgctgtgattacaggcgtgagccactgggtcaagccattcctcctttttaactctcttgttcaatattcagacttgggcatgatgagaccccggctccacatgt

SEQ ID NO: 712154 - DNA, 218 bp, Homo sapiens
cagtccatggactccatcatcgcggtagtgaacagagctccagcgactcacagctcaaggagaatcaggcagcaatgatgcccacgcatgggcgatggtgggctgggaagacagctcccatctcacggttgaggggcttggtccgaccctcatgctgcgcatgggaggtgtatctctgctcctctccagaaggcaccaccagaggcgcccacttctgg

SEQ ID NO: 712155 - DNA, 516 bp, Homo sapiens
ttttttttattcagggaagtgcttttatcagcttctttctaacacagaccattttcctgcagtaacatgaaaggcactgcacgcgcattttcatagcgggggatgttgagggaagtctagactcagacagtactgatatgggctgcgtgggtgaggtggtggataagcagtctgggattcctcagagaaggatgcaaaacagagggcaaaggacactgaaagcaaacttgagacaattaaaactccaagatttcatcaaggggctggccttggttttggctactccacaggtgctgggtgacgggtgcggttctccccctggaccatctctctgggcttagcagcttggagtgctgcgtggggtgttgagattcacgcagtcacatccctccttctcagaatgtgtagcacccactcaggaagccagcatgacagggccaggtgcatttgccacctgggcagaggagaccttaactgcaccttccttctttccccacttgagggatctcctcacag

SEQ ID NO: 712156 - DNA, 799 bp, Homo sapiens
  misc_feature (33)..(33): n is a, c, g, or t
  misc_feature (612)..(612): n is a, c, g, or t
  misc_feature (614)..(614): n is a, c, g, or t
  misc_feature (619)..(620): n is a, c, g, or t
  misc_feature (688)..(688): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctgtgatgagactgaggccaaagaagaaggaaaaaggagatgttcaggatcacgcaatgatttgtggcaaaaccccagctattaatataacacctatacaacttctagaccagtgctttttccacttgaaaggccttgttatctgagtttgtnanggtannttctgagacagagtctcactctgtcacccaggctggagtgcagtgacgcgatcttggctcactacaanctccggccctgggttcaagcgattctcctgactcagactcgctcccgagcagctgggactacaggcacaagccaacatgccaggtaattcaggatcaagggagagacgggg

SEQ ID NO: 712157 - DNA, 1114 bp, Homo sapiens
ccctggctgggctcagtggctcacccctgtaatcccagacactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaattccccacccctaccaatggtttacttcctcttcctgctcagggaccagatgggcctcacgggttgacgatggaatagaataacttgggctatgagtcaccagcccactttgtgacccagaaagaccttacccctctcggggaatcagttactcatctgtaagatgaccaaagtggcttaaatgatctcctaaatccttcaagttctctagattgcgtaaagccaagggatactccactctctaaggtgcaatgccaaccagccctggaggctgggaatctgcacgacccatccagccaccaggggtccacgaagtgcacaaacctgctgtcaggcacccaacattggacggcacaggcccagccagacagcatcactaaagagaggccagacataatccaggcagaggatccaagcccacaccggactccataaaaggtacccgattgacataatatgccagaacacaggaaagccgcacaacggcgccacggaggcccacatcttaaccctagaagtcatgacaatacagggaaaaccaaaagaacaaaggagacagaaagagcccaacaggagaccaaggcaggaggtacaccccccgaggcgccacaaaagcaattaccaccaagtggtacgcggtggcgacagggcaacacacaacgtgacaaacgagcacccgacccccctactcacatcgacacacagccccgttgtagataaaaggccatcgattcgtagcaacgacgagaacgcgcacgatacataatgcatacgggtacgacctccttacctagcacgcaccaacgcgg

SEQ ID NO: 712158 - DNA, 3815 bp, Homo sapiens
ggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgaaaaaaaaaaaa

SEQ ID NO: 712159 - DNA, 483 bp, Homo sapiens
  misc_feature (67)..(67): n is a, c, g, or t
tgtgatgatgaaacctgtgagggcagtgccaagagtaatattgccaaatattatgagctcacatgancctctctctccttgtttccaggaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaaca

SEQ ID NO: 712160 - DNA, 2244 bp, Homo sapiens
aacgaaggaccctgtggataggccgacacttaccagagacaacgcacgggggcactggaccacagttgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgaaaaaaaaaaaa

SEQ ID NO: 712161 - DNA, 4956 bp, Homo sapiens
  misc_feature (33)..(33): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgatgagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgggaaatgtgtaagcttccttgatcagctccaggcctcacagcacgggagcagtgaccagtaaggaaacgtcactgctgtgctttctgttggaaattgttcgaaaatacagtgaactggccaggcccagtagctcatgcctgtaatcccagcactttgaaaggctgaggcaggcagatcatttgaggtcaggagttccagaccagcctggccaacatggtgaaaccctgtctgtactaaaaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaa

SEQ ID NO: 712162 - DNA, 3335 bp, Homo sapiens
ggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgaaaaaaaaaaaa

SEQ ID NO: 712163 - DNA, 4540 bp, Homo sapiens
  misc_feature (33)..(33): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgatgagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcaaatctgtaattatgcacagtttctgttatcaataaaacaaaagaatcctgaaaaaa

SEQ ID NO: 712164 - DNA, 420 bp, Homo sapiens
gtggatactagtcactgcatcaggagaatgcagtaagagaatggtttccagttgaactgagttcggagcacagcacggcaactgaccttacttgattcgcggaataccatgtactgtgggagataacggatcggggttttctgggtcttcggtttgttttggtttggctatacttcgttttaactaaaggagaaccggtatgaggatatactcaagaataatacacattaggtgctcaagcatctccatgatgtatatggcatcatgtctttaagtatcctgtggtcgtcttataaaatcacatggccacttcctaaagcctagtgaaagattggttttccatttggggcaatggatctctcccctgactcttgctggttctacccagtctatccagatcagctggttgtatatgcctat

SEQ ID NO: 712165 - DNA, 2498 bp, Homo sapiens
ggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctggtacaggaagccggtgggagggagactgggggcggggcctatcagccaggggctcgggcctggggggcaggccggagtcacag

SEQ ID NO: 712166 - DNA, 4758 bp, Homo sapiens
  misc_feature (33)..(33): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgatgagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgggaaatgtgtaagcttccttgatcagctccaggcctcacagcacgggagcagtgaccagtaaggaaacgtcactgctgtgctttctgttggaaattgttcgaaaatacagtgaactggccaggcccagtagctcatgcctgtaatcccagcactttgaaaggctgaggcaggcagatcatttgaggtcaggagttccagaccagcctggccaacatggtgaaaccctgtctgtactaaaaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaa

SEQ ID NO: 712167 - DNA, 5071 bp, Homo sapiens
  misc_feature (33)..(33): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaggttctggcacagtccttgcttcagaacaagtgctcaacaaatgtcttttgaagagaggattctcaggagtagaaaacaatgaaaatgctgaggattgtgaataacaacagcaggagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgatgagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgggaaatgtgtaagcttccttgatcagctccaggcctcacagcacgggagcagtgaccagtaaggaaacgtcactgctgtgctttctgttggaaattgttcgaaaatacagtgaactggccaggcccagtagctcatgcctgtaatcccagcactttgaaaggctgaggcaggcagatcatttgaggtcaggagttccagaccagcctggccaacatggtgaaaccctgtctgtactaaaaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaa

SEQ ID NO: 712168 - DNA, 839 bp, Homo sapiens
  misc_feature (398)..(398): n is a, c, g, or t
ccctgaaagattccctactttgaccatcgcttcaaacaaatttttttttcacggaaacattgtccaccatggagtgaaaggccgtactgggctactctgacgcgccttctccgtaagttcacgcttcaaccattcgtttgagtgtccgccgcgcatgatgattgttccaggcgaccgccatcagacataggctcccctgcaggtcatagacaaggaatgagcggcgtcaataccccctacggccgccatcttgaaatccgcccccacgggtcctccggggagagaaaaaaagagtcttcaaccgccccgtgggcccaccttatgtgcgagcaatcaaatacgcccgccctccggtgtgtatatttcaccccccccacgagacccctcctatcgtctcngttgaggagatgtctcctcggcaaagggtccaccctctctcttcgacacacaaggggcggagatagatcagagcctggtcacctacacaaacagatacagagtgggggatcacaaccccccgggagccgcaactcctcgccgacgcgcgtgcagtgggtgtgtccctctcgagacaaggtagggagcgtgcgagacgactatttctcggtaacataggcacgctctccagacacgcagggtttgatggccgccgttcttaggaccgctcccagggtatggttacagagcgcccagttacgtgctaatctgggtagggcgctctggcagctagcgcactctaggcactcccacggcatacataggcgccggttctttacactgattccaagccagcgtcttgggccccacaggggagaaaaagaaacttttacacaaacaaa

SEQ ID NO: 712169 - DNA, 201 bp, Homo sapiens
gacacatcagagccctggggcctgtcactgcttgcaggctgagagtagctccctccttttctatctgagctgttcctcctccacatcacagcagcgaccacagctccagtgatcacagctccaaggagaaacaggccagcaatgatgcccacgatggggacggtgggctgggaagatgggtcccatctcagggtgaggggt

SEQ ID NO: 712170 - DNA, 1682 bp, Homo sapiens
  misc_feature (33)..(33): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaaca

SEQ ID NO: 712171 - DNA, 3324 bp, Homo sapiens
  misc_feature (33)..(33): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacctggctaatttttgtattattagtagagatgggtgttcactgtggttgttcagctggtcttgggctacagacctcaggtgagtccacctgcacagccttacaaagtgctcggatacagtcttgaccacggcacccggccgctctgttacaaggtctgcagctggcacggttacacaagttcagctggggcctgtaaactc

SEQ ID NO: 712172 - DNA, 593 bp, Homo sapiens
acgcctgttatcccagcacttagggaggctgaggcgggcggcccctttctctttctctgtggatgtcccagcacccaggtgcgaggaccatcacgaaataaacgggcgcggcgcgccacgacgacccaaaagtggagagcgtgacgggcagcggagaagactgtgagcgcggcggcgtcccaaaacacatctgagcacaaacgtggaaaacccacatgactctaagaaataccacacgacaagccgggctcagaggacaatgccggcgaacccaggccaaatagaccgacaaggcaagccgaaccccagacaccagaacgactaacacagcctaacccagcagccgaaccaccgtaccaaccgaaagcgtcaccacaaagcggcgcaatgagagcgcaacaaaagccaggacatccggcacatcctcctcaaggcctgaccgcaaggagaaacccacagaatacctgcccacaccgccgtatctggacatcacgcgtatcgaataaaatgaagccaacagcctgtgtaaactacgagccaacagtaaagacacaatcaacaactagaacgaacgcccaccaaacagaaacatc

SEQ ID NO: 712173 - DNA, 1761 bp, Homo sapiens
  misc_feature (33)..(33): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcccccccccccccccaaaaaaaaaaatatttttttttttttttttgggggggggcccccccccttttaaaacgcgcccagattggcctacgcagaggtggctgagaggataatggtcctacgcagggctggggttttgctacttgttcctatttatgttcctgattccattttataatacaaaactaggtaatgatgaaca

SEQ ID NO: 712174 - DNA, 298 bp, Homo sapiens
catcgacgaaaagggacaggtctgtctgccagtaattagggccgaaaactggaagccagcaaccacaaccgaccacgtaatccagtgcctcatagcactcgtgaatgacccccagcctgagcacccgcttcggctgacctagctgaggagtactctaaggaccgtaaaaaattctgtaagaatgctgaggagtttacaaagaaatatggggaaagcgacctgtggactaaaatctgccacgattggttccagccagtgtgaccagagaccccgtgcagtgcattcagacaccccgcaa

SEQ ID NO: 712175 - DNA, 450 bp, Homo sapiens
tgagaattctaaggcccagagacttgatgggaagcaaggtagtgaaactttaagaaagtaaggcagagaggaggagaagaaaatgaggccaggagggaacataattagagaagaataggacaaggcagaaaaatgagcctttgggacctctttataatttaagaagaaataataatgaagggaaattgaatatctaaggcttgctattacattttttgaggccaatatccgtttaagaacaaatcctcagagatgccaggaagggcctgggtttccaaatggaactactcacaaagttccttttgcagttccttcttctgttaatttgctgggaatgagaagactagggaaaaggcgatgtgtgtggtgtaccaagggtttaagtaagagtatgatgggaaggggcacctagatataatgaggctgctgttttaagctgaatagaaaaga

SEQ ID NO: 712176 - DNA, 4810 bp, Homo sapiens
  misc_feature (33)..(33): n is a, c, g, or t
agcgggttgttattctgcctgccatgggcagcngggtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgatgagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgggaaatgtgtaagcttccttgatcagctccaggcctcacagcacgggagcagtgaccagtaaggaaacgtcactgctgtgctttctgttggaaattgttcgaaaatacagtgaactggccaggcccagtagctcatgcctgtaatcccagcactttgaaaggctgaggcaggcagatcatttgaggtcaggagttccagaccagcctggccaacatggtgaaaccctgtctgtactaaaaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaa

SEQ ID NO: 712177 - DNA, 841 bp, Homo sapiens
cagacaactaaaaaaaaaaaatcagaaaaagtacttaagcaaaatgagaagcttggttggttggtttcggagatagagtctcgctctgtaacccaggctggaatgcagtagcatgatctcagctcactgaacctcctcctcccgggttcaggcgattctcctgcctcagcctcccaagtagctgggattaccaggtgcccaccaccacgcttggctaattttgtattttagtagagacagggcttcaccatgttggtcagactggtcgcaaactcctgacctcaagtgatccacccgccttggcctcccaaagtgctgggattacagggcatgagccaccacacccagccaagaagtttaacaaagaaccagaaataattaactaaacaaactctgtggatacaatgatgaacataaaaaatgcaatagagaggcaacaacagacttgatcaaacaaaagacagaattggtggactcaaagacaggtcacttgaaattatgcagtcaaagggagacacgaagacaaatgattgaccaagaaagcttatgggatttacaatgttcaccaaccaacaaagaatttttgccttataggtagtcttcccatggataattaagcgagcgtgacggaaataacgtttcttaaagaatccataggctaaattttccagtggcgtgcataattgtctccgattctttaggccaaagtgcccaacagggtgtccgcccaaaaaattcgcagagtttttttcactgttcaacaccatttgggttgagatttaaggaccacttccggggcctaagcgaaatttgaacccacgcaagggttttttcttaaagc

SEQ ID NO: 712178 - DNA, 190 bp, Homo sapiens
ggcacgtgctggcatctggtacctccctaactgggccccgctggtcccatttgctcattagtaatttcctctcacatcagtgggtatacagaattcagatttctccctttaccaggttccttgggtatggttgacccatgacctctgcagtagcctttagttgaggtctgactaaggtagctctaacaca

SEQ ID NO: 712179 - DNA, 113 bp, Homo sapiens
cgcagtggccaggtccttggcgtacatatgctgcccgcccctgtgagagaggcgcttccaggcaccagagcccttgaacttggacaggctcctgtggatgccatgcaagccaa

SEQ ID NO: 712180 - DNA, 185 bp, Homo sapiens
cgctcctagacggccagggaccttacatgcggtggggttaggatcataaatcgagtatctccattactggacaacacgggtgtcacttcttcaaaacattaaaactagaattacgataagatcaagcaatcccactactagatatatatccaaagaaattacatcagtatgtcaacgagatatct

SEQ ID NO: 712181 - DNA, 248 bp, Homo sapiens
ggattatgtccggactacgcctgctcatccaggtacgagtctatctgaatcctgaacaatcaggcgagatatatgtatgactgtgatggtgatgagattttccatgtggatctggcaaagaaggagacggtctggcggcttgaagaatttggacgattagccagctttgaggctcaaggtgcattggccaacatagctgtggacaaagccaacctggaaatcatgacaaagcgctccaactatactcc

SEQ ID NO: 712182 - DNA, 738 bp, Homo sapiens
gtcggggagactgctgggggccctcaagcgcggcctgggtgccaggcggtccggtgtggatcaatggagacgcgcacccgctcactgcggttcccgagactttctggcaccgtgaccgcgcgctgcaggcgcgcttcggatggacggccaggttcctggagcatttgctccatgccctcgcctgcctggagggccccggtgtggccccggtgccgtgcgcttgcgcgccggaaccctcgcagggtctgtctctcctaactggcagcggtccgccgtcttcgagcgcgtcctcatggcgccgtggccgccatatgccacgcccgtctcgcctgtgcctcgctgggccattggcgtcttacgtacacgtgcccagcacttgcgcgagcgtccccactgtcggcactccggcgttgagcccaggcgtgcgtacggtgctcgtgggccgatcaccttggcgcgagcccatgcagcggctcacgggggtgtgcgtgcgccttagtgccagctgtgcgggatcctgaacattgctgaccttcctgcgagcaactgcgggttggactaggcccggtgcctcggaagagaagcgttcctgccataccctgtatagatgccacgcccttgaagaactttacctctggctaatgaccgggaggacacttgtgccctggtcatccctagggccagactggtgttctgcacaggagctggttgcgatgaacaggggccgcacaagattgg

SEQ ID NO: 712183 - DNA, 259 bp, Homo sapiens
gaagttttgattaaaggatgttccctgttatatgtctggtaagcccttccattccctttttgggcccatttatggaatttatgggtttctagggatttggccccttcctctagggtttccccatttttgggggataattggtcctggggttcttttataaagcttttttttcctgtttgttccgaaattatggccccgctttcctttctgattttgattttttggggattcctggggttgtgtgggtccgcccagctta

SEQ ID NO: 712184 - DNA, 449 bp, Homo sapiens
  misc_feature (268)..(268): n is a, c, g, or t
tctcggctctatcaggagcggtggtgaacatttacgtctaagtcttggtatggatctatgctttcattgcggtgggggtagaaacatctaagaggggaagggcggggtcatatagctagatgtctggtgccacaggggtggtaccatggtacacttccatgggcgggatagcaataggcttggaaaatttttcacaagttacttcaaatctatgcagtattagacacagcaggcccttcagcatgtaaacccgtcttccctagagggnctcctcccatagtcatttctcggtagggtagacgggtggctagaaatagggaggatgtgacggcacatcagtaacccaggttgctcttctccctagctgaacattaccaccatgtccaatgctaggggcaatagtagcattcggcctatctgggaggggacagctaccactcccgggggtc

SEQ ID NO: 712185 - DNA, 944 bp, Homo sapiens
aaatcatcacttaattataacatgcacagacacagaactaatcatatgtatatctacattcgagaccacaccttatccccaccttggctatcatcacccgatgaggcaaccagccagaacgcctgattgcaggcgagatactgcctattctacaccctagataggctcccttcccctactcatcgcactaatttgacactcacaacaccctaggctcactaaacattctactactcactctcactgcccaagaactatcaagactcctgagccaacggcttagtatgactagcgttacgacaatagctttatatagtagagatacatctagaggactcccaattatgactccctaaagccatgtcagaaaggccaatcgtgggtcaaaaagtactttgccgagagagatctggagaatctaggcgggtaatgggaggtaatacagcagggaacaactcattctacagagccccctgacagagaacagcatagactaacgccttccctaagtgactactcccctatgaggcactaatactataagaagctcacaatgccttgacctgacgacgaacagacctagaaaatcagatcagaggtattacacaaccaagggcaggcacagagacctcgatagtaacaggcatctcatacaaagccacggaagaacgcggcgaggcaaccaaagacgccacgagacacaaatcacaatacatgctggccagccgggcacacaagaacgaaccacaggagaactcagacccacgccagggccagctcaccacaacggcggggacgcaacgcgcgacaccactgaccaatatacacgggacgacagacgaagacgggcacaacagagaaaaaacaagaggcacatacaacggacagcccgaccacaaacaagaaacaacaagcaagaaaaagcgaccagggcaacaaagaac

SEQ ID NO: 712186 - DNA, 1134 bp, Homo sapiens
  misc_feature (1134)..(1134): n is a, c, g, or t
tggtttttgaaaaagtgcttggaaaattatactgtacagttttttataaacaatttatatttattattgttgggcttctaacatggctcttaactattcgtggtaaaactatttataactattattcttttacaatttggtcactattattattgaaatgggctaatagctataaactattggtctctaatggggatatttcatagaaagacaaaaatcaaggtggggaagaaattatcttatgaaaactattaaccaaaaacccggtgaattatgtgaagaaacaagaatgttcctcattatccattgtgaatatccatctaacttaattttggggtgctacatttatatgtgagtgcgtggcccagaactttctccattctcccgttaatttattaggctcagaaaaagtgtgaaagcagcgggaaggaaacgcggttaaggcaccgtggtgggaaaacgggaagcgcctccttccgacaggggtgtgacaacgggtggcttgccagtgtgttgtgagttctcagagcgtagacgggtgtcgccaaggtctccgtggtttggcattatatgcgcgtataaggtagaagcgcttggaaagttgcgtggtgctcagaaaacaccctgttttgaagtttcggatgtagtcgggaagggccgctggtctgagtcttactctccaagctcagagcgccggggactctgtacactgctgaggctgcaagcttcttaggtcgctaaccttttctatctagtggggaggcaaccggggataacactacacttggggaatgaaacccactgtgctgaaacccggccaaagcaaagtgtgtccggcacaaaggggtctactaaccggggcagaggcgcacaataaaaaaggcgcaaaaaccgcggggagggaggcccctacaaagagccccaaagagatgccatagagaacccctgtgatacaacggagaactcaaggagaccaccatagagaatatgtgcgaaacagatcgcatagaagggggaccaacaggcctctcaacggaacgctgaagacacgggacgacaactgacatcaggagcgacgtaataatagagccagacatggacgagtatgcctcctaattatcaacatactgaggn

SEQ ID NO: 712187 - DNA, 879 bp, Homo sapiens
ggcacacgaatgcgggcgcacacgaatgcgggcgcacacgaatgcgggcgcacacgaatgcgggcgcacacgaatgcgggcgcacacgaatgcgggctgcacacgaatgcgggcgcacccttgagtctctccaccgcagacatgacgaagggccttgttttcaggaatctattccaaagaacacaagaagatgatgtgccacagttcaccacagtgccaggagagcaattttgatcacacattgtctagctggcaacgctgcagcagagcacttctgaaccatatctggcaccacctctgcaaggccagggcaagcactcgcaaccttctcatggtctgcactcaggacttccccacgcgtggctgctagcttggccctcggccaacacacaggcagctggcactcgacgcaaccaggcaacactggcctgcacaggccaccgaaaacatcagagctgctgttgcagcggggtgcaggcagattcaaggactggagctctcgtctgtggaggtggatccctgtggagacgctcaggctgctgcggagggagcggtgctttggtctctatgaactacgatgaccctacatgcaacacaagaacgatggctggtgtcggcaaagatctatggaagtggggctcaggacggcctggccgaccggagttctgtatggattctggtgccggacacttcagggcaccgccgcaattggatgcgacgcacgcgcacggccaactcgaacatggactccccagcagcatttggcccgaccttctcgcgcacgaatctcaccacgctgcactctcgtcaacccgcaggtccttattaacaccacggtctgcattggtcgacacggcctgcgcatcctcacccacgtgc

SEQ ID NO: 712188 - DNA, 357 bp, Homo sapiens
gggtgaacaacggcatggctctgactaggcagcactgaagacacgtcatgtcaaggggtcaaaattctcgggggagcgtgagaggagacagtgagaaaatggggaggggctctgtgcacaggagactcaggacagtggggggaaaagtcacttctccacataagaggctcaaatcccaacgccaccctccgtcagacccctttggccccagctccgacccctccagggtttaccaagttgggctttcacagcatgtctgagcaaacacgcagcgaccttttacataattgcaacctcctccagagaggagagaggccacattctctcggccccacccccaggacttcaaacacactg

SEQ ID NO: 712189 - DNA, 157 bp, Homo sapiens
atatcaatagtcgccaggacaaaatcaatatagagagcatcttgcaaagtgagctttcttgtctcctttagggcttcatctgtgccgaaccgtacaaacatttttgtgaaggcagcgccggttaaaaccctgcgaataaaagtgggactgattttat

SEQ ID NO: 712190 - DNA, 260 bp, Homo sapiens
agaggatccggctatcacattatcttcccctctctgggtagtgcctcattttaataagccatgctccaataaccgaatggacctttatcctggggatggccttgtaccaccgggagtaccaagggcttaccaagtgagtagactggctccaactaacaatccactttggctttggtttagccactttgcttaccagtgaatgggcttctacggctaaggttaatagttttccattccttgtaatttggtaatggtggtag

SEQ ID NO: 712191 - DNA, 289 bp, Homo sapiens
gtagagcaacctccagcatgtgaacgacggttaataaggagggctcacatctcatgtcgaaggccaatgctaagagtggctgcctggcgtgcagcgctgggacgttttagcaagggcagagtgaggctgttcagtgattatggggaagagtcagggcccatcagaggaatgaagtggctaagggtgcctccagtcccaatagccacaagtgaattctgttgaaagggagttctagcatctcacagaccaagtggagcctcaggatggaggccgaaggccagagagcgtc

SEQ ID NO: 712192 - DNA, 905 bp, Homo sapiens
ggaggttaagggagaagatggcggcgctaggggaacccgtgcggtggagagagatatttgtagagcaattgaattatggaaaaatacaaaggagtggagaagtaccacaagaaacttcaggctttgcaaagagtccttcaaagtgaattctgcaatgctgttgcagagaggtctctgacacatgtctatgagactgtggacatcagtagcagtcctgaagtgagagcgaacgctactgccaaagggctactgttgctgcattttgctgccagtgaccggacatcctcatcctcgagtggtgagctaccaaaaacagaaagagggctgggtttcaaatattatgggaggcaaagaacaaaatctccaatctatataatcccgaataattcccggtggaatggtgatagacaatgggggcctcaaacgtggagatcaacctcctctctgtaatggagtgagtgtcgaaggagaccatcatgaaaagctgtagaactgtgaaagcgccaaggacggttaattagtggtacgatacacacccaaagtcttagaagaatggagtcgcgctttgcaaaaatgagatccggacaggcaaggcaacagaccctaaatacattttcacacgttggatatttcatttggcgtctacgcaagaaggagtttcccttggtggaactactaactgggtggcatcgccatgatttgcagaaaaaccaaccaacttttcatgaaattcccctgcattaataagtgccatttaccatactctggcgccgaggaggcacattctctgcagacaagtaaaggtgggggcttgcatacgttgcagggtacagagatggaacggggagacacacgtgaatagaggctcctgagaaggacgcggagacagttgttataagtgtacc

SEQ ID NO: 712193 - DNA, 123 bp, Homo sapiens
tagaagcactgtgttcaggcagtgatatttctgtcaggaggacaaacagtgccaatgtctaggggcttatcctcagaagaaaggacaagaagaccacctcacatcagaaacctagcctgacac

SEQ ID NO: 712194 - DNA, 876 bp, Homo sapiens
  misc_feature (1)..(1): n is a, c, g, or t
  misc_feature (3)..(4): n is a, c, g, or t
ncnntcattgtaagtatcgaaacaagataatacagacacgaacattactacgtccgcctagcttttttgctcttgtatcaccgttcgcgccaatgtgtgccccgaaaaaggtggtgttaaatccctgttgttgtttccccccttcatgggtctccgtgcgccttaaaatgtttatccgtgttgtactctgttttacacagggggggcccttttaaacctcggggcgggttaacaataacttataaaacgctggtattcggaataactttcaatactggcgacattctccctttttggacccccccccaatcccccctgtttggtggccaacacatactgcccctcttaagagcaacggcctgtttaaataaaaaattagggccccggtgcataatatttggtcccctcctaaacattcccacgagaattaattgatattccccctgtctcttaaacaggcgtttcttctaacactatctgtaacaaagcactcattatattggtgtgcataaagagtgtaaaaattcttagagaaaatttcttccacacccccctcccctctttaccgcatctcacatacaagtgacaacctccttttaataactgtccccagtatcaagtctcactcctgtagccttacccacatcataaagtcccatccagctctatcaccctgagtctctgtattaacccctccttctcgcccactacgcccgtgtaaaaccccggtcacacttagactgcgtgattatacgtactccgcctcctactcacaactacattcatcctcatccgaaaataccccccactattctgaatcacaagcggtccagccccgccccaaaacttctataacatacaccacccgccctcatc

SEQ ID NO: 712195 - DNA, 807 bp, Homo sapiens
ccaagcactgagtgtgcctggtgttgccacggccagcagtctctgcggtctgcgtcgtggccttcccttggccgtccgctccctccctcgcggcccaatttatggtaccgccccgttggtggtccgccccccgccaaaacgggggttctcttcttggtaggccccgcccctgcgcttgtttgtgcacgcccgcgcccatcccggtgccgccctgcgtgcccgatgatacatccgggctgtgttcttttgccggccctcacgtcgggagacacattgctctgctgtgtgttcttctcagaggaagtcttttcggtgacgaggcggagtcttcgactaactcacacgcctgtctgagatccccccgatggtcgtctctttctcttgctccccgccagtgcgtcggtctgtcgcaacctggtcagctcgcagattagctttcacttcgcctcgtcgtgtctgtcctccgcgtcgcgctatctgtgtcactcacgccatgtgtcattgcctctcgtgacgggtggtgccttctgtgtctcgccccgcacgtgcgtgcccactggagcagcctcacgtcctctggttatcttatcgctccttgtgtcctcgttcatttccttctggggcgtgtgatcataagagaaggcagagtcgcacttcatcgtattcccgcagccatcatctgccgccggaccttgcgagcagaaagcgccggaggcggcgctccccttgcatgttccccacggagtctgtgtctgcccccgggtgcgcactcaagacaaagccctcttcgtcccatcatggaaccac

SEQ ID NO: 712196 - DNA, 578 bp, Homo sapiens
tcaggatcttaaaggcgagtcgggtaggagaaggcattagtgctggtcagccgggtcgcttgggggtgagcagtgcaggcaggtgcgagggccgggagacccgaggtttaaggcaaagcaggcaagggtgtacgcagcccaggcgggtcacctttggcacaattaggggcggcaaccgcagtgaccgcagggcatggccgagtacaggggctggaggaccagaagccccttggtcctgaacctccactccaggccctggcaggcacttgggggacttctgtccccaattgttgagtccctggcccagctctgggtggtcagtggagcgtgtcctccctgtgccagctctgggtggtcagcagagcgtgtccgtgttgaaggacagctgggcccgttcctcctcgaagctgatgaggccctcgtcctccgtgtccaggtcctcgggctcgtcttgcacaagtgcccggagctccgtgggggcagaccggggccggagcaggctgagcaagcagccgagagggactgcagttgcgggatggggggtccgtctcctgctgctccaggttgccactctggtt

SEQ ID NO: 712197 - DNA, 736 bp, Homo sapiens
acgctgaggtgggccagaattgggagctggattgctccaacggcaacctcctaagtggcaacgccaggcaggggaagttggttccgggccactcagggctcaggctcatcatccagtgaagccaaggccctggacaacaggttcctggggcccctgtggggccccagggacaggtggtgggtagacggtatcattggggtgtggacattatgggccttcaatggcgatccatccatggctctgggcagacacccattctgggcaccccccaaaagaccccagggagatggctgggcgcctggaaaacccccactggtggcgggcagggcgtgtgggggctggggcttgtgcggctgggaacactgggttggggcttggagtggggcgggagactctctaaaactccgggtggcccgaagggcacaggcccacacgggggctttggggcttctctggcctttccaaggcgggagagaatgaatggctgaacgaacgaacttcttcaccggtggggcagaaggggaaccacaggccccaagcctgggtctctggttccccctggtcttttgggcagcgaacaaccttttggtgaaacccttcgatgaactcactggctggaaggaggaacttctcctggatcaccccgaaggaattctcaccaggtcccgtgaacgaaggctggggggtggggccgagaggatgtgaacaggggagggagaaccactttttgggctgg

SEQ ID NO: 712198 - DNA, 423 bp, Homo sapiens
gagccacgtgccatggtgtttgtgtaggtatgtaaattgtgatgtgtgtgactgtgtatggtacttttgtgcacgtgtgtatgtgtgtgttcacatgtgtgtggtgtgcgtgcattgcatggctgtgggtggtgtgtgcacacctgttttgtgcacacatgtataagtgcttacatatggttgtgtgcacatgtgcatgcataaggtgtgttcacatgtatgtgtgtggtgtgtgtgcatgtgtggtatgtgcacacgtctgtgaaatgtgagtgcatgcatggggttaatttgtgtatgtgcatgggtgcccacgtagggtgtgtgcacgtgtgtgcatgtgtgtgttcaccattgtttgtctgtgtggtgtgcatgtgtgcacttgagtgtatgaatgggggttatgtgcgtctgcttgtc

SEQ ID NO: 712199 - DNA, 774 bp, Homo sapiens
gataacacccgcgaccccgcagctaagcgcagctcccgaagcaatggacccggaagctggcagcccagatgagcgaggctgatggccgagtaagactgctccagctaccggcgtgtacataagcgaggcgtggaagatgatgccgcggatggccactggattacttcatggtctaccgtggaggccacttatttgcgatgttgccatggggaaccgtgtaccgaggcagacaggcgctcgctaatctgcggaccagctagacgagacgggctggtgaagaccctggatgttgacatgcgcatgacgtggatcggggcgggccctaccagacctgacaacgtgtgtgaattgaggaaatgtttgaccgcgtggtgcatccgaacactatactccctaagaagccgatgaactgaaccaatcacccttgatgctgtttggactggcactgaaagcccgtcttatgttcccacttcacgatcttggacctccttgacaaggtcctacacgttttgttctccctcatagaagaacttactaaggatagcgaacttctgagagttggcttccacggttatggagagacagacttccttggcgcggacttgggggtacccaaagtgcaaggtgatcccaaagcggacctatgtgcgagcaatggttgctaccaggcaacatcacccgctctagtttgcttcacccagccagacaaggtaccaacggacattcgacggatgcaacacgaggaatgtgttaaagccactaccatgcggcggc

SEQ ID NO: 712200 - DNA, 379 bp, Homo sapiens
  misc_feature (351)..(351): n is a, c, g, or t
  misc_feature (353)..(353): n is a, c, g, or t
caccaagagcgaaactccatctcaaaacaaaaaaaaaagactgagaatatcgttactatatagagatgttcattggggagaaagtcaatagagtcttgaatattctcgtgatgtgcagaataattgtgtagagattattttaaatcataaatacatcttatatcttaatatcttaaatatgttttgttttccatatatacttaagatatttctatgaaaagtctatcctatattgccagcagagtctgtgtaacctttgaaagttgagtaataacgtaagctgcttgcttattttcataaaacgtgatttctttatatcgtgcattttcattatttttctatatatagtanantcagtgtggcattgagagtcggtgtt

SEQ ID NO: 712201 - DNA, 403 bp, Homo sapiens
acccaggagaaagccccctcccttaggaattaggagtgggcatcaggcctgggaccctgctttccttccccgcccccagcctgttaagttaagtggacaggcccccaaaatgcccttgcatgtgagcaaatggcaaaaatgggtgtgtgaggggtgaggaggcctcacccgttgagccccgaaggagatcaggcagccccccctgcaggagaacgtcagccctccagggggtcagcccctgccagttccccccagctgcaggggccagcccggcagggatgggaaaggggtggggagcgagtccctgcctcctttgagcaaagattcagagtagggtcccatgaataggggaaaaaaaagagtctttttttgtttaataataaagaatttttattaactttta

SEQ ID NO: 712202 - DNA, 297 bp, Homo sapiens
ggcacctgtgatctcagcttcccgagtagctggtattacaggcatgtgccaccacaccccgctaattttgtatttttagtagagacagggtttctccacattggtcagggtggtctcaaactcccaaccccagatgacccgcccgcctcagcctcccaaagtgctgcaattacatgagccaccatgcccagccacatttttcccattttttggctgccacttgtatgtttttttttttttctcctagcagaaaacaaattatatgtcctctttttttttttgagacggagtctcgct

SEQ ID NO: 712203 - DNA, 229 bp, Homo sapiens
ccgttcagtctgggaccgctacgtgaactccaccatgagtttcctctgtgcttctgccctgcccatggcatatgttcaccactctttctgggtcctaacactgtgctgcgagtctgggggctctgcactgaactgcctgcctgtggtgcaatgcagtgtgaaggccggcgctgctcgctggacgaggtgggatcccgaggcctctccagtcctgccgagagcgcaccac

SEQ ID NO: 712204 - DNA, 355 bp, Homo sapiens
gaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacaca

SEQ ID NO: 712205 - DNA, 424 bp, Homo sapiens
ggcacgagattcaaatagtacaaagatttggcttaatgtgaaattgggtcttctttctaccccagtccccagtcttttagttctgtgttacagaaaagtactatgcgattgttagcaattgtctcatgtagtctttcagaaatattccaagtatataaatagtaatatactttgacatttttatacattgatttcccccttacatatgtttgaaacacttccatatcagtacatgtaatctgactcattcttgttagtagcttcataatagttatatgaatgcattataggtcatttccagtattttacttgcttagtgtttttggtcagcatcatttggagatagtgtgtaaagttaattttgacaaaggccaggcttttcaggttacatgtaattttatgtaaatcttacaggtgatatgag

SEQ ID NO: 712206 - DNA, 133 bp, Homo sapiens
ggatcccccgtccatcgttcatgtctgaactatccaacggttctgatcggtcttcgcataccgtccgactttcgattcgttgcattaactgagccacattcttgcgtcaattgcgttcgctctggtccgtctt

SEQ ID NO: 712207 - DNA, 1092 bp, Homo sapiens
cgccaaccgatcccacagcgccggcaggactccgggccgaactcctggcaaatccagttccagaggtttcagaccactcctagcaagacctggactggtgcaccgcgtatatcccccatcgcagtgcatgcccagcatggagggtggccaggctttccttcctgatgcaaggagaaccagctctgaaagaccgccagtatcgccgcaccaagcaaggaagcatcagaatgcctgggctttgaacctgaatcggtttttgactgctaggaggaagccagagactaccttcggtcctcaggtgggaaaacgcacaatagatgcggctcatgagcggttcatcaggacacaggtactgataaggtactgctactagccacaaaggccactcctggctccagccggaagacctgccgttacattccttccctgccatgcaccgtgatcctggagtgctgcctgaaagtccgacaatgactattacctgaaccttgtggcattggcagttctgggcaatgtactggcctgtggcactggacaacagtgtgtacctgtggagtgcaagctctggtgacatcctgcagctttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgtcgggctagcagccaccttgtgggcccctgagtggcccagcaggaagtgttgtgggctgcgcttgggcccagatggcgacattggccgtgtggtcatgctacctggtcacgtggtgtgccctatgccctgagaaggggggcggggtcaccggggaatttcccgctcagggggttcaggccgcctgttctctgggcctgttgtcccaggggccctgttcacaccctcatatgttcccggcaatagggagccaccattgtctcttctacgacgagccggtggcga

SEQ ID NO: 712208 - DNA, 518 bp, Homo sapiens
agcgagtaatatataccagaaataaaatgaatggtactttagactgctgtggcaaagtttcctgactaatacattcaggacctgaggggtagagcattcatgatggtacctggaagtcagccatatatggtttaggagatcagagtaatttcttattgtcgggaactcaaaggtaataccataaccttcatatgggatctagatgtagtctgtagtaaggaggactcaacgttacttgtatgaaaatttagaggaatcaccagttcagtatgctgcgtatgtcacagtgggaggcatcacctctgtaataaagcagatgtaagcaggacttaactattagtactattgtgaggtaaggaataggaaggcaacttctcataacattcccatggttactatcaccttatggctatttttcacaacaaggcccaacacaaaaacagatagatgctgcctcatacacgctgaacattctttggacacggatacagccaaggaactggtacggataagcgcgg

SEQ ID NO: 712209 - DNA, 121 bp, Homo sapiens
tcctgcaagacgggaaaagagctcggaagttgatataaaatggatgtctgagttccagcacgcaggtggggccatgggatcacaggataagtggcgttggcttgccatgattgtgaggggt

SEQ ID NO: 712210 - DNA, 138 bp, Homo sapiens
cgttatgtagtgcagtgcatgctcgaaagcgctttcttgtcttgcaactgctgcagtatcgtagagtgcctatacgacgaatacttgacagtcaaagtaggtgagtacgtggcatagtgtgtccttataaataggtag

SEQ ID NO: 712211 - DNA, 189 bp, Homo sapiens
cttaaaaacccccgggggcggttccccccccggggttttgccttgggcccgggggggggtaccctttttccccggggaccccttttgccctttgggcctttttgggggcccctttaaacccggttgggcccaaaaaccgggtgggggcgggccgggatttcccgggtttttttgccccccgggggccga

SEQ ID NO: 712212 - DNA, 896 bp, Homo sapiens
ttctgatatacgttttcctggtgcccatgacctgggactgcttcttaccccggtgttatcccaaggtgccctctcgagcgcctgtgttgttgtaggtccgccaatctttggcagaaatgatgtggttcagctccgcccagattcctgggtttgctcatatttgcgggcgggtcttacaccgaatttaggaatgagttctcccatgacctctagactaacatggcgtccttgtttggtaggtcaacatgggacataattcctcgtgcttaagacgtaaccacgaatcgccctctgttagtaccaccacacagctgaacacggtagtcgttctctccaacagtaccccagtacatggagacgtccttcctagggaggcaacttttgctctaaaaatctctagtgttggaggggcagtctcacggatttcttgagatgagcaacaactctacgggatgctcgctcctacgatgccctctttagtcaatatttgttcagcgtgcgtctcctaaagtggactacagtcgatatgagtgtgaaaggactactatgagggacaggcagtcgtgagtggttggcccgttaatctcccgataagctggtgttctctcccgtgtcttctgccgcgaggagcgcttttgagccaagagttctccacgtgggaaaggacatgaaagtacgctgctgacacgttgttctggtaaacaagtctcgtggtgagccacttggaggtaacagaagcacggccccctggtcgcgtcctgttaatttctaccgcgagcgtacattgactcgccattgggtttctgccactaagaacagttcaccattcggtacgttaaaattcgtagggggcaataaaatcactaacaaggaaagacctccaaacgaaaaatgac

SEQ ID NO: 712213 - DNA, 893 bp, Homo sapiens
tatcaacgcagagtggccattacggcgggctagagcgacatcatggtattccccttactaaagaaagtgtgtattaggaggagagagaggaaaaaaaagaggacaaaggaatggatataaaaaaatgtaagttccaaaaagagataacataagaataatacgacgaaaagatgctccttgtgttgtggaacagataaatttttttttagacataaaagaagtttttacggtggggaagtggtggggaacattcgccaagtaaatatgaattggcgcgccttcgaagaatggtccggggggtatcatattggggtgccgtctggggtgcttcaattgtatagcccggcgtttcggcgggtggctcattacacctctggtcctgggttctcgtgatatagactggggaagaaatcgtgcagttaccaggagtccccccggagggttcactctcacggcggtgtgtaagaattgcgcgcgcttctgccctcctgtggcggagtaaaaatgtggcggcaataaagcctgtaggttttaagggggaggggggctaaaaggggagaggccttccacagaggaggtttgtaaagggtgcatttaagggatcaaattggggaaacggcgaaatccttttgtaatgaacacacgcagtgagtgcaacaatctcggaacggccctgtatataacatgtgggagcgcgttgggacatgtgtgccactgacaccgtgcgggggccaaccacagctcggcgggtcgagtacgaaggaggccccatagggtgaaacaggcaattttaacaaacgccaccgctggacccgacagggggtgggggaaaagacatttcaattcgcacaagcttcggcgcgggcactgaaacaacaaacaggggtgggcga

SEQ ID NO: 712214 - DNA, 1140 bp, Homo sapiens
actagttctagatcgcgagcggcgccctttatgtatttttttcccaaggtttgaaaataagccattttattccaaaagcttgtcagtggccctgatgacatggtcgatgcgcgtgagtgatcaacgggcgtcaggtcagtttcaaacccaccgagatcgttcataagactcgtgaggatcatgtcacagttcatggctgtaatgccgtgattatttggccagagtgttgcgccatttgtcttccatcttatcagccagcgtgagaggaacactcgaggcaagggaagaatacttcacgaggcagtttctcgttgtctcgttggcagtgaaccatgtgggcacattgtgggctcgctcgaaaacagcgagaacatcgtccctctgccaatctttcgtggacagcatgaggcccctcgtggcgtgtcaacacgttacgccaagccatggaccagacaatattgtgtcgcagagagcccccacagtttacacactcccatacgagctcataaacaggtggtctcctttacccgagggtcgtcccgtgcaacattattgggtgccggttcgggccattataaagtgagcgcaatttatcaccaaatgtgtggagaaagaagaatgtggggatctcacattaacgatactatactatcctttaaacaccgtatagaaacctccccagagctccgagtggtaaggaaacctactctgtgcctaaatattcccgtggcattgctgagaggacacgacccaaaggatacgtggggcgccccatacacaacgtacctacacgtgggcatctcgacgacaaaaaaggaaagacatacgaagggttactcgtgctatggggcagtaagacgtaggacgtcagggacaggaggggacattagttcacgtagacctaacttatcataaaaaaaaagctgtggacgtggcgtggcatcagcagcggcagcaccgaaatcacacgtctcacaaggattacccacacatatccccaccctatagagggacacgtggactaatcacgtcctataccaccacttaagacaaaacagcggcatcctatcacagccatttgagcgccacggtagaaagactacatgtaccactccgagggggacagaaagatccacgtgg

SEQ ID NO: 712215 - DNA, 766 bp, Homo sapiens
agcggctctctctgcgtaatggcgctttacggccgcgccgcaaagcaaaggtcgtgcgttgtcggcttggtagcgccttccttctccgacttcccagacttcccagtctgcgcaggcttacttggggacgcagggaactaccaagaaagtgtcagaggaaaggaaaggtgaaacagacgaggaactggaacgggaataagtgggaaagaagccaaggggtttgagagagacttgctgccctgggtttttggtttttgttttttgagacaagagtctggctctgtcgcccaggctgcactgcaggggcgcgatttcagctcattgccgcctcaacctcctgggcttaagcgagtctcttgtctcagcccccgacgtagctgggactacaggcacacaccgccatacctggctaatttttgtatgttttgtagcgacagatttttgccatgtcgcccaggctggtctccaactctcaagctcaaataatccaactgtttgggcctcccacagtgctgaggttacaggcctcagccaacgcgcctggccctgctctggttttttagggagtaagtagtgcggaaaggacgcaggtcttagccatcatctatgaataatacttcgtcatgggaatgaacacgcctttgcaaacattatgacctgatcagggaggccgacgcgggatcacttgcagtccggagttcaagaccagactggcaacgtggtgaaaactcgtctctactaaaatacacaattagctgggcatggg

SEQ ID NO: 712216 - DNA, 381 bp, Homo sapiens
ctcagcactcaagtcctcccgaaccgagtgccttccagcttgcttggccctctggtgctgcggtaggggctctgggaaggtctttgctgggatttcttcctcttcctcttcctcctcctcctgtgactcctgcagcagttctttggcttctatccacttcctgctcccttgtgctcatggtgcccactgtgtgccacatgtgccaggccacagcgccgtccccgagtcacggcccacaccccatggggattctcgacaccggagctgaaggccacaaggcgcccacagtgaggatcacccgagccgtgacagtgagggcgttgggctccgtgaagaacaggtccccaccctggaagtcatcgttgaggatggtccgcacag

SEQ ID NO: 712217 - DNA, 128 bp, Homo sapiens
cccccccccccccccccgggggcttgggctgcaggtttcccgggggggggttttttttttctttcccagccctttagccctttttccttttcccccttaaccccccattaatttttttttccccccca

SEQ ID NO: 712218 - DNA, 311 bp, Homo sapiens
  misc_feature (8)..(8): n is a, c, g, or t
  misc_feature (100)..(100): n is a, c, g, or t
tgtcaggnattacaggcatgtgcaccacacccggcttatttttgtatttttagtagagacaggcttcgccatgttgaccaggctgtctcaactcctctgngaatccgcctgtcttgcgcttccagggtgctgcgattacaggcgtgagccactggaacctggccttgtattgctttattttttctcttacatgaagtaaagcgctttggtcaaacacacataaaatactgccttgtactggtggtgggttccattagtggatcacccacagtgttctacttggcttgtccaatggtgccttggaataggga

SEQ ID NO: 712219 - DNA, 169 bp, Homo sapiens
agaggtggtgtctcccaattagtgcatgagtaggtgctgcagtatgtagcggttaggcgtacggcaggtattggttgatgagtaggctgatggttcgataataactagtatggggataggggtgtaggtgtgcttgtggtaagaagtgggctaggcatttttaatctta

SEQ ID NO: 712220 - DNA, 647 bp, Homo sapiens
gagagatcgggatagaatcgccggacaggtggccgctgccattcaagaagcattagaacaaaccatgctggtgttagtcaatagcctcattcgtgaatcctggatctgggtcgtcttcttttcgaggtctcttgcgtctgtctggccaggctggagtgcggtggcgccatctcagctcacgtgcaatctccgccttctgggttcgaatgattctcctggcctctagccatcccgaatagtgctagggattcacaagtgtgagccattgtgcctggtctggtatgggtctcttgattgtacttacaggggacatgaggaagaggcgcttcctcccattcccttgggtgagggggcccagggtgattgggtggatgtatacccggcatgccagtcggtggcttcccaggtcaaacatgttcccatctgagttaggaggaaggagccagggaacccttgtggctcagctcccccagcatcctgtcttgcgcactatgtcagcaacacgtgtagcaccacgcaagaggataggctcgtgagcttgttgagctacagatgggtccctggggctgccagagagttggcttcctgctggagtcaacgctgagagggccaggggttccatgctcattccctggcacggtcacaca

SEQ ID NO: 712221 - DNA, 937 bp, Homo sapiens
  misc_feature (787)..(787): n is a, c, g, or t
ggtttacaccggcggtcagtgcggccgggttccttccgcgggacggggatggaagaaactgagtgccttaggatgagctgtccatcacagtatgagtagagagagaaccccgagattctagttctggcctcctgactgggagaaacgatgatgagtcgtcgtaaagagagaggatgtctctctcagacctggcacctggcggtgaagctggctgaccagccacttactccgaagtctatacttcggttgccagagacagaactggcgagaaatactcgctagggggctatagtatttcattctcgtgaagcacgcgttatatgcgtggctaaagctccacgtgagtcgtgttcctatgagccctggagctgtattgatcgtgatctacttgtggtcgtgaagctacaagatgactcagacacttggacttctattggcattcaacctgggtccactgtccatgttctgcgagaagtcctggcctgaacctgatcgagagaccggaacctgtggtacaaagtggactagtccattgagatgagttcctggtgtgttagcacactggcctgtcacagtcagtcgtcctcttgacagggatggcggtacttgtaaagatgctcatggtaataaaggaagtccgctggcatcacgcatcattcgtggtactacccctaggcctcaggcgagtgaccctatttgcttcgttgagggttctcccagggagcaaggacctctttctcgtgtcttcggctgtatgccaaatatgcttgagtacgtcggtgcctgntcacctcatgcctcgtcaatgccatttgtcctgggttctgcactccgtagccaggcagtggcccgaatgcctggggactgatggcctcttccccggagcatgcccttccaggtcataaccgggatatgccaggtgggttacctggttgag

SEQ ID NO: 712222 - DNA, 165 bp, Homo sapiens
caaagacacaggaatatacttttttgaaattcctgaaagagattgggaaacagtatggcagcttgtcacgcgggtgcattgtgttagtcagaagtttgagatttctactgcagcatcgtccagtcagatgattgctgcagcattgtttgtcacgacctgtctcta

SEQ ID NO: 712223 - DNA, 262 bp, Homo sapiens
atgacgtctagtaggatccccgctcccgacggggtgcaggaaggagactgaggagccacagtgtctgatccatctgcagcctcctctccgggttcttcagggtccccgaagtttctgaggcaggggtctgctggggtctggatgcaagtcttctagcagtgctgggattagctccatgtgggtaaagctccccacgtagcctacctctgtccccccagcgccgaaaagcccagattctcgtcaaaagcttggtcggcccaag

SEQ ID NO: 712224 - DNA, 1049 bp, Homo sapiens
ggctacataagctatcgggcccataacccgaaaatgttggttatacccttcccgtactaatttaatcccctggctccaaacccgttgcatgctactactatccatctttgcaggcagcactcatcacagctgctaagctcgcattgattttttaagctgagataggccatagaatataagcatgctagcttttattccagttctaacgcaaagaggaagatacacacccgtcgttccacacgaagactgccgatcgaagctatttcctcacgcgaatgcaaccagcatccataattccttctaactagactatcctcttcaatcaatataacttcatccggaacaaatgaatccagtaaccaagtagctaccaagtcaatgtactcatcatttaactaatcataaatggctctaatagcaagtaaaactaggaactagtccccctttctcttctgagttccctagaggttacccaagggcacccctctgacgatccggtcctgcttcttcttcagcatgagcaaaaactagcccccatctcaattcatatagccaaatctgctccctcactaaacgtaagccttctcctcactctctcaatcttatccatcatagcaggcagttgaggtggattaaaccaaaccctagtacgcaaaatcttagcatactcctcaattagccacataggatgacataatagcagttctaccgtgacaaacctaagcataagcattcttaattgaactatttatattatcctaactactaccgcattcctactactcaatttaaactccagagcagaccctactatatttcgcactgaaagagctaacatgactaaagcctttattccattcacctgctttcctaaggaggctgccccgttagcggctttttggccaatggccttatcgaagattcgcaaaagcatagctcatatcccaccattatagcacatgaacctcttaagctctattttactaagcctattattcacttatcaattatcccattttaacgtaactaatgcggttgaatacaaaccg

SEQ ID NO: 712225 - DNA, 302 bp, Homo sapiens
ccctgaacttaggctggctctgaacttaggcctggcaggaggattgcagcactttgggaggccgaggtgggcggattacctaaggttgggaattcgagaccagcctgaccaacgtggagaaaccccgtctctactaaaaatacaaaattagccaagccgtggtggcatatatctataatcccagctactcgggaggctgaggcaggagactcgcttgaacctgggaggcggaggttgcagtgagccgagatcacgccatagcactccagcctgggcaacaagagcgaaactctgtctcaggg

SEQ ID NO: 712226 - DNA, 83 bp, Homo sapiens
catttatttggggggttttttccccccctttctttccccagcccttttgaaatcaagcaagggggttcctttttgagatttta

SEQ ID NO: 712227 - DNA, 233 bp, Homo sapiens
ctctagaggatcctctcctacgagcgcagcaggtggtttcgacgaaaatagaataaaattctaaaacaggttgatatggaaattattttctaatacagtcttttccaggttgcataaagtacgtcccggaacctacgggcgactcaacaaaaacaagatcaaaaacaaccaggtaccgtcagatgaaaatcttcaacgctgtactgcgagttttacgccccctccaagcgcca

SEQ ID NO: 712228 - DNA, 184 bp, Homo sapiens
ccaaaatatttatgtcaatgtccaaactaagtccaatgccatgagactgaagtctttgtggaaaccatctgttacagacaagcttatttccaaatgccaccttcatttccaatacatctcactcaggcaaaggaggctcaagtgtaacctcagagggcctagttttagacatttgaaagtggtt

SEQ ID NO: 712229 - DNA, 106 bp, Homo sapiens
tgtcagcggcccccaaactctctatccggcccgggccagttcactcattttttatttatttatttatttatttatttatttttgagacggagtctggctctggtgc

SEQ ID NO: 712230 - DNA, 393 bp, Homo sapiens
caatttatttatccattttcctgtcaatagacgtttggaatttttgaagcttttgttattcttggctgtgatgtaggaactctcttatgcatgtctctgtgcacacatgcaactgtttctctgtgtttataccttggaaggccatggtacaaaatattaaactctacaagatttacaactccagaaattatttttgacaaactgatttatctttactctctaacacttggtattgtcagacttcttaatttttgccaaatactttgaaaaatgatattgtgatctgatattcattttcaaggttttttcataagattgatcagctttatctgtttatttgtcaaatatattcattttgattaaaatattatatctttttcccagttaaaaaaa

SEQ ID NO: 712231 - DNA, 563 bp, Homo sapiens
  misc_feature (457)..(457): n is a, c, g, or t
  misc_feature (479)..(480): n is a, c, g, or t
  misc_feature (483)..(483): n is a, c, g, or t
  misc_feature (504)..(504): n is a, c, g, or t
  misc_feature (528)..(528): n is a, c, g, or t
ctatgccccccattcccaaaaagccccccagatggccaacttcttcctaattgcaaaaacttgcctttttcgcctttacgtccccctctattcctttaaacaaattttcaaacaaaaattgttactcccccttaaaaccaaaaattttggttttgtgtaaagaataaaaaggggggattgctgggtaaaattacaagcaaattttgtagatttttttccctttgtcaaaaaaagtttatggaagttaatgctgtcaaccccccctggggggcccttaaaaaaataaaatgccgccctcccctgctgagtttaaagcttaaaggcctaaggagccccagccccatttggctaaattggtttgcaagtcccccacttttgggtttaccccccccccaagatgccaccagaccaccaaaatttcccctgtgatttatctttttgctgagggggaaaaaangtaaatgttttgaaaattcccnnccncctttgtggaaactgtttcancaaaggtttttgtataaagggaanagggaatttccaaataaaaaattaagtatgttttg

SEQ ID NO: 712232 - DNA, 91 bp, Homo sapiens
tcagctgaatgctccttggggaaaggggttggggtacagtcatcatcaggccctggggcctgagagaattggctcaataagatttcaagat

SEQ ID NO: 712233 - DNA, 570 bp, Homo sapiens
aacagaaaggcctagcaatggaccacctgatgatgcttccactgtggtcagataagataatttacaattgaatggaattattttcctttcagtttatagtttactgaagtgagccttgcattgtaagttcctgaagtaatcactggaaatgtcttaattcagtagctccatctttagttaatgctgcactaaaagaaaaaaggaattttacttacatactttttgacaagtcacattcatatatgttttagtggaaaaactgttttacatcttatatatagaagctgtaaaataacatgttctggggagaggaataagatgaatagaataacattataattatctaaatgttctttaaatggagatagccacaatctttcgtaaaactctggaaagaacagcatgaccttcttattgccccctttccaccgacgtcaaacagaaggaaattatagaataagtctgtctaaattttaaatggttcagttatcggaagactttagagagcaagttttccacaaatcatctctgcgccattttgtcttgattatttttttaagggttggtttg

SEQ ID NO: 712234 - DNA, 1011 bp, Homo sapiens
ctccgattattttctcaccaccacgtggggagatttctcgagaacatgggctttttcgacagatgtttctcaacatgttgttcttcgccgacacgtttggtggtgccaacacacaattgccccctcgcgtatgagagcgaggttctcctcttcgacgagtgattgttttctggtcacttctccccgcgccagattaatagtcgccggtcttcattccccctcttttttgtgtggtggatcgacggccagcctccgtcgtagactcaaagaggttgttcgttgccggctgaccaacagagagttgggtttgcgccccccctgctgtttgataagaccgggcgtgagggacaggcgcccccccttcttcttgtaacagttgtggggagggcccccccccctttgttattttggttctccgcccgcccacccccctttgttgggtggtgcctcttttcatcagcactgccccccctctggggccgtcgtctttctgttttggctaagtgtgtgcagcgcagccccctcttctgcggtcggggttttttttctcacacccggcggtgcgagctacatacttgtccttctgtggtggcttcctcccgcgctgtgctctctctccctcttcttcctccccatcggcttcgtctcgctgcggcgcggcgcgaagagattatctcttccctccttctgctcgccccccccccgccttttattttcgttgcggtggtgtgatcaacccctttctctcgagcagttgttgttttctctattcgtgccgcccctcttgttctcttgtctattgcgtaggggtgggtttggtttcgtgcttccgctgctgtttgtttgaccccctccttcggcgagagaggagcgtagtttcttttggtccccccctttgtgttctttttttcttggtgtgctccccttctgtgtttttttttttttttactccccgctttttttttggcccccccccccccccaccttcccccgcaatgtgggcccccccca

SEQ ID NO: 712235 - DNA, 265 bp, Homo sapiens
gagtaactggtcgtcaaaactccaggtgacacaaaatagacgtacgaaatggaatttaagatatctagaacacacaaatagtctaagacccaaactggtattagatacccgacatatgcttagccctgtaagctcaacagttaaatcaacaaagctgctcgcagtatctctacgagccacagcataaaagtcacaggacctggcggagattcatatccctctagaggagccttttctgtaatacgataatgtgatagccgggtac

SEQ ID NO: 712236 - DNA, 351 bp, Homo sapiens
agtgatccccctcccaaggtaatgaggaacttgtcaagagatattccgcctagaccagatacggtgcgctcccatcttgcgccaaggtggctcacgtggtcacccaagttctttgatggctttcacctgctcattctcggtatgtgtctcatctgcagtcacacaaatgggggtcatttttgtcagtggccagtttgtgcagtatccagtcgtgactgatacacatctagcgccaaatagtaatgcacactccattgcatacagaccgctctcccagtcatcacagtctggtttcttgatatcctgaaggaagattcggccacctcgtaggttctgcagcttcatcagtac

SEQ ID NO: 712237 - DNA, 183 bp, Homo sapiens
ggtgggctacctgagtgtgcaagcctgagaactggattactagccaggctccccggctcgactgtaagtcttgtgtaggtgctgggaagtccctgaggtcatcaggagcccggacactgcgggaagagggaggcacaggggctggacccgggatcctgcccccctggccacccaccatcaggc

SEQ ID NO: 712238 - DNA, 794 bp, Homo sapiens
gaaggagacagacttattactagatgattcgctggtgggggtctattgggaatcgacgtactcaagaggttctccatgtgtggtacaggatggcatagctgaaggccctgaactgtggaaccagatggcacagtgcctcacctgcagcctggcaaccatatatcatctcacagctctgaggccctggggggggttacttcctccaccaccatccctatctcacacatgaccagaccgtgtgctggtggcccatgcaacttggaatgttggccagactttctgaaaataaagaactatgtggataatagcaggccaacaaaaaaacaaaaacacacgaacaacaaaaaaaacaggaagacacacaacaaagaaaaaagaaacagaaacgagggggggggggcgcacgaccacagcacgacaggagggagggacggggagaagagagcagagaggagaagaaaaagagaaagcagcacaacagacgggaagaacacagaaagaaaccgacgaagagaaaccaacacacagagagagaggcagacaaatagagccgagcacgacataataactaacacctcaacatctatctcctctacacaaaacaatcacatacgcacacgacaaaaacatatacattacaactacactcagttacctataatcttcaaataaattcaacatcgtctcgttcaaaacaatcgattccatatcgctttatgacttttacatatttattctcactcactatcattcactcattactacattatattcaatagcattccaccacaccc

SEQ ID NO: 712239 - DNA, 432 bp, Homo sapiens
agatactgtaacaaaataaataagtcagacagagcaatgaaatagatgtaggagttctatagtgtgtggcataaacatagtaagaaaacagatggtcatgcacctagaaatatttacttactatactagcttatgtagctttaggaacaacacatgtataaccaataactgactctgaactatcaagcactgtggggtggctggaaggtaacggtctaagctttgtgcaacactctacatatataatctatatttcacttatattggcaatatactatacccagataaaagtcaaaatacacctagaacataccagaaaagcaagctatagtcatacctgctttaccggtatgatctcgtctaacacaaacattacattacagaaaatctgcatcaatctacacggaccatacacagtgcacaaactgaaat

SEQ ID NO: 712240 - DNA, 758 bp, Homo sapiens
ggttgcaaatactgggagcactttgctaaggactggtggtgcctggggtgtcatccgttcatcatgtatcggggtttcccctggggaactagatctagagcttcgttatgctgtaagtcttcattcacttggagaacttgttccatgacgactggaccaagcctgagtgaaagaattggcttcagtcccgggtgtcattcccttatttggctacccagataaattaggcaagttccatattcttggaggtctgggggtcaaccagatgtgcagtgacgcttctgcgcttggcccgtgttgaggtcctaggatttgggcaggttgggacctaccgaagtcagctacacgagtaggggtgggaaaacctggagtcccttgtggcatgccgattggatgaaccccacgaacggctgggtttccgacgaaggtacatatattccctgggagaataggggagtggcctttcccaagccattgttggcgccacaaaattgtcgtttcaacattcaacggtgtcgccagaaatcttttccaaagggctagaaatccaatgctcccttttggacccattccaagccgttagagcattggccctttggcacgccttggcacaccttctccatgggggaacgaaaacaggggggggggtcctactttacaagaggcgaaaacacttgggaagccactctgggcgcacgaacacacaaaccccactcacacaccccgacaagcacatcacacaaacgacacaacacttg

SEQ ID NO: 712241 - DNA, 331 bp, Homo sapiens
ggataggaacataggtatatgggaaatcctcgtgcggacatcaaagacaagacgagcaaaagcggaagcgaataggcccgctacaccccgaaagcgccggctggacttcggcgctatgccgatagcgcctttactcggcgcaatgcgcgtggcatgaggcgcgccatgacccgcaccatcaccgtcgccgcgttgcatattcccctgaccggccctgttcagccgaatatcgatgccgtcaccgcgctcgtcgaggaagccgcctcgaaaggcgcgcaggtcatcctgcctcccgaactcttcgaaggcccctattactgtcaggtcgggg

SEQ ID NO: 712242 - DNA, 1053 bp, Homo sapiens
  misc_feature (490)..(490): n is a, c, g, or t
  misc_feature (494)..(494): n is a, c, g, or t
  misc_feature (511)..(511): n is a, c, g, or t
  misc_feature (529)..(529): n is a, c, g, or t
  misc_feature (646)..(646): n is a, c, g, or t
  misc_feature (657)..(657): n is a, c, g, or t
  misc_feature (903)..(903): n is a, c, g, or t
atctatggggccgcgtgaaacggccaatcttgttctgccataagccgtcacggatactggggttctcccccctcagtctctctatcatagtgtggaccctctcgcccatactgtgggacccactaaaacgttataccccggggacacatctccgctgagtgccaccgtttagaaacaaattgtgctcgtggaccccacgtggaaattggcgttaaaaagcggcaagaacgggaaacttaagtcactggaagcacaggtccacccccaccaggccttgaagaaagccatgccaccagggcctcaagggctgaagataagggggaaccagaaattgggcctaacaacactcgaaacaattggagacgaattccattccgcctaaaccacgttatacgtccttccgtgatacgagactctgtccgctcatacaggaatgtactctactccacaacaagcgttacatcggattcacatgagagtggtcatattncttncgattagggaatgtacnccatgtcatgtgttacancccaggaacggtgttagaagtccccggtctcacacctgtcagaatgtaggtctcaaatgtcataagtaccaatcttgtggaatcttaaacgttaagttccacgttatgtgacaccanaatgctctccnttaggatacgttccgtggtgttcagattcttgttaggccttctgtcacccatgtgaaagtgataccatgtggataccattgtggtgattggccgtgtttactctataactctaattccgtgtaaatttaagtggaactctagccaataagttgaggttaagttccaccaccaggccaggaaaggtgtgttcctggagaggaaccaggtagccaacctctgtatatgccgatatattgggttttgtncttggtaatatctccaggtctcctgtggtccattatgtgaggaaccaaccggatggaagaagaggtaccgtgatagagtttcataggaaaaagagcccagctgacttagtgccagtttttaacatatttttcccattaaatcccattacc

SEQ ID NO: 712243 - DNA, 519 bp, Homo sapiens
  misc_feature (330)..(330): n is a, c, g, or t
  misc_feature (377)..(377): n is a, c, g, or t
  misc_feature (507)..(507): n is a, c, g, or t
tgggtgacagagcaagcccgtctcaaaaaaaaagaaaaaaaaaaaacccccctcaattttggattacattgataattggggccagatcataaagagagctttatttactgtattagttttttcttacactgctatcaagatatacctgagactgggtaatttataaaggaaagaggtttagttgactcatagttctgcatggctggggaggcctcaggaaacttagaatcatggtagaaggcacctcttcacagggtggcaggggagagaatgagtgcccagcgaagggggaagccccttataaaaccatcagatttcgtgagaactaanacaatcacgagaacagcctggaggaagccatccccatgattcaatcncctcccaccaagtccctcctacaacacatggggattatgggaactataattccagataagatttgagtggggacaagcctaatcatatcagcgtatcatgaaaagattacattttattccaggggtcatngaaaccattgaa

SEQ ID NO: 712244 - DNA, 695 bp, Homo sapiens
  misc_feature (52)..(52): n is a, c, g, or t
  misc_feature (73)..(73): n is a, c, g, or t
  misc_feature (99)..(99): n is a, c, g, or t
  misc_feature (102)..(102): n is a, c, g, or t
  misc_feature (122)..(122): n is a, c, g, or t
  misc_feature (138)..(138): n is a, c, g, or t
  misc_feature (146)..(146): n is a, c, g, or t
  misc_feature (250)..(250): n is a, c, g, or t
  misc_feature (258)..(258): n is a, c, g, or t
  misc_feature (262)..(262): n is a, c, g, or t
  misc_feature (329)..(329): n is a, c, g, or t
  misc_feature (421)..(421): n is a, c, g, or t
  misc_feature (448)..(448): n is a, c, g, or t
  misc_feature (454)..(454): n is a, c, g, or t
  misc_feature (466)..(467): n is a, c, g, or t
  misc_feature (491)..(491): n is a, c, g, or t
  misc_feature (493)..(493): n is a, c, g, or t
  misc_feature (570)..(570): n is a, c, g, or t
  misc_feature (575)..(575): n is a, c, g, or t
  misc_feature (692)..(692): n is a, c, g, or t
gctccctttcaccaaagctgaaggcagggcacagttgggggatgggggggcntcggggtaaatgtgggggttntagggcccagtgacctcagttctggntcntgggaaaggggtcggtatgnggtaacgtggtagggntccagttntagaagccaggacctagaacctagtggtttcacagtgggcagagcagttgggaataagccaggttaggggtgggggaagacagccagctctgtcctctgcaggnggattccntggnggggggtctcagatttaggaagggggggtggggtctggtccagaaagggccagaaagacagggaggnatctgggctgagactgtgtgtcctccagaagggatgagcagccaagtggttctaccacctcttgcttgggcaaagtgtaggggatgacaggngccggatggagggatcctccagggagngcctgnctctgacatgcnngggagggctagaacatccctcccngngccccacttctggggttgaaatggaggaccatctgctctcagttaccttcaactctggaggtgccccggcgtctggncttgntcgccccattcgcggggcaccacgtggtttccagaacttggtggcccgcatgccgggcctgagcgtggcctgctctgtatgctgtagaatttgtaagccacacggggggctctaaanccc

SEQ ID NO: 712245 - DNA, 429 bp, Homo sapiens
acaggaaacaataataggatgaaggttcatgcatctgggatagaagataaagacgactagtatcccatacactcactatgatcaaataatgaactctagatggatgcaatggatgtgacatgtagaaaggtatcaagatttgggggatgatacaagaatatatcgggaaatgtgttagtgagctggaggacgactggggtgaagaagtttgtgactggagaaaagcactgacgataaggcaaataattgatgaatttgattacatcctcaaaaacctaaagacggaaatatcattcgactcagcaatcccattactaggtatatacccaaaggaatataaatcatcctattacaaagacacatgcacgtgtatgtcattgcaaaactatccacaatagcaaagacatggaatcaacctaaatgcccatc

SEQ ID NO: 712246 - DNA, 237 bp, Homo sapiens
  misc_feature (13)..(13): n is a, c, g, or t
  misc_feature (43)..(43): n is a, c, g, or t
  misc_feature (83)..(83): n is a, c, g, or t
  misc_feature (97)..(97): n is a, c, g, or t
  misc_feature (167)..(167): n is a, c, g, or t
  misc_feature (235)..(235): n is a, c, g, or t
aattcgcggccgnttcgacggtggggggccatgctgcatgtanagtctttgcccgcggcctgatttttcctctcaatcgtganggggccaacgagangcaaccaaggattcacaatcattgccagagattcaaaagttttccagtcgaatcagagaggccaagttancaggagacccataatgagtattacaaagctttctccgagatgggcacttttaaccgaacatggtattnct

SEQ ID NO: 712247 - DNA, 315 bp, Homo sapiens
tagctgggcgtggtggcaggcacctgaggtcccagctactctggaggctgacgcaggagaatggcgtgaacccaggaggtggagcttgcagtgagccgaaattgcgccactgcactccagcgtgggcgacagatctagactccatatcagaaaataagctaaaataaaatcataataataataataataatgcttgtggtgttcttcaggctaccggagaatgcggttgctgttgggcgcaagctgctcctgactgtttaaaaagggagctgctcagtggttcacgcctggcatcccatgactttggtaggcctg

SEQ ID NO: 712248 - DNA, 443 bp, Homo sapiens
agcgccacagaaacactacgaggaacattacaatgaacagaatatcagtgagatatgggacagctgcacgtaactaatatacatgtgatatggttgggctgagtccccacccaaatctgatcttgaatattcacgtggtatgggaggaacacagtaggaggtaattaaatcatggggacgggtctttcctatgctggtctagtgatagtgaataagtctcacgagatctgatggttctatggttctgtaagggggagtttctctgcacaagctctctctttgcctgctgccatccatgtaagatgtgacttgctcctccttgccttccaccgtgaatgtgaggcctcgccagccatgtggaactgtgagtccattaaacctctttattttgtaaattgcccagtcttgggtatgtctttatcagcagtgtgagaacaggttaa

SEQ ID NO: 712249 - DNA, 185 bp, Homo sapiens
gagagtcgagagtgggagaagagcggagcggtgtgagcaagtactgcggcctcctctcctctcctaacctcgctctccaggcctagctttacccgcccgcctgctcggcgaccagaacaccttccaccatgaccacctcagcaagttcccacttccctcccggcatcaagcaggtgtacatgtcc

SEQ ID NO: 712250 - DNA, 161 bp, Homo sapiens
caggtcacgcgttgtagaaggtcctcatctcctcccatccctacgcatctttacataacagacgaggtcaacgatccctcccttaccatcaaggtcgggtgtggcaccaagtggtactgaaccctacgagtacaccgcactaccggcggactacatcttca

SEQ ID NO: 712251 - DNA, 721 bp, Homo sapiens
ggtgtggggttgcgcaggggcacggatctcggagctctccccgcttgcgccgagtttgtcagacgccttccccacccaaaccggggtctctgcagtcggaagcactcatcagtgcagtccccgcgcgggtgccggctcgtaaccgttgccgcgggccgtacgatgcccaagaagactgctgctgtgcacggtagccggtccgaggctcggaggagcaatgcgtggctgatcggcagattcgtcgcaagactacgcttgcctacgctcggagcaggtgatgaagacgaagaactcggcatctcgcatccgtagttcccttggccgcacttgtcacaggaagggcaagatggcggccacaagtgggccggatcctagacaagagaatcgagcctgtggatgatgtgcatagttcggaaatcgagatgcattatcacgtagcctgaggtatatgcaacgccttgcacccctcaccacacagattctagactagaaacaacagcaacagttctaccgacgggtaagaaccacgaccacctgcttacagctttcgcggaatagtagacatgggtactctaacaattacaccttacctagaagaccatcatagtgaccttcgaactcctcccatcccactacttccgcaggcaatataccggctcagccatctgtgctgccactggcgttccacgcacctgacggccagtgtctcaattcccacatg

SEQ ID NO: 712252 - DNA, 327 bp, Homo sapiens
gacacggagtctcactctgtcgcccaggctggagtgcagtggtgtgatctcgtctcactgcaacctccgcctcccagattcaagcgattttcctgtttcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccccaacacccggccatgaattaactccgttaaaaaataaacgtatacattttgtgagca

SEQ ID NO: 712253 - DNA, 180 bp, Homo sapiens
ggactatagagcaagactctgtctcaaaaaaaaaaaaaagagacttcccattattagagtgaaaaattattttgtccagagtacttggaccagcccggaagcttccccaaaatacttttgtcggttgttaaacaacagcaacaacaaacattgacagggctccagggccgggccgggggt

SEQ ID NO: 712254 - DNA, 474 bp, Homo sapiens
  misc_feature (324)..(324): n is a, c, g, or t
  misc_feature (378)..(378): n is a, c, g, or t
  misc_feature (383)..(383): n is a, c, g, or t
  misc_feature (426)..(426): n is a, c, g, or t
  misc_feature (469)..(469): n is a, c, g, or t
catccctactatcttctgtctagtcatactcctattcaccattctcaactactcatgcattccctgctcttgtttacactgccggtttacactacttctccaagccatcacagctgatatttcctggtgctatccccaaactgccactcttaactcttgaagtaaataaataatctttgctggcaaggctatgctgaatctccttaggcactctaattagatgtcctaggtcctcccaattcttagacctttaatacctgtttttctccttctcttattccgtttagtttttcaattcatacaaaaccgtatccaggccatcancaataattctaaatgacaaatgtttctgctaatagtccacaatatcacccttancacanaatcttcctcagctaatctctccactctaggttccacgcggcntaatccgttgaagagcctgagaacacgccatattttcaaacanccaaa

SEQ ID NO: 712255 - DNA, 116 bp, Homo sapiens
gctcgaccccataaccgcggacccggctattcgaatagatcatgttaaccctgcaggggtgtacttcttcacacacgctctcgccacttaccaccatgtacacatcgtgtatctcg

SEQ ID NO: 712256 - DNA, 179 bp, Homo sapiens
cgggaggctgtcagtgcacagccacatacctgatgttctatatatacttagcatgtataccatgagtgtctcatgttctctcgatgggattataaaactggttttgtattgctatatgtcagtgcccatgttctatgttgctagcatgtataattaaaattgacttttgatcgtcaatc

SEQ ID NO: 712257 - DNA, 325 bp, Homo sapiens
  misc_feature (32)..(32): n is a, c, g, or t
acccccctttgcccacctgtgagtggcttccntgatggaaagactgagtgagaggactccttagtggccggcccttgtagaggcacagagctgcaggagctgtggtgagggccggcaccatgagacctctagaccccaggctcttgaagcgtccctgcctgccctccctgaaggacttcccaggccaccttgccctgcccagcgctgggggctgagtcctttctgggcacaccaggtcacttggcagagtccctggccccgagcgggcactgaaggaggccctcgcacttctgggggccctgggttttcgccgtcagcatttgag

SEQ ID NO: 712258 - DNA, 501 bp, Homo sapiens
ccggaagcagggcgtcgcgagctgtgaagctgcttcggcggtgcttggcggacagaagaggcatcagcgtcgagaacgaacggaggtgaggcagctctcgtccgagaccgacctggagagtggcgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagttccttcagaagcagaggcggattgtggaacggctggttcggaggggattccagaacttacttcgcgctggatgactttgtggagatcactaagaagtacgccaagggcgtcatccccagcagcctgttcctgcaggacgacgaagatgatgacgagctggcggggaagagccctgaggaccttgcactgcgtctgaaggtggtcaagtaccccctggatgccatcatggagatcaagg

SEQ ID NO: 712259 - DNA, 609 bp, Homo sapiens
accggcagaatcacactccaagaatttagtacctttagcaatcaacctccaacttgctcctcccccccagcctcaggcaaccagtaatccactttctgtctctatggatttgcctattctggacatttcacattaatggaatcatacattctgtggccttatgtgactggcttctgtcacttagcacaatgttttcaaggttcacccacagcgtagcatatacgagggcagggtttgttttttaatttctttttgaagacagggtctccctctgtcacccaggttggagtgcagtggcacgatctcagctcactgcagtcttgatctcccaggttcaagtgatcctcccgcgtcagcctcccaagtagctgggactacaggcatgtaccaccacacccagctaaattttaaatttgttggagagatggggtctcactatgttgttcagactggtctcgaactcctgggctcaggcaaccttccctcctcagcctcccaatgggattacaggtgtgagccaccacgcctgactagggcaggtattttggctctattttttgggtgactaaactagttctgagatgtaaaggggcttgccatggtcaaata

SEQ ID NO: 712260 - DNA, 285 bp, Homo sapiens
  misc_feature (38)..(38): n is a, c, g, or t
ccagctacttggtaggctgagcaggagaatgccatgancccaggaggtggagcttgcagtgagctgagatcatgccactgcactccagcctgggtgaaagagagagactctgtctcagaaaaaaaaatgctgttagagaaatgaagaatgcttttgatgcttactggtagactgcacacagctggggaaagaatctctggcttgaggatgtgtcaatagaaacttccaaaactgaaaaaggaaagttcaataagagtgggggaaaaaaagtggaacaacacattc

SEQ ID NO: 712261 - DNA, 287 bp, Homo sapiens
ctctgcaaatggcacaccaaagcctggatgacagcacatctgtctacaggcacaatggctgaatgttttacgcccactatgagacctattgcttgggaaaaacaaggttcctttcaaaatatgactgctcatggacatgacctggtcacccaagagctctgcgggagactcgcaggagacgaactgtgtattcatggctgctcacacgacatccatcaggcagcccatgaatcaaggagtcatttcaactttcaagtcttattattatttgagttggagtttcgctc

SEQ ID NO: 712262 - DNA, 1002 bp, Homo sapiens
  misc_feature (1002)..(1002): n is a, c, g, or t
gaaaggcgtcccccacgcatccccggcttcctttgtgggagtggctgtacccacaaaggaagcgggatgggtggctttaggcggggaggtggtctaaaaaagaccccttaaggttcaaaaagggtaagatgatttatatacaaatttaggtggcaattgagtgtgaaacggggggccatttcccaagggggggatagaagggaggcagcggcgtgacatgtgaaggaaaacgggcaacaaataaggttttacctcctttgggcagcagagaatagagttttattacaacatatctttaaacaacattttggtaactacggggtcacataacgaattgtggcaacgcggataaagtttataaagggcaattttaaatatacgcttaaagaatttacaggaagaacacatttgtgcaggaccttgaagagagtcagccgtgagaggaaggccaaacgaatacaggggtttcaaaaacaatagtaaagcgggggtgcgagaatgcaaaagcgtcttacggggggaaaacaacccggtgtttttgcacacgcaacaagtgtggagacaggggacactcagagcccccgggttattaaccatagcaagagcacacgagtacatacacaagcaggggaggttaacacacagaagacgatgtaccacacgcaagggggcccgaacaaaaaaaggcggggacccccacagacagcccacacccgcccggggacagaccgccaacaacaaccgcaggcaacgaacggcatcaccagcacaccgcactcatcgccgacaccacccgaacaggaaaatgccaggcgggcaaccacacacacgcaacagtcacgggacagcagacgcaaagacgggcgcaacacgaacgagcacggacccaacactcagccacgaaccctcgcacgacaacacgccaaccacgccacccaggaacaacaacaaagtccgtcgagtccacaacacgccccaccgactcgatgacacacccacacn

SEQ ID NO: 712263 - DNA, 288 bp, Homo sapiens
tatcaacagcattagcagttaactatatcttaactcacatgatgtaggcaatgcgctgtcttaaaatcatttttgtgcctccacctatcagtagatcagggttcttaaattctgtgtgccatggtcatctgataccaatagaccccttctcatagttatgttttcaaatgcataaaacacatagaattacaaaagaaaccacttatgttgcactacagatataaacaacatgttttttaaagtggtgatgtagtcatatgtacttttaataaattaacttattgattt

SEQ ID NO: 712264 - DNA, 420 bp, Homo sapiens
ctgcattggcggcgacgtcttccctagtttccagtgtgtcttcccggtgtgttcctaccacccagagggaagcttttgcacaggatcgactctggaacccctggcctctcttttaagggtaaccatcctcatttgaaagatcagtttacaattttgaacatactaattttgggaaaagatgagacattccaggctgcttgattaccataagtcttgttctctttagctgtaagtctatgaaattactttgtagatagcttcttaatagttagataagagtacttactgagactggtaataaagtatctttaacattatcacaaataaaactagttgctacgtgctgaatttctgtatttgtttacacatatgaagtgaaaaaaaaataaaattttggctttgaataccaaaaaaaaaaaa

SEQ ID NO: 712265 - DNA, 361 bp, Homo sapiens
actcttgtttgtagaatctgcaagtagacatttggagcacttggggcctatggtagaaagggagaatatcttcccatcaaatctagagagaagcaatctgagaaacttctttatgatgtgtgcattcatctcatagagttaaacctttcttttgattgagcagttttgacacctctctttttgtagaatctgcaagtggacatttggagcgcttggaggcctatggtggaaagggaaatatcttcacataaaaattggcaccgaagaattctgagaaacttctttgtgatgtgtacattcatctcacagagttaacacttttctttttcattgagcagtttggctcagtcgacacggactg

SEQ ID NO: 712266 - DNA, 193 bp, Homo sapiens
gaacggtgatgtggttgactagtcggtggagtcgatgggggtgttggagacacagttttcggcaggtccttgagatactcctgtggggtcctggatggcatggtgtggaattgttggacttgtgcgcggtgtgctcagcgttaatcaccttgggcagcaagaagtctctgaagacgtcggatttgcggcatgt

SEQ ID NO: 712267 - DNA, 376 bp, Homo sapiens
  misc_feature (11)..(11): n is a, c, g, or t
  misc_feature (294)..(294): n is a, c, g, or t
  misc_feature (321)..(321): n is a, c, g, or t
  misc_feature (360)..(360): n is a, c, g, or t
tgaagacaggntttgctcacgtgctgcgatattgggtacgagcagaccagaggcgttaggtacgactccggggctttcagctgaaagcaaagagagtaataatttcctcaggagggcacgacttaggaggaacagttctgcaaggcaggtgcttgtgggtgggggtgttggtgtccaggaagccatgtaaagaagtaatttcaggaagcatggagtgggcagctgcgtcaaaggttggtattgaataaaatcaggaattgagaactgagctttggttctggccatgggagggtnatgagtggcttcgtcagatggagagtnggggaaggcctggctggtactaggcaggcgagagccctnggcagcagacactgcg

SEQ ID NO: 712268 - DNA, 296 bp, Homo sapiens
gggagacatgattaaatcgagctcggtactgaggaaaacgtacgagaggaggtaagattggagactggagtcgggaagagtagcttgctggagtggaaaaaaaaagcaactcagtggtatatgagagagggcagtagaagatagaaagtggggactggtgtgagtagacagagatagtacgagtccgtgggagcatagacaagtaaaggtgcgaggtggatcagggagtaggtgatgggtctgttctggatagcagggatggcctccgaggcggggactgcaggtgccggataggc

SEQ ID NO: 712269 - DNA, 392 bp, Homo sapiens
cagattcaataattattcttttctacatactgtgtttaaatgatatccctttttctttttgttcttatagctcgagctgtaaaagccaaaggtccggtgatgatcccatacccttttttccagtctcatgttgaagatttttatgtagaaggccttcccaaaggaatttttttttttttttttttttttttgagatggagttttcactcttatcgcccaggctggggtgcaatggcacaaccttgctggtcactgcaacctctgcctcctgggttcaagaaattctcccacctcagcctcttgagtagctaggactacaggtgtgcaccaccacgcttggctaatttttttattttttttattttttggtggagacagggtttcacctagtt

SEQ ID NO: 712270 - DNA, 171 bp, Homo sapiens
gaacgactgggctttcattatataaccaggccaagaagcctgtgctagttccagtattgatccggttctcctccgtcaccatccgaccacagaacctacaggctgatagattgttcactaactcatagagtctctggcaatgtctctcagaaactgggaaattgccgtctc

SEQ ID NO: 712271 - DNA, 153 bp, Homo sapiens
atgatagtaacatgagaggatcagcgggctgggtaggacttggactgataggcactgacgtgcggacctgcagcctggccacaccatcacgggctctgagtcatctcctaccctctcccttgtagtcgcagcccaggagaagtgcgctgggtg

SEQ ID NO: 712272 - DNA, 198 bp, Homo sapiens
  misc_feature (73)..(73): n is a, c, g, or t
acgatcccctgattcgtgccctgatcttcggcccatagatgcttggccactgccatccatcacccgcgtgggnctggacgtgctctcttgctgaggcactgtacacattgagtgaggtcttaacattcccactacttgccttcctcctcagaatttaacagtccacttgatctattcattattctgaggtcacttttt

SEQ ID NO: 712273 - DNA, 966 bp, Homo sapiens
cactatgaggctaggtgcgagcctgggtgttaatcggcagaggggatcgctggtctgttatggcggaatcatctgaatccttcacatggcatcagcccggcccatgtcggcgaggcaagtgatcctctcacctccagccctggacgaagactcccggcgtactgatgccctcacctccagaccctgggcgtgaccttccaccatttgaggatgagtccgaggggctcctaggcacagaggggcccctggaaggaagaagaggatggagaggagctcatggagatggcatggaaagggactaccgcgccatcccagagctggacgcctatgaggccgagggactggctctggactgagtgaggaccgtaaggagctgacggccagctcagagggaggcacgcggacgcgggccatgcggcagcgtgagcgggaggctgggcggggcctgggccgatgcgccgggggctcctgtatgacagggatgaccgaggacgaggagcgccctgaccgcaagcgccgccaggtggagcgggccacggaggacgggcgaggcaggcacgcaggagatgatcgcagacgcatcgaagaacctggaccgatctccaacagggcaccgctgagccgccagtggggtgagcatggcgggccccggctgcgacatccaccaccggttccaagaatctcctgcgccctcacgtccacaggcccggcccacaaacgctctctcaaggcaccgcactcaaccgcacgctgtgcaacagacacccgggcagagcccgctgccagaacactcccgacacgcgcccccagcgacccacccagccccgccaaccatcttccctgcaagcccgccgaacccgcgccgaccccagaccacgcgcccgcaacgggcctcgccacgtcccaaccacccccacacaacaacacaccgaatccaccgcccttccaccaccccccaccatgacc

SEQ ID NO: 712274 - DNA, 161 bp, Homo sapiens
ggtctctcacaaggctcctgtcgtgaattcacattcagattattcatccaattgcaaggtcgataattaagcggaacaattaagaaaataatattatgataagtatgtgaagatataatactcaagacagccatatgaacaacattcattgtcgaaaaaaa

SEQ ID NO: 712275 - DNA, 113 bp, Homo sapiens
gacgctctctctgatggggagaagaggctgaggagtggggcacagcgaagggaagaggcatgtgcaaaggaggagtcgcccaggcagggtgcaatgtctcacgccttgtaatc

SEQ ID NO: 712276 - DNA, 365 bp, Homo sapiens
accgatacaagaatatttagagaaactttattatgtgtaatacctttaacctggaaatgacccttgttaattaattaacaggagagcagatggataaattgcgtgtattacaattgaattctccttagaaagggaggaggccttacacaacaacgtggatgaatcccaaaaacctgacacttaaaactttccaaaatttggccctaacattcattagttccatagtcacttttttcccgctaatgacaccatgggttattttatttttagaagaatggcaattatttttgatcagaagcattaaagttctgacctattttccgttcttctatgtcaaaagggaattggtatgttttctaaatatt

SEQ ID NO: 712277 - DNA, 83 bp, Homo sapiens
gtcaagagtggttttttggtttgcttttttggcttttcaagacagaagaaattagagcagtttgtgcgctgctggaatgctga

SEQ ID NO: 712278 - DNA, 730 bp, Homo sapiens
  misc_feature (43)..(43): n is a, c, g, or t
atgtcgagatcagagagcacattttggagaattcttctagatnttcagaacttgagactatttgtcaaagtctattttttttcgatgtccaagtatgttagactctagacacccgttgtttatcctgggtttacttagataacttttgtaccgtggttatattgcttataatgttaatggaccatactattgaaactggtgagttctgattattggaatattctctgtaaatccagtaaaccatgtataaagtatttgtgaatagtttggtcaataatattatttatgaagacccgcccaagactgatttcccatgatggggcgaacaccaattagccccaaggttaatttctgtaccaccgtggttgtccagaatactgatttactataatgatatatacatgccagatatttacttatatcttagacacagagttctgggtaccattttgggatctagttcccctggaaaaggactgctgtatttttaatttttaatggaatgtagcttttaaaatcctgtcactggcatccaccaaagggattataccctgagaccctatagctgtactttaaagcccttcagttcagctattgggagttcatgatgaattagcatatgcccgaaaggttgctaaccttaacattttgagagccgtaaccctgattttatctgctgtataagactttgtgccttttactttggaataaagatttttttccccgctga

SEQ ID NO: 712279 - DNA, 277 bp, Homo sapiens
atctggggccaaagatcagaactcactttatcttgtactcagagaacaaagagcagaaaaatgtctcccatcccattttcagcggagagtattaaagcacaacctaatttaggatctggcacccttgttggcaaggcagacacagctgaggttgggctaaatcttagcttccactgccatagctttagtatcaagtttaggataggcagctgctccaactactgggcagcagcgagggcaacagacaggggcatcctctcagcagtcgcaccgtgcc

SEQ ID NO: 712280 - DNA, 703 bp, Homo sapiens
cctttgtctgtgctggaatagggttaagaatgactgtataaagagaagccaactcagtgttcaaatacagactagttccaaattcatttgacttattccaaaggtgtatttagaggccagaaatggatagtacaagtgattcaggaaagaagcacagctagcatggagcttatgggacatctcagactaacatacattttgtggttgaggagacaaagaagttaagtgacttgtcaaaggtccaccaacaagttagcagaagagttgagtttagaaatcagtaactaccaacatttagtgggtaaaatcagtacttgtactgaaaactaacattttcagaaaaggttggcatggagaaacagagaccttccctcgaaaccctagtaaattatccataaaaccctctgaaaagaaaatttctcagtgatactcatgagtgttaaaaattgagcatatcccagattctggtagaagtttctataatcacctatattaatgagtggaattaagaaatattcactcatctttcctctcttgtcccatcaaatataataggtataattcaaaagtacaacattataaagtgaaacagattagatattcacagtagtttccacaattcacaattcactgtataaaatcccagggttacttacaaataagtcataagagacatttactttgaatgaaatttctaataaaa

SEQ ID NO: 712281 - DNA, 678 bp, Homo sapiens
ctaaaaattgaagccacctggcatcaaaaggcttcggcatttaagctttccataagctagttaccaattcctcctgaaaaggcctgtgccccttattgctctacccagtagggtcagcctttgtcggtctaagttggttccacatgataatgtggattgcatttctgaaattgtaagtaagattaagcatatctttctggcctctaatctgcatgtatttcaggtaagagcctaatgatgtcaattttccgtatcaggctaatgaactctctgctactgatcagttaattcctatatattaagacaatgatgcatttcactgtcacgtgttatcagtggtttctgcataccattggcagtttgacttctgccatctagagtgtgtaaattaagtggtcaaatctgatctagcttccttgagaggtgcctcacgtcaatagttatcagactgataacttatttgcccattttttcaaatcaatcatggtttcatttcgaatgtcgtagtgtctgctcagtctggattccctttctgtcttcctgcagaaccatatgtgacttcctacaactccagtgccgttaactcaacctcctggtcccctcagatcttcagtacgtgcatccgagtagaccataagccttcatcctgagtcagacctttttcatccatcattcaag

SEQ ID NO: 712282 - DNA, 409 bp, Homo sapiens
  misc_feature (21)..(21): n is a, c, g, or t
  misc_feature (64)..(64): n is a, c, g, or t
  misc_feature (68)..(69): n is a, c, g, or t
  misc_feature (100)..(100): n is a, c, g, or t
  misc_feature (157)..(159): n is a, c, g, or t
  misc_feature (386)..(386): n is a, c, g, or t
tccaaccctctgccagtttgnccctcagagcttggtggctcaagactgttagcctggcagagcngcgnngaagggagaagctcttggagcaggcaggatnccaccgctgcttcagtgcctccacgctcagctaccctttggcccattggccctcgtnnncctctccaggattgtatgtttcaagcttgtcctgtgttcctttgtctgatgctctgtgtattgctctttgaatcgagtttggaggaagagttgagttgtatgagtggcggcatgttggtaagtgccgtacttcctgtttcaaagttttctgggggctcgctaattgaatgtggaaaagtagcaccacttgacggctacaagtgccgactcctgaattttcccatggngttctgacttcaagggcttgcaa

SEQ ID NO: 712283 - DNA, 383 bp, Homo sapiens
cacattattctgtggacaatatattgggaagttcaagctatcaggacagacagctctttagtcccccagcattactactaagcatagcgggctctattcttgcactcgttccgttactcgaggccactgcctatgtggaaggctccaaatccatgacagtcaaagtctctgactccttcaggaaccgtacatcttcctggccttaatccattatagcaggcgtgatgtggtaaatgtatgccaggaagactggcagacagttgcttacatactccctcaaagtatttaccatcagctacagtccaaaatcgcttatagtacaaggagatttatgaaaagactctgacaaggactcttgaatacgagttcctgatagataagag

SEQ ID NO: 712284 - DNA, 123 bp, Homo sapiens
gttttacgtgagactacatgggcagggggaaaatgacaccaatcattggattacagaaaagggttttataaatcctcctcttgaaattatgttcaggcccagcagggtgcacattcttccaag

SEQ ID NO: 712285 - DNA, 162 bp, Homo sapiens
  misc_feature (42)..(42): n is a, c, g, or t
aaactaaaggatgcgtaaggatgggtgggggaggatttctangatgatggccccctccgatagttcagacggtctctatttcctgagcgtctgagatgttactattagttagttttgttgtgagagaaatttggccagatggggaaggtcactggaaattga

SEQ ID NO: 712286 - DNA, 2311 bp, Homo sapiens
  misc_feature (1266)..(1266): n is a, c, g, or t
  misc_feature (1270)..(1270): n is a, c, g, or t
  misc_feature (1282)..(1282): n is a, c, g, or t
  misc_feature (1296)..(1296): n is a, c, g, or t
  misc_feature (1312)..(1312): n is a, c, g, or t
  misc_feature (1320)..(1320): n is a, c, g, or t
  misc_feature (1328)..(1328): n is a, c, g, or t
  misc_feature (1338)..(1339): n is a, c, g, or t
  misc_feature (1360)..(1360): n is a, c, g, or t
  misc_feature (1366)..(1366): n is a, c, g, or t
  misc_feature (1370)..(1370): n is a, c, g, or t
  misc_feature (1374)..(1374): n is a, c, g, or t
  misc_feature (1379)..(1379): n is a, c, g, or t
  misc_feature (1385)..(1385): n is a, c, g, or t
  misc_feature (1388)..(1388): n is a, c, g, or t
  misc_feature (1390)..(1390): n is a, c, g, or t
  misc_feature (1405)..(1405): n is a, c, g, or t
  misc_feature (1416)..(1416): n is a, c, g, or t
  misc_feature (1427)..(1427): n is a, c, g, or t
  misc_feature (1454)..(1454): n is a, c, g, or t
  misc_feature (1457)..(1457): n is a, c, g, or t
  misc_feature (1467)..(1467): n is a, c, g, or t
  misc_feature (1473)..(1473): n is a, c, g, or t
  misc_feature (1483)..(1484): n is a, c, g, or t
  misc_feature (1490)..(1490): n is a, c, g, or t
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggccccagnccgngggcgcggcccnagggagagcgggangaagaacgaggacgcnacccaggncacccgcnagaagcgccnnttttttttttttttttttttntttttnaccntccntttangaaagnccngnctcaaaacagatgtnggcgtggtatngactcaatatnctgtacaatgaccccggtgcggcgggnagngcgcgcaggnacctgntgcggggccnngggcgnctagggagtgtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 712287 - DNA, 2237 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 712288 - DNA, 1764 bp, Homo sapiens
gccggctccgcggcggaggggcggcgccccgacccaggcccagcaccgtgggcaccgccaggccggcgcgtatggaggcggtgggacgcctgcggcgcgggtgagcctggcagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 712289 - DNA, 183 bp, Homo sapiens
aaaaggaaggaactttgaacctatgtaccgagcaatgccaggtttagcaaacataatgctagtcctagattacttattgatttaaaacaaaaaacacaaaaaatagttaaattttaaaaccaattattgttttatagaccctggaaaagattttcagcaaagtacaaaatttaagcattcctt

SEQ ID NO: 712290 - DNA, 1780 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtgcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 712291 - DNA, 997 bp, Homo sapiens
  misc_feature (388)..(388): n is a, c, g, or t
agcgggactctcatgaagagatggagtgttcgtggatatcaaacagggcaagcattaactacatggactgaactaacagaagactgaagtaattttttttttttacttttggtttaaaatgttgctgatgctttgttttatttttcagagtcaagaaaacttcttttgagctgttgtgagcttttctttgagctgtttaacaattgagtaaactatatcactgtgaataaaatttggagcatatttgtttctgatttctccagaattgggaacctatttatgaatattcttaacttacagcaatatagttatttggcataagtgcaatacgaatgtttccttttgcaacaggacacaactggagaaactggttattttaccaaggctnttggctggaatagtgtgctttcctttaaggaatcaaacttgacttataaagccaataaaggcccttgggaaaacttgcctcataccttgtttatgcagtccctgtacagggttccttacctgtggtaaataaagaatgtcactttctgacaggcccaggagccccaagttatcttgggacctcaagaggaaaggaatttacccaattcatattttaaaaagtcttatctgagtttccttatgaaacagagttccatcaaagccaattttaaaaagcccatgtgaaaaataattattcttgctgtactttatacagattatccagaccagttttaaaaagcaatccagtcttatcatgatttgcctttagttaaaactggcggactgggcagagcaaacacacttttgttttaacaacctattgttcacctgttattaacgggtgtcgagggttgtctctcacgtggcctgaagggttattctgcatttagattacctgcttttccctgtgacccccgtgtctctggtgtggtcgaaaccagcagctgtctgttgaactcgtcctttaattcggccattgaatactggttcccagtgccccatgagcttt

SEQ ID NO: 712292 - DNA, 1408 bp, Homo sapiens
gcggccgcgcctgtgcgcgagggcgcgcgcgtccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 712293 - DNA, 1631 bp, Homo sapiens
gtggggacagtgtgagcacacagtccgggtccccgctgtaaggacccggtggcggggacaggttgagcacacagtccaggtccccgctgtaaggacccggtggcggggacagggtaagcgcacagcccacgtccccgctgtaaggaccaggtggcggggacagggtgagcgcatagcccaggtccccgctgtaaggaccaggtggtggggatggtggggacagggtgagcatgcagcccaggtccctgctgtaagggaaggtcgcgcagctgggctggaattctgggctcagcccctcccttactcacaggccccccttcctggatggtggaggtgcccaggcaccacccttgttgtctgctcatggccttggggtgggtcctaccgagctggggaagcctgggggccgtagggagcccagagtcagcctggaggaggtggcgctttggtgagtttggaaggcaagcaggggtgagctgcagggggccaggaaagggtgactgtgactctgggagcagccgtgccaaggccctgggacaggaggggcttggccagcctcaaggccttactccagcccactgcactctcagattccagctccctggggcaggtgagatggccgagccaggtccttggatgatctctgttcctgttcccctcttcccaggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 712294 - DNA, 919 bp, Homo sapiens
gctgtctccgtgtcccgtcagacagctcggagctccattaagctagctcggtcacttgaccgtccctctgggcccttcccgccgtctatcgcctggactaccccggcgcccactcgtagctcgctcttgattcgcctccgcctctttttgttccgtcgcctagagccccgccgcctctcagggctgatgagtgtggacggcgtggagtctccgtcgcctcccgcgtgcatgggcattgacgtgaccgcagcgtttgaatgacatgccattatctggctgatgggggtaccgacaaggtgagccctgggccagagaatgatccaggcgtagaggtcgttccgtgggaagtcgacgacatgacaactgacaggcctaagggaagctaggaagtccccgtcaccgactcaggccagagatgatggtgatggactgacagactccagtgaatttggagcttgcctgtcaggctgattggctgatagacagccctggatttggctcactaagactgaccagcccgggaccaagcagttctggggtcccaacctgggtggaaggtctgaactgatgacccacccaggctgaccaggccagcccaactcactgacctcctgaaccctgacctcatcactgtgcagcatggagaaagatgtcccgtgtgaccacaagcctgggtggcagcgtgctgacaggccgcaccatgcactgacacctggatgctcccgcgcaatgccatcagttgtgtgccgcgaacgcagccagggtggtcgttggcagggccgtagcatcttcaagaatctatgcccatcgaaggacggaacagttcgtgggaaaaagctgaacctgcgtgtgggggcgcaaagccttccgcttaacctgagctgtgctgaacgtggttgggcaccagatggactcacca

SEQ ID NO: 712295 - DNA, 411 bp, Homo sapiens
gagtctacttctaagtatgtacaattgcccttagctttttgtttcctaacttgtctatttttcttctgcttcctacatttcaagtgcaaatttatctttttacttctaaaactatgtatttatctatctaatttccctatctacactatatcatatctacgccttcccgtacttcgtgtcttccagtaatccacttcaaacatctatctagaaactcttgacaatattttcatttactatcttatttctatcttccatttatcttctaagttagtacattttgcccttagctttttgtttcctagcatgtctttttttcttctgcttcctacttttcaagttaaaatttatctttttaaaagatcgcctatcaattatttaaatcacctaccacttttaaactaaactttg

SEQ ID NO: 712296 - DNA, 332 bp, Homo sapiens
gtgtgtcccgcgccaagtaaggtttggtcaagaaaagggtgtaaggcacctaagtcatagtccgcctagaaagcatttgcggtgaacaatggagggcccgaactcgtcatacccctgcttgctgatccacatctgctgaaaggtggacagcgagcccaggattggacccgccgattccacacggagtatactgcgctcaggaggagcaatgatcttgatctccattgtgctgggtgccagggcagtgatctcctttggcattcctgtcgcaatgccgggttacattgtgttgccgccagacagcactgtggggaatcctctaaagtcaacct

SEQ ID NO: 712297 - DNA, 362 bp, Homo sapiens
ctgtggcagcaccgtcgtgatacccagtgaaactctggcaggcacagctctgcggtcgatccagaaggacacccagcactactctgatgtgcaaaccctagagctgcctcgtggccaccccgggaggagaaggagggagtgtgcagggctggaagggctgacagcgctttagacaccgtaactccacacttgtggttttcatgcttggagcttctgtaggaagatggaggttggccaaagtttcagcgactaaaagtgtgaaattcatttaagcccatcaaactcaaacttgtgcagggaccaggcagacacccatgatgaaggcagctggccaggcataaaggacacaatccgcagagcca

SEQ ID NO: 712298 - DNA, 1044 bp, Homo sapiens
ggctccagtcctgtcgtgcgcgcaggcccttattgagagcgggatgaagtacgaggacgccatccagttcatccgccagagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtgaaaaacacacaaacaaacaaagacaacccacacaacacaaaaacaccacgagaaacaaaggcgcgggcggcaacagacaaaacccggggagacaacaaaggagacgaccgatctagaacaggagggcaccagagcgaggcacaaaagcaagcgagccgggacaaacgagcgcggggaagaagcagcacagatcctgcgggcgagcacaccacgccggggcagccgagacccaccgcataacacggcgaacagaactgtggaaaacacacgcagggggacgtctaaaacacagcacgaagcacacacacgccagccaccgccagcagcactagcacgcgagcaggcgacccgagacgcacgaccagcgcca

SEQ ID NO: 712299 - DNA, 648 bp, Homo sapiens
ccggtccacccccttgacccaaccctatgtggcagccctctaaggggcgtgttaagaagtaatatctgggagcgacatgagggcgcaatagcagaacatcatcccattctagcaagaatccagtcaggaacagccaccttgctatagcactaagtaagcgcagatgcctcttctaaacaagcaagttcactcttgttcaaacagtgagtctttgagagtatcaactctcaccacgaaaggccgaactacatatgcatgctaatgacctcttcttatgaaatattcaggcaagatgcagaggattccacagtgaacagcagtgagaggcgctgagacgcacgctgtcataacttttaccatataaactttatctatatattagagtcacgaactctcattagtacctgtaccactcagatatagcagataattcgtgtatgagactaaccccatgcctttgtttcgttattaaaaatttcgtcagcagccctttaataatggtggtgtgtagttcattcttgtcgccatgcaagagcagcattagcatggcactcaacagctgccgtccaagcctgggtgctcgtggtggtcctgcatctcaccacccacccgcaggtctggctgttcagtaaggttgccctgggaaga

SEQ ID NO: 712300 - DNA, 183 bp, Homo sapiens
gcccagctgattttactgaccttctcagtggaaaggtaggtctcattatcgtgtatcttctgggtgaaaacaatcgtaaacacagcggtgggagacggcgtacttgtttcatatcatgtttgtagctcgccctgtcctgggctttgttcccccggatccatgtaaggtccgcaatgtcttgtg

SEQ ID NO: 712301 - DNA, 1238 bp, Homo sapiens
tgttcagattaagaacgaggatcagaactcaacatgatcagacgcaaaagtaagtcagcgcccgactaggccagaaagagattagccaatcgatgcgaagtgcaagtttcaacacagatccctacgtccggtgcatttggaatcatggtccaagatgagatgacagacgtgactgggcgggtgctgcagaccgacctccatcctctacgggggcaggaataaagctattgcgacaccctgtccagggacgtctgggacatgcggaacaagcagttccacacgggacatcgagatcaaaggtgtgggccattgcagtgcttacgacccaccagacagccagatgcacggaagtccatactgaagtccttacacagagcagctacagaaagatctcgagagacgctaggcatgcccataccagggtcacagacagtgactttctagcaaaatacagcgacagggagtgctggaccacgtaggaagccccaagatacccggacaacctgaaagaacaacgtaatgcagagcctgacaaacttcggtagagtggtcaatccctagcaccagggaaaggacaaccccgatgtacagcacgaaggtcacagccgcagtggagaaaaacaacggattgcatatggggattgggccaacacaaggtgcgttgcagaatagaaaagaaccggatacaagaagggaaccaccagacccaaaagaacaccctgggacaaaacagcgatgacactgaaagaatacaaacagcacaaacaaaggaaagggacgatgaaaaaaaaaatacaagaaaggaacaccaaagacaacggccagaccgaaaggaaccagaaagaacaagacaaaactaaaaagaaaaccaaaacaacaaaaaaaacccaacaacagaacagagaaaaagcgaaagaaagacaaacaaaagcaggcagacgaaaaagaaaacaaaaaaaaaacaacaccaaacagaaacagacacaaaccaaaacaaaaaaaagaacacaaaaaaaaacacaaaaacaagaacaagaaaagaacaaaagacaccaaacaccgaaaaatcaagaacgggacaacacagaaaaccaaaagaaaataaccaaacagaaaaaaataagaaaagacaaaatacgcacaaaagagacgacaaaggacgatgaaaacgaaaaacacacggaaaaagaatacaacaaacacacataaaaagaaaaacgggaaagagaaaaagagag

SEQ ID NO: 712302 - DNA, 259 bp, Homo sapiens
gtccagaacgcaagctctcaccgaggaagatgcacagatagccattatgcagcagcacattgaccgcctagcccttgctgaatgagaagcagtgcggccagcccactggagcccaaggtagcttgaggagctgcgtgacaagaatgagagccttaccatgcggctgctttaaacccttaagcagtgccaggacctgtaagacagagaagagccagattgatcgcaaaatcaaccagctttcggacgaggtcagcgttgt

SEQ ID NO: 712303 - DNA, 518 bp, Homo sapiens
  misc_feature (4)..(4): n is a, c, g, or t
  misc_feature (16)..(16): n is a, c, g, or t
  misc_feature (79)..(79): n is a, c, g, or t
  misc_feature (316)..(316): n is a, c, g, or t
tttnaaaaaaattgtncccccaatatggcctgaaaaatccaacaagcctacctgaagttggatccttccatcctgtttncaaaataaaaggaagaagaataaattccttgtcccttcaattccccattccttccttcccaccgtggaaccgtaagcctgaaatgaatacccttgccgtgcctctggcccaatgaaagaagttttacctctttcctgaatttcccttttgggctggttaatggtggctcatgcctgtaatccccagcattttgggaggccgaggtgggagtattgcttgaggcccaggagtttgagncccaggctgggaaacataacgagaccctgtctctacaagaaattagccatgtgtagtggtgcacacttgtgtttctagttacttaggaagctggggcaggaggatcatctgggcccaggcgttcgaggctgcagtgagctatgatagagccactgcactctaacctgagtgacagagagagagagagactctgcctctaaaa

SEQ ID NO: 712304 - DNA, 472 bp, Homo sapiens
gtagctgttctagaggatccgcgctgtatcgagtagtaagtgattggcatgcggggctgatttaggcagatgtacgagaggaacggacaaggtagttggggtaaagcacacagcaaggccacagctcactgagacgcaaggtcggtctcgtaccccttcaatcgtgatcctctgtctggaggattttcatgatggctttactccaagaagctccccagggcctttgtaaatatggggatatttctgacactgacaatccttacagtctcttatacattgacaatgatcaggaaccgcccggcatgaatatgagaaggtggctggccgacataggacacacagaagaaaccatcaaccacacaacacacacaggaggaatcctgatgcaggaggacaatagaacagcaggggaccccaagactgaactttgcatctcatgtattgagatcattccccaatatggtttggctgt

SEQ ID NO: 712305 - DNA, 206 bp, Homo sapiens
ggactggaccgatccttcactctttacgtgcacctcaacgccgatgagctggaagccctgtcagatgtgctcaggttacgtttgctggatttgttcacttggtaggttagctcccgaccagacctctatcatgtgtttgtgaatctggtcagacagtgcacgattaccattgctccccttgcaatagaggtcatggctattggcaa

SEQ ID NO: 712306 - DNA, 516 bp, Homo sapiens
atggggcgcgttacgcaccaaaaccgtgaagaaggcggccgggtcatcatagacaagtactacacgcgccggtggtcaacgagcttccactcgaacctatcgcgtgtgcgaggagatcgccattatccccagcaagaagctccagcaaccaagatagcgagtgttatgtcacgcagtctgtatgaagtcgatagttcagagcaggcccaggttaacgaggttatcctccatcgaagcctgcgaggcaggcacggagaggagagataggagagtcgaattaatgttccctgaaggttctcaagcccttggtctcaggcagattcatcgcacagtagatcctggacagctaagggaaatgctgaaagctttcggacttacggctagtgctgtccacatcttgcaggtcgactctacccgtacagttgggcatagaattctcaagaacggcctcggggagctgcttagaatttgtctctgtacgtagctgtagtaatgtttcgactaagatctggggac

SEQ ID NO: 712307 - DNA, 230 bp, Homo sapiens
tacagactgtcactggaagcttgaaccccgcagggatttcattaaatgttactgctccaatataatcttgttttgactccgtctcccacatccaggtgactcgtgatgtacagggcgagctaccaaggctgagggcagttctacccatttggctacgcagggttcggcccctgtggctactctcatagcgctgttaagtgcctgcagcattttccagagtgtacggatac

SEQ ID NO: 712308 - DNA, 291 bp, Homo sapiens
tgcaaatagcacacgcctctatccaaaccagcaaagggcagttctgcctaagaaaagacacgttggcagccatggctgacactgatgctgacacacacacacacacacacacacacacacacacacacacacacaggccacccttattctcccagggtctcagtgatccagagacccgtatgagagacccactgatgccccagggactcccccaaagtctgtacaaccaagctattctccattcttccggctgagacacagtatccaggggtgctctctccttcccccatc

SEQ ID NO: 712309 - DNA, 177 bp, Homo sapiens
acgcttcgaggcaccccaaattagctgcccattcgtcaggacacccacaccacccagtgtatatatatctgcctcgccggcagtggtgtaccctgggggcacattgctgacacagcccctatgcgtccccaggatttgcatgctctcacccgtgggccaagtcaaccatacctagga

SEQ ID NO: 712310 - DNA, 368 bp, Homo sapiens
cacagtggctcacgcctgtaaccttagcactttgaaaggctgaggtaagcggatcacctgaggtcaggagttcaagaccagcctggctaacatggtgaaaccctgtcttttcaaaaatacaaaaattggccaggcatgatggcgggtgcctgtaataccagctactctggaggctgaggtaggagaatcgcttgaacctgggaagtggaggttgtagtgagtcgagatcacaccactgcacttcagtttgggcgacaagagcaagactctttctcgaaagtgattttgtttacttgcatgcataacaggtaaagaagcttcttaataaagtagtgctccgtgaatcttgcttttaccggttcagaccc

SEQ ID NO: 712311 - DNA, 167 bp, Homo sapiens
gatgaacctccttgaaagcgctggtttttctcgagcaatccttattatattgttaacaaggaaagatcaaccagatggcacagcaccagattctcagagattaagctattatgagaagtagctggtactagagtgtattacgaccgaaggaggaaagcatctcctta

SEQ ID NO: 712312 - DNA, 251 bp, Homo sapiens
cctgacatgcctgcttagccgactcttagagtatccccgccgtacgtgaacgtacggcagagcccggttaatcgcctaaaacttataactcttatagtcggagcttcaattcctcttcttaacaacatacccgtgccaacctcctactcctcattgtaccctatgacccaagacgccacacaaagggccacccttaagagccgcccaatgagccacgccattagccccgcgaagggccccacgaacagcct

SEQ ID NO: 712313 - DNA, 153 bp, Homo sapiens
tatgttgaatacgagtggtgaaaaagggcatcctggtttcatgccagttttcaaggggaatgcttccagcttttgcccattcagtatgatgttgccctgtaaattgtggtagtgggaccaggaataaaaaattaaggaatttttaacttttca

SEQ ID NO: 712314 - DNA, 833 bp, Homo sapiens
  misc_feature (833)..(833): n is a, c, g, or t
ccagcccggtaagatttttctttcggccacaaaccccacggaaagggtttgattctttttcagggaaaatgacactgcccgaaagacctgttttaacccggcccttaaaaaactttgtccacaaacccacaacgaaataaaggagtctgactgaaagttctccggggaaagataccaatagccactggtgttgtggaaggtccttggtgccaagaaagtatccccacaagggttaaaggaggtctcccctccacaacattaaaagacaggaaccaatttgttctgcttttaataagaaaattttgctaacttctggccccttggttactccaggtcgtcatgtacaatttccaaaagagagggtcacatagaagcacagccaagtcattatcactcctgtttgagaccagggtcaccccttgcatgcagtataacaactatcccaactctgatgctttgcaggtgccgggcttaatcgtttgagacatccagtgcgcttataacaattttcgacaagtgtaatttatccatgggggcattcaaaaacagatgaccttctgggatacaaattgcgggggatggacggtttaaattggggcgaggataggccttcatcaccagtggtcaggttgtcccaaacagttcctgcgtttatagagccacagttctatgtcccaatgagtcacgcatttaatggcacaaagaggccattgccccttccctccttttgagggaatatgtagtaaatcacaaccaggaaaaagtaactctagctgtgcactgtctcaaaaacaaagcttgccaccatcaagtatgaaactttatagccgtcn

SEQ ID NO: 712315 - DNA, 352 bp, Homo sapiens
gagttcgcccaccacctcacgttcatgctcaaccggatacgttttcgcgtcacgatcgacgaggagtcggtgcgcagcattcgctatcagtacccggtggcccatcggatggccgagatcagccgcgacgtcatcgaggaacgcaccggtatgcggatcagtgactccgaaaccggactactgacgggctatcaccaagtattcctcgactcccaccgtgcctgcccctacctcaggctggcgatcgtcacagcgaccggacggtctcagcccacctcatgcggatacagctcgacaaagtgctcccccacggcaccaagtacctcatgctgaccggcgacgaggcagacgc

SEQ ID NO: 712316 - DNA, 1389 bp, Homo sapiens
taaggcttttttagtatttttaaaaacatttaattggggaaactttgattcttgaaagagaaaacaaaagctattgtgatataaatctttgaatgtgtgttcacctcatgtttggggcaccaaatctggtcttggtatctttggtaaaacaccggttttggttattgtcaaggaggagttataaggccttttccgaccacctttgtgtgtttcccctttttctgtgcgcagccatgtgttttcacgtgtggagttgtgcctcctttaccaaaccttcaggtgtgccccttggagcccttattttccgtgaatttcttcgtgggctgtggattctccccgtgttcttccaccaggcagctctccagttattctccaaactttctctagttccgtgcgtgattccttcccagaaagcgggggtgtggaacacgtggaggggcaggtgttcgtggtcgtggtttctcataagaaaacctttagtagaaatttcatattatattctttttaccccatttttttgagcaacaaattttttttctccaaaatattttgtttacaatcaaaactcctttttataataaccgatgtgacacagggaaaactctcttagtggactccgaaatataacggcgaaacgcgggtgggtaaatagcgcattgggagttgggattacacggaggggattaaaagggggggttcaccataatgaagatgaaacacatatagtgtattttttataaccccttataggcttgttataaaaggtattaacagattttctacagaatttgttttggcgggggagaaaacaatatccccttttcttaagaagtgggcgcccccttgagtgaatatagagccatttagtgaggagaagaggagggccctgtgaacgagggagcaacactacacaagggggaattataatggacttatatgttatttattggggagatatatgggacacacaaatatttttcgccccccagagatattaggagcctaaggatgagatatatgattaggagagtactccaccccgtaaataggggagaaaagtaactactgatgaaacgaagagggggaaacatcggaagaagagacaccagagctagaggggggaaaacgaaaaagccaccccacaaagagtggggaaacacccccgcgggaaaaaaacaaaagaagggtgcgcaacaaaccaaaacagaagacacaacaacaaggaagaaagaaaaggagaggacgagtaactaacaagagcgcaaccaagacagcaaccgacggaagagagccgaagagaataatgtaaaaagaagaggggacagcgacagaagaaggtgatacagccaccagaggtgagaaacaccagcacatctactggagcaagta

SEQ ID NO: 712317 - DNA, 676 bp, Homo sapiens
caactctgcctcttcccccgctgactggggtatcagtttatggtgccctgcaggaagaccctcttgtccctcctctgcagagatgtgggcagctgtgtcaggatggccattcgtggctcagcacagctagactgcagcccagcactcgagactgggtgaagcagacactggggctggacaggccaggtaagagcctgtcggcacagtgatcctgagatgtgggagttgctgcagacgggagaaggccaggcagtgtctgtggcctggagctcagttgcctcgagtagaacgttctgcgatgccgacgctgcggctggatggccctgtgggtcctgtctgatacaagcaagtactcggagggttatcctggcaagagatactatgggggagcagaggtggtggatgaaattgagctgctgtgccagcgccgggccttggaagcctttgacctggatcctgcacagtggggtagtcgaatgtccagccctagctccgggtcccctagtcaacctggctcgtctacacagcccttctgctgacctcacgagcggatcatggggctggacctgcccgatgggggccatctcacccacggctacatgtctgacgtcagcggatatcagacacgtccatcttcttcgagtctatgccctataagctcgacggcttagctgtt

SEQ ID NO: 712318 - DNA, 724 bp, Homo sapiens
tggtctcttggtggtcccttgaagggctttgatgatcaggccagaggcaaaaggccccacctcaatctgggcctgtctgtcctgaatgtgtcagtttcactgtaatcctcaggcccttccagtcacccgttgccttggcaatgtcatcaccaatctttttttggtgagacagacccagggtggccgatctggggggccaggcagaagtgtgcccgatcttcacctccggtgcacctcagtgttatacgatctttgatctcgtgtgggtgtcgaacttcggcggcatggtgaaggcggctggtgtcggatgaccccggatctcggaacgaccgaaggaagttgcacctgtggcctccgatatcctgagacaggcttgggcagtgggataccagacagcttctcacaacaggatccccaaagaaattacggtgagtaatattccccaggccatttgcacacatccctttcctgggactccctcaaaaacaacccctggggatcttttgactcgggcccgtgagcggagtgagcgtcgccctggaaaacgcaggctttgaaggccacgcgaagctgtaactgaggccctgcctgcttgggaacggcggtggtcccgctgtgactccggctgtctgggtcaccccttctgccgttcctgtccccgttccagcgctggcccaataacccagaagagatgtccagatagaagggcaaaccaatttgcaac

SEQ ID NO: 712319 - DNA, 702 bp, Homo sapiens
  misc_feature (30)..(30): n is a, c, g, or t
  misc_feature (106)..(106): n is a, c, g, or t
  misc_feature (155)..(155): n is a, c, g, or t
  misc_feature (179)..(179): n is a, c, g, or t
  misc_feature (187)..(187): n is a, c, g, or t
  misc_feature (197)..(197): n is a, c, g, or t
  misc_feature (216)..(216): n is a, c, g, or t
  misc_feature (234)..(234): n is a, c, g, or t
  misc_feature (244)..(244): n is a, c, g, or t
  misc_feature (377)..(377): n is a, c, g, or t
  misc_feature (379)..(379): n is a, c, g, or t
  misc_feature (387)..(387): n is a, c, g, or t
  misc_feature (400)..(401): n is a, c, g, or t
  misc_feature (406)..(407): n is a, c, g, or t
  misc_feature (419)..(419): n is a, c, g, or t
  misc_feature (424)..(424): n is a, c, g, or t
  misc_feature (429)..(430): n is a, c, g, or t
  misc_feature (442)..(442): n is a, c, g, or t
  misc_feature (445)..(445): n is a, c, g, or t
  misc_feature (458)..(458): n is a, c, g, or t
  misc_feature (478)..(478): n is a, c, g, or t
  misc_feature (507)..(507): n is a, c, g, or t
  misc_feature (510)..(510): n is a, c, g, or t
  misc_feature (518)..(518): n is a, c, g, or t
  misc_feature (526)..(526): n is a, c, g, or t
  misc_feature (543)..(543): n is a, c, g, or t
  misc_feature (570)..(570): n is a, c, g, or t
  misc_feature (585)..(586): n is a, c, g, or t
  misc_feature (670)..(671): n is a, c, g, or t
  misc_feature (673)..(673): n is a, c, g, or t
  misc_feature (675)..(675): n is a, c, g, or t
ccctttgctgtaaacaatgtcaagaaacanaaataacaaccaaaaatgaaatattcagtttatccttatgtgggccgatggcttcttattttaatcctcatttatnttttcattatacactttctttttttaattctttcaactttaatcttttnttccctccttctacataacacttnttttttcntttttattcntttactttttcccattttnatatcttttcaacccatnttttatttanttttacccccaccaaaaaatacatttcacctcaaaaatttttgggcttaaccccatcttctctgtttcccaccatcccacacacttaatattaaataattccacacaaattaatacttttcttttaaaagatntnatagatanaaatttatctaannaattnnttatattctaanatctnctttnnaaattatttccnctnatacatacctaantaaacataacattaataccnaagtaaacataacattacttggagggttncantttctaantgaaactntatttgaaacttttaantatactttaggaaacaagcatgaacgncagtctagaataccnnaaacatctacttgggtagcttggtgccattatcctgtggaatctgatatgtctggtagcatgtcattgatgggacatgaagacnncntnggaaatgatgagattatttccggtgtt

SEQ ID NO: 712320 - DNA, 100 bp, Homo sapiens
acacactgaaacgtataccagctgattgactgtgcccagtacttcctgtgacaagatcgatgtgatcaagcaggctgactatatgcctgagcgatcagga

SEQ ID NO: 712321 - DNA, 904 bp, Homo sapiens
gcagactgccgaggatggccgtcatggcgccccgaaccctcctcctgctactcttgtggggccctggccctgaccagacctgggcgggctcccactccatgaggtatttcaccacatcctgtgtccctggcccggctgggggagccccgcttcatcgccgtgggctacgtggacgacacgcatgtacgtgcggtttgacagcgacgccgcgagccagaggcatggagccgctgggcaccgtggatagagcaggaggggccggagtattgggacctgcagacacggaatgtgaaggcccagtcacagacctgaaccgagcgaacctgggtgaccctgcgcggctactacaaccagagcgaggccggattctcacaccatccagatgatgtctggctgcgacgtggggtctggcacgggctgcttcctccgtgggtacctggcaggacgcctactgactgggcgaggattacatcgccttgaacgaggactgcgctcttggaccgcggtggacatggcggtcagatcacccaggcaagtgggaggctggccgtgtggggagcagttgagagactacctggaggggcacgtgctgtggagtggtccgagatacctgggagaacggggaaggagacgctgcaaggcaacgggacagcacccaagacgagtattgactcaccagcgcttgactcttgacacaatgagggccaccctgagggtgctaggcgcctgagacttctaaccttgggcagatcacactgactttgccgcgggatggggaagggacaagaacaaagaacggagctgggaggcacagcgctgcggagatggcactacaaaagtggcgcctgggcgagcaatctggaggagccagtacctgacagtacactctcgttgccagcttact

SEQ ID NO: 712322 - DNA, 339 bp, Homo sapiens
  misc_feature (1)..(1): n is a, c, g, or t
  misc_feature (68)..(68): n is a, c, g, or t
  misc_feature (74)..(74): n is a, c, g, or t
  misc_feature (78)..(78): n is a, c, g, or t
  misc_feature (81)..(81): n is a, c, g, or t
  misc_feature (87)..(87): n is a, c, g, or t
  misc_feature (91)..(92): n is a, c, g, or t
  misc_feature (149)..(149): n is a, c, g, or t
  misc_feature (163)..(163): n is a, c, g, or t
  misc_feature (192)..(192): n is a, c, g, or t
  misc_feature (205)..(205): n is a, c, g, or t
  misc_feature (212)..(212): n is a, c, g, or t
  misc_feature (234)..(234): n is a, c, g, or t
  misc_feature (240)..(240): n is a, c, g, or t
  misc_feature (244)..(244): n is a, c, g, or t
  misc_feature (246)..(246): n is a, c, g, or t
  misc_feature (251)..(251): n is a, c, g, or t
  misc_feature (263)..(263): n is a, c, g, or t
  misc_feature (312)..(312): n is a, c, g, or t
ntggtcagggcactggccactccagttaccatcttctgctaggtagcctgcaccttaggggtgatttntttgcngaantgntttgcnaaannggtcaccagcacatttcccaggagcttgaagttctcaggatccacatgcagcttgtnacagtgcagttcantcagctgggcaaaggtgcccttgagatcntccaggtgctttntggcatntcccaaggaagttagcaccttnttgccntgtncnttgantttggggttgcncatgatggcagaggcagaggacaggttgccaaagctgttaaagaacctntgggtccatgggtagacaaccaggagc

SEQ ID NO: 712323 - DNA, 122 bp, Homo sapiens
gacagaatgatagagtcgcgagtccatggtaggcgtcagaatcaccgtctacattgtagtggcagttattggtggtcccatgtggccgcttctatcacctgtttaaagtagtcagccagact

SEQ ID NO: 712324 - DNA, 127 bp, Homo sapiens
gggttttttttttggggggggggggttttaggtttttggtttttaaaaccgggcttttttaaggggaccccctggcccaaaattttgtcccgaatttttgggcccccttaaaaaggttttttgggga

SEQ ID NO: 712325 - DNA, 160 bp, Homo sapiens
gggcccaagttgggttcaattaaagggccagcttgttccccccaaaaaagccccttttgtgaaacccaatggaaaggagcttaagttgttggaccctattccctataaattcagggcaaaaaaggggttaaaaaaaaaaaaaaaggccctttgggctcca

SEQ ID NO: 712326 - DNA, 458 bp, Homo sapiens
  misc_feature (19)..(19): n is a, c, g, or t
  misc_feature (341)..(341): n is a, c, g, or t
caatccccaagtgccctanaccctgaggttcctggagcctcagaatctgacagccttctcccccccatcctgtgtgtgtcgggggggaccagagggaaccccatttaaagaaaaagatccccaaagtagaagtcaaaagaaagacatgttggctataggcgtggtggctcatgccctataatccccagcactttgggaagccggggtaggagggatcacccagaggccagcaggtcccacacccagccctgggcaacacagcaagacaccgcatctacagaaaaattttaaaattagctgggcgtggtggtgtgtacctgtaggcctagctgctcaggagnctgaagcaggaggatcacttgagcctgagttcaacactgcagtgagctatggtggcaccactgcactccagcctgggtgacagagcaagaccctgtctctaaaataaattttaaaaa

SEQ ID NO: 712327 - DNA, 137 bp, Homo sapiens
tccagcgctgtctcctgtggcggcatcttgagccgcagggttacgtctaggccagcgatgcctgtgcataggtgctgcccgcagctgccatcctccatatctgtgtccgcagcacactcctccaccaccttcaggaa

SEQ ID NO: 712328 - DNA, 945 bp, Homo sapiens
agtcaaataaaaaatttggtcattggtactgactttctctctctctctctctctcttttttttttttggacagagtctcgcacttggttgccggggctgggaatgcaggggtgcgatctcggctcactggcaacctccgcctcccgggttcaagtgattctcctgcctcagcctcccaagtaggtgggattacagggccgcccgccaccacgcccagttaattttggtatttcagtacgagatggggttcactatgtgggccaggctgggtctcgaactccggacctcgttgatgtggcccacctcagcctcccaaaggggctggtattacagatgtggagccaccgacccagccgtgagtttctcttactctctttaaaacctttattttgtggaaaaaccgcggtagactttggggggggaggcatttgggtgcgaaaattaaagtgatcaaaaaaggctgaggtaggaatcttttttcacacagagaaacttcttggaacatgtgggtgttttccctacaaacgaagttaatttttgttcttccgtggctcctgaggggaaggggggaacagacgatttgggaacaatgggggcttggaagaacatttctaaattaagacattctggggggcgtgaaaaaatcggggcggggggttgagtatatatgaaaggtgttccacacccgtgggtggtgggaccacaatttaattcatttatctagggttgggcagagggaaattttgggttggagacgcaatattcgtggggagagaattatatgtcgggcaacaggtgtaatacattaaaaaaggctgtaaaaaaccatattggtttgtgtgcggcgtggtttaagaaacccgtcggataaaggccaatttttttggggaactattgaaagaagagactttgagaaaagaaaatatagagaggtggtgttataag

SEQ ID NO: 712329 - DNA, 752 bp, Homo sapiens
gaagatagcggcgcggtcgtcgtcgggggtggcggcggcagagcggggcggcggccctgtgcggcagcggagacggcagccgtgacggtggcagctgtgcggcgctgggacctgggccttgggggcaatgagtgcggcctgcggctgtggccagcggctggagccgtgtagcggagaagctccccctccctgcttcccttggccgagccgggtgccgctcgcgcagtgacggcacgtacaagtagccggggcatccgcgaaaacacgtacaacatccatgggaatcccgaaaacggaaaccaccaacagaccagggccacggtacggactgataagcacacaaagctagaaaacgagaaccccgagaacgttaccggaaggagcggaccggggaattacagaggacataccggggagccctgaatttgacccatgtataactacccccagcaaagacgcagagagcgcgactcgacggtacggttagcaaagaatcggatgcaagaccaggaaaatacggcgagatcccacgaacacgacaagtgcacctaggcaaccaccatatgtaacggaacgcggcaaattcaagagacagccaataggaaaggagatcgcacaaaaatcaaatagagcagccagcaaggagaccgcagaagagacaccatgcaaaaggaaggcgctgcaaatagaaacaaacgggcacaaataggggcaaccgaacacagaatcgacacacaacatgagagaaaaaa

SEQ ID NO: 712330 - DNA, 151 bp, Homo sapiens
  misc_feature (9)..(9): n is a, c, g, or t
  misc_feature (42)..(42): n is a, c, g, or t
  misc_feature (74)..(74): n is a, c, g, or t
cacaacagngggactactgaagactagagaacgcctctgtgngagtggtgcagacaaagacctcactaaagtgngcttaacagagtactagaggagagaacttggcaatagcaagtacagacaactatgtgagaaatactgctcccaaagg

SEQ ID NO: 712331 - DNA, 121 bp, Homo sapiens
ttgcgatatggagccctcatcagaaaagtggagaaatggtacatgtcactgcttcatggaggctagtggattggccagggcttcgaactgcaaggacaataatgatgagtagccggatagg

SEQ ID NO: 712332 - DNA, 266 bp, Homo sapiens
ggagtgacaggaggataattattagaaaaaaagcgaaaagaaagaaaactcagcattacctgctaattacttcgctgccgacgggaggctgggcaggtgattccgtgaaggcttctaagtttaggagggaggctggtgaagaaatagaagatttccgcctcagaccacagagcctgaatggatcagattatggaggagatattcctatcattccggatctggaggaagcacaggaagaagactttgttttgcaggtggcagcccct

SEQ ID NO: 712333 - DNA, 505 bp, Homo sapiens
caacgatggtcctcagctactcaggagctgaggtgtatcactggagtccaggaagtcaaggctgcagtgaaacatgattgcaccattgtgctctagcctgggtgacagagttgagaccctgtctcaaaaataataaaataaaaataaagaatcacatctgggccgggtgtggtggctcataccagtaatcccagcactttgggaggccaagacaggagcactgcttgagcccaggagttcaagaccagcctggggaatacagtgagaccctgtctctacaaaaataaaaattagttgggtgtggtggcacacgcctgtggtcccagctactcaggaggctaaggtgggaggattgtttgagcctgggagctcaaggctacagtaagctttggctgtaccactatactccagcctaggtgacacagcgaaaccctgtcacaaaaaaataaataagtaaaagacaagaaagagccaggcgtggtggctcacacctgtaatcccaaca

SEQ ID NO: 712334 - DNA, 507 bp, Homo sapiens
tgctgattttcaggatggaaacccatcctgtcggggatgcattccacagcctctccggcctccagggaggaagaagtccctactcccagcccaaaaacccagtaccctgctgcccgattcactcagcaaatgctttcagagaactcactttgtgccaggccctgagaggaacgaagagatgctgcccttcactatttagggtctgcaacctcctgggggctcctgggaccctttcaaggggtctacaaagttaacactatttttataacaacacgaacatgtgattcgccttctctcacatgcatacagtggggttttccggaggttacatgatatgtgatattgcaacagactacacgcacaagcaggtatgagtttctgttaagcctggcatgaaagagatgggcaaaaatataaaaacaatgccactcttttcacagtattttttgttttaaaaaaatagttttttaaaataaaaatgttatctatgttaacatgcaaaaaaaa

SEQ ID NO: 712335 - DNA, 136 bp, Homo sapiens
ttcatgcaggcctctgctccttgtcttttttacctgtaaaatgggtttcaaatgctccgccctgcttggccccagcttgtctgtttttgggtcctgggccaaccaggatacctgataataaaagatccttgggtga

SEQ ID NO: 712336 - DNA, 292 bp, Homo sapiens
ccgtgattatagaggatcccgcatgagggctgtcccagtgtcatgcggtgaggctgtgcatctggttccacattcagtgccttcactatgccatcctgtaccaccatggagaacctcttgagacgtcgattcccaaagatggacaccagcgcaatcatctatgtaatcaagtctgtctcctctcccaaagtgccccaggtgggatcacgccaggagcctgaacctttgccgttcctgccattgttgggcgtcggccccaactctgccaggtcacaacaggcatcgattaaca

SEQ ID NO: 712337 - DNA, 902 bp, Homo sapiens
ggacaaggaatgccagagcctgccagggacattgatggtaatagtcagctcactttctatctttcattttttttggagactgagtgtcgctctgtgtggcccaggctggagtgcagtggtgcggtctcggctcaccggcaacctctgcctcctgggttcgagcgattctcctgcctcagactcctgagtggctgggacttgcaggcatgcgcccaaccaaccctgactgatttcgtgtcacctagtggagacggagtttctccgtgatggacaggtagggtcctcgaactcccagcctcaggtgactctgtacgcctcggcctcccagagtgctgaagattgcacggcttggagctacagaacagcggcactagtctgatcacatttctagacgagaatcctctaccctctagtctacgaaaacgggctgaactaacgcaatatgcaccaacatccaactatccatcccagggcagatcgcaagtcgccgagctccacgacaactcgtaccaaggaccagccaacacaggcccgaacctgacctggactaagccactgagtgactcactggacactacgcgcgctcacggcccctgaagcgaaatggacacggcacaccagacacgaactaacgccccctaacagagacggcacgcccgacgggctggactaccaccaacaaaagccaagcccgccacacagcaaaaaccatgcgtgaacagcaacatggacccccggccttagagcgaaacatcactggacagcaataaacagtgcgatagactacctccacaaggcgggccacacaacgcaaagacccacatcagaagctcctgcatcccctaagaagcacaacgaccaagcgtgcaaacaatcgaaaaagtagtgtcagaacacgcacc

SEQ ID NO: 712338 - DNA, 498 bp, Homo sapiens
tactatcactctaaaagggagcttacgactggcagattggggatagcaccaggagatactagctgtgatggcttggagcaaccgtgtagaccagcagtgtaaacaagagcaggacatttatgagtagttgagaacagtgaataggagtatgactagacagaagatagtacggatgacaagtttttggggtgcagtccaagttgggctggtgtctggaatgagcctggagcctaacaaaaaggagcgtccatacagaagctcaaatgggctgtaccctgtagcatcccgaggacaggcctgaattctgagaagggcaagtggtaaaagtattgtccagtcctttttaagttggaggctgaacttggcgaggtgtgtttttataagaccattagtccattttacctttcctgaagattgaggatggtaaggggcctgaaggttccactgaataccaagagcctgagaaactgcttgggtgatttgactagtaaaggcctg

SEQ ID NO: 712339 - DNA, 295 bp, Homo sapiens
tgggtgcagacttctcgttagcagctggaagacagtgtggcgcgttggccatccacccctaaaaagccccacttttcgcttcgtggcccaagagagcatccagaaggcaggacggagagtgtttattctgtcgagtgtttatgtgcggggctcactcgcttgcactgtgcttagggtagggatggtaaatatcctccctgcatggctttatcctccctctcatcccaaagcaggtatcttctggttgtcacagagtttcattgagtccagctgcagccacgtggccatctggagc

SEQ ID NO: 712340 - DNA, 148 bp, Homo sapiens
gtttttttttcccttgggcctgggaattttccccatttttatgaaggggtttaaaattgttcaatttggtgtgctggcctccaaacccttaactgtcaaatctggcattatcttgtttgtacagaaatatactggcctagcagaggca

SEQ ID NO: 712341 - DNA, 592 bp, Homo sapiens
  misc_feature (267)..(267): n is a, c, g, or t
ggtgtgacggagactctcatttctcacttcctttctccttaccccgctggctccaacctgaaaccaggtacaatcttctgtcgcatctgcattgggtggggtatcacttctgctgacaggagacgagtgagcaggggcaggtaaggattctgaagcagacagagtctcccgcccccatcatactatctttccaggctcttgtccactttcagcacctcccctcctgatcccataccttggaaaaggacaaatatatccaccctaaanaataatgggacctacaatcttggaagcaaaatttgtctgtgaaaagaggctatgtagagagcacaaggctttgttgcctcccagtaatgttcacaattccgccttacccacctcaaccctagcaggtctagacctgctccctctgggaagtgtacctacagccctggtttcaggaggcttggcgctcttgttctttaggttatttgaggatcttgtctccttgagtagactgtccatgcctggagggcagggctgtgcctcacacctctctgtatcccactaaagagcctgaccaatgctgggatacagagagtctccgcgaact

SEQ ID NO: 712342 - DNA, 234 bp, Homo sapiens
cgggagccttaacctacaagcaatctcagggtaaagaatactggatcataagtttctcttggtagaaataccccagtcttaaaagggaagggggaacaatataaagagaatttaaaaaagagggacacccagatgttaaatgcctccgtgagggaagtacataacatctcctattaagtattctgggacaaacaaaatggaatcggaattggactacggaatggcactatcaag

SEQ ID NO: 712343 - DNA, 204 bp, Homo sapiens
  misc_feature (14)..(14): n is a, c, g, or t
  misc_feature (144)..(144): n is a, c, g, or t
cccgcacagcacgnagaggcatccatctgcccatcggtatggagttagggaatgtggacaaggaaatagcaggaccccagttgtctggaacaggaagaatatgtagagagcaggtctggatatgcagatcagcaccatctagtncatctattcagcaagtattgatgaagcactgtctatgctccccttctccggtggcgtggt

SEQ ID NO: 712344 - DNA, 317 bp, Homo sapiens
  misc_feature (29)..(29): n is a, c, g, or t
  misc_feature (45)..(45): n is a, c, g, or t
tgggtaaccacaacccttgctggtgactngtgtcaggacagaggntgtttgtagtgaagaggcagaaccgaggtcgtgaaccttattgatgtctgagcttataaaaggcacgggctggagaagaagcctgcctctggggcctgtccccggggtgtgggggtggggaagcataccaccttctgctgtccttgctggagttgggcttgtgctcactacctccttcctgaccccccacctgagcgaggcaccaggcttaagagacttctacgctaagggacttaggggaactatgactagggggaccccttttcttccct

SEQ ID NO: 712345 - DNA, 112 bp, Homo sapiens
ccgcaacgtggatatactggatatggagcttcctatgcccagagattgacatacagattaaagatgcgattgggcggtacctaccagtgccagtaaatcccacgttttgcgt

SEQ ID NO: 712346 - DNA, 181 bp, Homo sapiens
acagctgggcatttgagtgtcttttccttgagaggagaaggttgggtgagagagatgttgagtggagcccagagaggaaccaggactggatatatagatttgggagtcatcagtcttatcgacttgtatagtactgggtgagatcacctaagaagagatgaagacagagaagataaagggc

SEQ ID NO: 712347 - DNA, 320 bp, Homo sapiens
  misc_feature (13)..(13): n is a, c, g, or t
  misc_feature (19)..(19): n is a, c, g, or t
tacggccgtagcngcgagntatcaataatgatatccgtcccattgatgtatcgcccagcattactcacaagcgtaatgagtggccccgtgagttcccacggatgtcccatcctgcccatcggattccttgcattccagctgtcacgcgctttcttcagcccctcgccatcattcagtattgtgtccatgtatcccgggctcaagcagtttacacggatgccatagctgctccattctgccgccaggctctttgccagcgagaggagtgccgtcttagacgaattgtatgcgcattgaggttgcgggtaattatatgctgg

SEQ ID NO: 712348 - DNA, 154 bp, Homo sapiens
  misc_feature (53)..(53): n is a, c, g, or t
  misc_feature (82)..(82): n is a, c, g, or t
  misc_feature (85)..(85): n is a, c, g, or t
cagagacgccctcgtataacttcatcttccttctttccttattgacattacantattctcaccagactcctaggcgaccagnatnataccctagccaaccccttaaacacccctccccggtacatgcaagacatgcaagcccggtacatgcaag

SEQ ID NO: 712349 - DNA, 204 bp, Homo sapiens
cggttacaaagtacaacggtagaagtcatcagttaaggctattttcagttcttgtggggatcttcaggtgcttcaggccatctggatgtatacatgcaggtcacaggatatgatgatttagcttgggcttagagacctgacattcctgtcttcttatattaataagaaaaacaaaacaaaagggtggtgatcgtggggttgtaa

SEQ ID NO: 712350 - DNA, 358 bp, Homo sapiens
  misc_feature (1)..(1): n is a, c, g, or t
  misc_feature (202)..(202): n is a, c, g, or t
  misc_feature (210)..(210): n is a, c, g, or t
  misc_feature (225)..(225): n is a, c, g, or t
  misc_feature (241)..(241): n is a, c, g, or t
  misc_feature (333)..(333): n is a, c, g, or t
ncaacatttttcaccccccccccaaacgcaaggggatggggaaacttggcccaaagtaacgggggtaggaattttagaaccaagcccccttatactgtctgtttgaggcagaagataacaccagcatctcgccccccctctcccttaaaggaaatctttattaatcccgtagggttcccagataattctttttttaaaaaancccccccncctaaagaagcccanctgtcaagagttttgnacccccaacttcagctttgcatcccgagttttgtattccaaaaaaatcaaagggggccaatttgtttgtttcccctatgaacctttttaaanaaactctttttttttaaaaaaaaaa

SEQ ID NO: 712351 - DNA, 215 bp, Homo sapiens
  misc_feature (22)..(22): n is a, c, g, or t
  misc_feature (141)..(141): n is a, c, g, or t
accttgtggaatactgtgcatnagtagccctggggctgcaacgaggtaaagagaaatcttttagggaatcagccgcctgaaagatcagttccagaagccaggcacagtggcttatgcctgtaaactcagcactttgggagncctgaggcgagcgaatttcttgagcccaggagtttgagaccagcctgggcagcacagcacaacccgatctctgc

SEQ ID NO: 712352 - DNA, 355 bp, Homo sapiens
cacgagggggactcccaggtcggtgctcggcccagacttatgctcgtgttttcacagtccacactcgtgcccgaagccccttaccccgccccgggttgtggtctgtgggctgtgggacgagctgcggcgcgggccatttctgagcattggaggtttcaagtaatccactaacacacagttccaatttctgtcatcaaatcctgtgctgcagttcctcgtggtaatagatgcatattatttcttttatttacaagaaatgaatgtgactagtattgcattatcagctgaaacttggcttttagctgcatggcatgttaatgtacctccgatgtggctggaagcttgtattaactgg

SEQ ID NO: 712353 - DNA, 3100 bp, Homo sapiens
  misc_feature (8)..(9): n is a, c, g, or t
  misc_feature (11)..(11): n is a, c, g, or t
  misc_feature (18)..(18): n is a, c, g, or t
  misc_feature (1332)..(1332): n is a, c, g, or t
  misc_feature (2563)..(2563): n is a, c, g, or t
  misc_feature (2647)..(2647): n is a, c, g, or t
  misc_feature (3005)..(3005): n is a, c, g, or t
agggactnncncgccggngctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatctnctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcacgctccctgcacttaggctgcgtgggacaagggctgtgttgtcacagcaggaataggttttcctctgttggcctcccttttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagagcaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtanacaaaagataattttctagcattaatatgccccacgcaatatttggaacacttatgtgaaaaatgatttgtttttctgaaattnacgtttctctctgagtcctgtaactgtccccgaggggattgagcagaagctcgggtatgagcccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcnaatcccgtccaggccagttccagattctaaactgatttttttcatgatattgtcaaaacagtgaggaaacattaaaaaaaaagccctaaagcaaa

SEQ ID NO: 712354 - DNA, 277 bp, Homo sapiens
tgaccatgtctgagctctttacccccaatctcgcagccggcggatttcccatgcccggtgcagcctagttgcacagaccagcctttgaaaacccaaatctccaggcttgtcaaagcaggcaggggctccagtggtacccgatctcatttaccctgcctgctctttaggcctttggcacccatggtcacttcactggttttccatttggcttctcacctgggaaatacaaaaatagccacacctgaagttaaaagtcgttcagatggactgcacaaaa

SEQ ID NO: 712355 - DNA, 589 bp, Homo sapiens
tattaatatctgcatataaataattttaatatactacgtcatgactgtgtgtctgtacgtttaccaacttatctgccaaccttatatctccacgctcgaagttaccttctatcattctcaacaacgaatcgaataacacttgatacattaaatcagctactttaatgggctttgtccaacaataaactattgcgccgccttatatatcacactattgtagaaagtattatttaatttaaatggatgcaggttgtctactaaagaaagattatatattactatgctaattgttcataatcaacagaaaccaagatagagctacaaactcagctgtacagttcgtacactaaactcttcttgcttgttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattcttaagcaaatctcgtgtctaccttacaaaacttgcctcatgaaacataactatctc

SEQ ID NO: 712356 - DNA, 2790 bp, Homo sapiens
  misc_feature (8)..(9): n is a, c, g, or t
  misc_feature (11)..(11): n is a, c, g, or t
  misc_feature (18)..(18): n is a, c, g, or t
  misc_feature (1332)..(1332): n is a, c, g, or t
  misc_feature (2253)..(2253): n is a, c, g, or t
  misc_feature (2337)..(2337): n is a, c, g, or t
  misc_feature (2695)..(2695): n is a, c, g, or t
agggactnncncgccggngctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatctnctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcacgctccctgcacttaggctgcgtgggacaagggctgtgttgtcacagcaggaataggttttcctctgttggcctcccttttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagagcaggatggagaatggaaggaaagccccccaggcttcgtgaattgcaagaagggaccctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtanacaaaagataattttctagcattaatatgccccacgcaatatttggaacacttatgtgaaaaatgatttgtttttctgaaattnacgtttctctctgagtcctgtaactgtccccgaggggattgagcagaagctcgggtatgagcccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcnaatcccgtccaggccagttccagattctaaactgatttttttcatgatattgtcaaaacagtgaggaaacattaaaaaaaaagccctaaagcaaa

SEQ ID NO: 712357 - DNA, 2718 bp, Homo sapiens
  misc_feature (1260)..(1260): n is a, c, g, or t
  misc_feature (2181)..(2181): n is a, c, g, or t
  misc_feature (2265)..(2265): n is a, c, g, or t
  misc_feature (2623)..(2623): n is a, c, g, or t
aggagccatcctgcccgcggggatcccgtcagccgccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatctnctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcacgctccctgcacttaggctgcgtgggacaagggctgtgttgtcacagcaggaataggttttcctctgttggcctcccttttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagagcaggatggagaatggaaggaaagccccccaggcttcgtgaattgcaagaagggaccctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtanacaaaagataattttctagcattaatatgccccacgcaatatttggaacacttatgtgaaaaatgatttgtttttctgaaattnacgtttctctctgagtcctgtaactgtccccgaggggattgagcagaagctcgggtatgagcccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcnaatcccgtccaggccagttccagattctaaactgatttttttcatgatattgtcaaaacagtgaggaaacattaaaaaaaaagccctaaagcaaa

SEQ ID NO: 712358 - DNA, 859 bp, Homo sapiens
  misc_feature (21)..(21): n is a, c, g, or t
caggggttgaaaagccttcgntcgcgcgggcgcttttttgcggcggggagccttttaaggcccggggaccaggggttatcccgccgcgcgcccctcggttatttccgccccccctggtggtggccaaggcgctccccgagtggtgtgatttctcggagcggctccggcaattacgcctgtgtccccaggcgcctgggtgctcgccgcgcccggcagaatttctggccgtggttgcaccgcgcgcacctttgggcgcggtgtatcccacccccgacgagttcttggtgtgtcgcgagcaataaagggggcgaatctttcaagggtcctctacatggggagatcaaaccgagtctcccccgtccgcgtctgtccacagggcaaacaagtgcttgtttccccatccataatgagccaccgtgaacgtggctttccccggaactttgcggtgaaagggtcatcttttttgaaaactcgggagaaaatcttacaggatggtacgacaaacaattctgttgggttctagggagacttctgggatcctcccgcctggaatccacgagaaatatgtccaagggttaaccacaatcattcctctttactttgtaaaaaagccgactcctccctcccgaatttacaaaaatgcagaccttctctctccacctgataatgaacatcaagctgatgacctcacgcgcaccaccataaagctttatcccccgcctattatacatgaataataagcactttttccttcgcctccaaaattctgttgtgattagaacttcaagctgaattgagacgagtctatttctcttttcgggggtgaaaaaaacctctttctcaaaacaaaaaacaaaac

SEQ ID NO: 712359 - DNA, 611 bp, Homo sapiens
  misc_feature (226)..(226): n is a, c, g, or t
  misc_feature (534)..(534): n is a, c, g, or t
gtttccaaaggggttaaaaacccaaagaaaaatggaagttatacttggttttgctaaggccaatgtagaccagtgtccccaacggcaatagtgttggaaccagcttatgtgaacacacatgactttgcttttctctgagaattccacgtcttctcctctgagctccatgtacacctgtttccccgacgcggtgacctgatgccatgaagccttcgggtatcgtagnccctgaaggattgagctgtctcgggtgtactgttttactgttgcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcnaatcccgtccagccgatcatatctactgattatcatgatagctgataacccccggtgaggaaacattatatagcctc

SEQ ID NO: 712360 - DNA, 781 bp, Homo sapiens
  misc_feature (721)..(721): n is a, c, g, or t
gcggcagtctagtcatccagcgccatcctgggcccacgtgttgcctgaccattccgtgatggccaggtggtgagccgtggctgagtgctgacggctctcaaagtggcagagcttactgtcagcagcgaactcggttaatgcaacgatgacccgggcaggaatagttggtgaacatgcccaggacctgctgatggtccctccttgagtctcatgttcaatgcagtcttggtcgcatgaaactgggaggggagcgtgttagctggcagttcctgagagccacgctctcaccagtggctggcagctctgtgtcctctgaacccagcacatggcacaagagtgccgtaggccatccgctcagtgtttctacagcgagcaagtcccaggatgctggagctagaggggacctgatctgagagaagatatcttcagtggttgccaggctgttccttggaacctgtgcagggatgaggcctgcctgtgtaaatacacctagtgaggagtggagctgaatttgaatgcagccttggcagcttaatatgagcaagttatgacacctcctcttgttgcccttcttggcgggcgtcaggagatttgccagtgctcggagcctggtgactgtgggtctaggcgagacgagagctctgggcctaggttggggtggccaggttctctgtggccagaaatgagacagctttgcggtgcccaggacctggcccttttngttttctctgaatgagagacaagggtctttctaatgtggttcacttgtgaccactgtgga

SEQ ID NO: 712361 - DNA, 110 bp, Homo sapiens
aacccacgggtgcgcgccacgaccgccagactcgagcagtctctggaacacgcttcggggcttccgggccttagccaggtctgttcttcacggaggtgtttcgcgcgccc

SEQ ID NO: 712362 - DNA, 296 bp, Homo sapiens
cggactcccgacacggcatgcggttgagtttgggatgcctgagggcgagacgctggtgaattactactcctgcagctactggaagggcctgtgtgccccgtgaggactgtgtgtacctgactggtcaaccacctgtgcttctactccttcctgctggggcaggacgtgagcctcgatggtgccgtgggtggacataatgcgtctggcgcagaaggccaccctgctcttccccgagagcatctgtgtgtgcacaccctgcgcaccaggagctcttcttctcccatgttcctccaaca

SEQ ID NO: 712363 - DNA, 742 bp, Homo sapiens
  misc_feature (459)..(459): n is a, c, g, or t
  misc_feature (625)..(625): n is a, c, g, or t
  misc_feature (730)..(730): n is a, c, g, or t
ccgaaggcattgttgtactttgtagggaccaatgtgccatttgtttgtggcaaaagccctaccaattgaccaaaccttgtaaatttcttttgtatattaaaccagctgtaaccctgaccattccctttgtgtttacctgtttttgtaaatttttttccttctattaaatgaaagggtgttggttcagaatggcactttgaataatgtaaaccagtggtggattttctttactttttgtctttgggtttggggtagtttttgttctttttgaagttttattatttttaaagtgcctcccacctaggcgtaggccatgaccatttggggtacgagagcctaattttgtaggacttaatctgttggttggatttgacatgtcaggtagggttcagggactgattggtcccatttgccctcaggtcagtttgtttaatctcaagaccctgttactactgattntattaaatcagagtctttaattcttgcatgtttgtatctaatttctgaacgaatgagcacactttaaccagttatttacagttacctttttcctttaccggattgtgaagcttcatgtattttaattagatcctggggtttaaagggtcttaactgaaacttgccnataatcgcaggactcaatttttatcatggctggctgatttcttcattgataacagattttggtatcttgctttctggagttttccatcactgtttactttacctnatggggagaggg

SEQ ID NO: 712364 - DNA, 129 bp, Homo sapiens
tcaagcttctaacgatgtacggggacatgacctgcagggcctgcctgcctctccacccactgtgcccccctctctgtgtgcttctccagcctgggaacaagagtgaaactccatcccaaaaaaaaaaaa

SEQ ID NO: 712365 - DNA, 332 bp, Homo sapiens; identical to SEQ ID NO: 645850

SEQ ID NO: 712366 - DNA, 603 bp, Homo sapiens
gtttaggaggttcgctgctgaatatgtaacctcaaggccttaagaagggcttcaagagaagtgcgcacaacatgttattagcaattctcataataccatacagcggcgatcactccccaaattagtggataaacccaatcctgtccacggacataggccaggcagagatttagtagttgtttcacagaacatcttaataggtcatgatttctcaagtcacacatgtgtagcaaagatagttagctgctgcaaatcatataaagttggagcaccgttcagctaaagctcaagtgctaaaggagtgagagtttctcccctggcatttcgcggtccattattccccagacaaacagtggcatgacccaccaggtctttcttctctgcagaccacaggacgaagagtcagtgcccccgggactgatccatcacatcatggcttccaccgtaaggccctaaccgcatgagcacagctcatgttcgatgtctctcataccatgcacaactcataaagacactgtaataatggcatgcaggttcagatgttagcctggcagatgtagcactatttcagtcggtccagagttccagttcggcttgataaag

SEQ ID NO: 712367 - DNA, 846 bp, Homo sapiens
ttggccgtcgccgtttggggtgtgcccccttgggtgttttccgctctggcgtcccaatcctggcggggtgcacccctcctggcgaagattccgcgcgatgttctgcccgccccatattgggctccagcgtttcgcccattctacggggccccccctgtggtccagtgtgtgcggcccccggtattattccctccggggccggtctcacacccccgtggaacagcccgtgcggtccgggcgctcctgcgtggacgtgtcccgcaaacgagtatgttcccgcgaaagggtctccccccattttgcgcgccggcccgctctgttgaaaaaaggcacgccttgcacggcgacatccgcagtcccccaagtgggcccccgccgccggccctaaaagcgggcctcaacggctccccccccgtgtggcaaacgccgtgggccgcaccccccagagagggggaccacacaaccaactcgaggcgccctctcgacaaggggcgccccaatacggcgcgccgcgccaccacttgaagcgtctcttctcttcgaggggaggctctctacccataaggtcggaagagcccccgctgatgtccccccctctgtgtacagtagtaccgtcgtcaacaaagcggcgttgttctccgtgtagtgcccgccccgcctgtgtaaacaggacccacccctgcggctctcctatagtcaccacaaccagcttctccgcttcccgagagccctcccccagcaggttaatttgtgggggtcaaataatcggggtgtaaggacgtgggcgccccagtttggcccccctgcgtgcttttttccaacaaccccccccacccaacaaaaaca

SEQ ID NO: 712368 - DNA, 231 bp, Homo sapiens
ggctgaccaagaggacccccgagtacgggagtggctatgggccgcagaagggggagctgagcacactgctgtacaacacccacccgtaccgggcctacccggtgctagctgctggacaccgataccctggtatactagcggctgtatagtgcacaccctacaccatacacctaccaagggtcaaggcagaacacaaccaagtatacataccactaaccagtcctagcccag

SEQ ID NO: 712369 - DNA, 423 bp, Homo sapiens
  misc_feature (371)..(371): n is a, c, g, or t
gggtaagacagagcaagactctatctcggaggggaaaagttctggaaagaagggcagcaaaatgttaagagtggttgtgacaagggattgatattaaaatactcttgttttcttttatcactacctgtgttttctacaataaatgtgttccttctctacgttaccaaagaaatcaaacccattgccctgaactgcctcaaattcctactgctttctccccctccctccctgaagtccacaaccgtctctgaacccacatccatccctccctctagaatcagagcctgaggcaaactctccatctgtgttctcactgcctctcaccgtgtccttgctctacctgctatgtctcatctccgaatacatcgcanagttgtcaggagtaagacttgtgaattcttcatgtagtaccttatctacggc

SEQ ID NO: 712370 - DNA, 313 bp, Homo sapiens
ttacggtactgaggtgtctcttcgatatcttgatctcacggtgtctcagagagtatgcgtggtcagacacagtagagcgggtccggtgtgagctgttgaggatgacagtgaaggtgcgttgcctggctctccagcagggagaggcgtgcctcgtactgtgccttaacccacccctcgctgtccaccagcagtgggcagcggccattctgggccccttcccagagacaccagtacttgatgcttttgctttccttacggttgtaggggcagagcacgggcacagagcttcctgccacccccttcaccacagtgg

SEQ ID NO: 712371 - DNA, 325 bp, Homo sapiens
tcagccaatgtgatgcagacagaaatagaggagcagatacattcttgagcggctgacaaccaaagtggacaagttagacttcacatacaaagcacagacagaaaagttcgaccactctgaagacagacggatttccactctattgtgatgaaaagatttgaaagatcttattttgaacttccaagaaatttcatttactattttagctatgtaatattaatgtgtgtttgcgaattttataatacagtaggtcttaagacatttttgctgttataaggaagtgtttgtcccacattttcctatggttaacacctcaccaagttct

SEQ ID NO: 712372 - DNA, 257 bp, Homo sapiens
aacggcatgcgtagacagctcgtgtggtgtttgtatttggtcctgataagaagttcggagctgtcttttgtctacccaggtagcactggcaggagcttgcatgcgattctcagggtagtcatctctcgttatctgacagcagaaaacagggttgcaccccagttgattggaaggatggggatagtgtgatggtccttccaaccatccctgacgaagaagccaaaaaaggtttggggcgaaaggagttttcaccaaag

SEQ ID NO: 712373 - DNA, 158 bp, Homo sapiens
ctagccacatatagtctcaaatcactatctctatacatctatttagtacgtacacctttcactgtcatcgctgagggcgtagatatatctctgctcatcagtgatgatacgccagcagatgcacaagcagccattcagcatctttacaccgtatcgcg

SEQ ID NO: 712374 - DNA, 120 bp, Homo sapiens
gaaacgaaggagagcacaggacagggtgctgctcagcaccgacactcgtgcatgagacagggggcagagcatgggaaaggctgcagagtagggggggctgcagttggggtcacgggaact

SEQ ID NO: 712375 - DNA, 285 bp, Homo sapiens
tattaaccagtgtcatgtgtatttgtgcatacgaacgcgcaaaacactggaagtgctgctatctttataaaaacaacccttatggccatgtggactatcagtaaaagagaaggagacaagaaattcataagagagatgagacctcaacaatggccgaagcacaggggatggagatcaagaagagccaggagaaatctggaagatatacttaattactgatgacatatggggaatgacaattttataaaaggacacactggccaagtgcagcgtatcaggcatgtc

SEQ ID NO: 712376 - DNA, 266 bp, Homo sapiens
  misc_feature (50)..(50): n is a, c, g, or t
  misc_feature (80)..(80): n is a, c, g, or t
  misc_feature (111)..(111): n is a, c, g, or t
gcacacgccgaattgacagaccgcacaggtcccaatggacgaagtgtgcngcacacgccgagacaccatacccggctaantgttgtatttttagtagagacaaggtttcancgtgttagccaggatggtcttgatctcctgacctcgtgatctgcccgcctcggcctcccaaagtgctgggattgcaggcatgagccaccgcgcccagcccgttcaagtattttctgatgcctcttgtctggactctcggcgtgtgcaggggatcc

SEQ ID NO: 712377 - DNA, 1144 bp, Homo sapiens
gaagggcctacggaagcatcgggaaccactttccacttgccgagggaccaccccggggtgacccgccggccctcgtaaaaatccgcgcacaacacccgggaagaggcccgcagagccgtgagcccacattgaggacccaaagcgccggcgaaaagggtaccctcggaccgcgtgaaccagtcggcctgaccgcgcggaaaagggtcctgcccgtggggaggtcattccggcatggagtccccagaaaggccagggcaagaaccccgggaccgacctgcttcgacaccaaatgccaacgcttggtggccaaccctggacccgcttgcctgcgccccgagcactggcccggaagccatgatacggcgtgcaacgccaatccggttaattccaccatccccatcacagcagaagtttatcaagaagcatggaggggtacagaccccaacaacagttgcttcggccgtgacgaccctggacatcgtcagagccaacacctttgcttgcagacgctgaagggttcggactcctagctcgagtcgaacgttcccatcgatgcatttggctggccatcgactgggaaggaccatcagtgccgccctctgatctgctcagtagcacccccataggtggactttccccaggaccagctgacagcacgtcactgggcggatccatggaggccggcacggaggtggatcaaggctaaagccggagcaggctctggccaccctctccatggcgtatgccggcgacccgcgtttgtcttctgcccttgtggatgacaatgaatggaaaggaaggtgcttgatggcaatgttcacggtcgcttaagtacacaggaaacggaatgtacctagcgttctgcacagcaccgctagctgcttgggaaaaagggcatcgaggagagcaacctgggcatcggcaaacgtcgtcctcttgttgagagagggagatgatctcggatgcccatctcccgagctgagaggcctccatctaagaagggggaagtatttcgtggagaacactgaagtgagccagctgtgacgggaggccagtttaccgttaatagtatgaaggcatcatgtacactgcaaagccgttggaagataaactttgtatttcaatttgctttggtgatgattac

SEQ ID NO: 712378 - DNA, 436 bp, Homo sapiens
gggctcacacctgttattccagcaatttgggggccgaggtgggcagatcacttgagatcaggagttcaaaaccagccttgccaacatgacgaaaccccgtttgtacccaaaaatacattagctgggcaccgtagtgggtgcctgtcatcccagctactcaggaggctgaggcaggagaatcacttgaacccgggagatagaggttgcagtgagccgagtctgtgccactgcactccaacctggggtgatagagtgagactccatctcaaatactacccatcctctcacccaaacaaacccaataacacattagatgcattcgaagcctcccagcaattctccaatgatggcagaataggcatccaggagactcaccttaccctgtctgaccaccctttgccgtgcaacttgatttgccagagcagcttgcgcggcg

SEQ ID NO: 712379 - DNA, 118 bp, Homo sapiens
tatccatgtacaggatgtcagctttaaaagtgccaatgagagataggaccggtcagcacagttaattctcagcacggtttcaacaccaagacagctgacccccgagagtatgttttgg

SEQ ID NO: 712380 - DNA, 529 bp, Homo sapiens
attggaagtggggatattggttttttagaacctcttcatgaggagaacttcattcacaaacttaagaagcctttgaacacggtgaatatacacttacttggaagtgtgttatatctgtaacccatatcggtctttacccatttattcaccagagaaagttgaagaatacaggaacagaaatttttatgaactgagccctcacatctttgccctttcggattaagcatacagatccctacgagatcaagataaggaccaatgtattctcattactggggagagtggagcaggaaaaacagaggccagtaagcttgtcatgtcctatgtggcagctgtttgtggaaagggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaa

SEQ ID NO: 712381 - DNA, 293 bp, Homo sapiens
tccggctagcgggtacaaaggttgtggattgcttgcgattctacgatcgagctggtacggtatacacacttcctgatggcagacttgggctgttgggcttcaactcctacttttaccagcacgattcctttagcatgagaaggccctccaaaagagttggccgtatagggctgtgcccaattgagctttcttatacggtctatcatgccacttctggtctcgtcggtgactacggacgcttcctagcagtacgaagtccaggatgtttgcgcttcctgtcgggctagtcgggg

SEQ ID NO: 712382 - DNA, 247 bp, Homo sapiens
tggggtttttttaaaaggtttatagggggggtccaaccgcccgccctttttttgtttggggttttttcccccgggatcctttttaaattccttccttttgggggcaaaatccaaaggtcctttttttttttttgggggccgcccactggtgggtggggaccccccgggttttttttcccctccccccctgaaggggggtttgttttccggtttttggggggggttccaaaaaaagtgcttttgatta

SEQ ID NO: 712383 - DNA, 243 bp, Homo sapiens
ctagaggatccggtattgatgtggcatgtatgcactgctgcagcacagagctgtcttcccctgtagactatgtgctgtatggagtactgctgcccagttactgttggccccttcgtgatccaatcatcttcagtgagcaagacagagacgcatgaatggaaagcggagttcctaacagtgatgaaatgtttccccgatcagttcccccgagtaactacaaggcaatgtagctttccacatttt

SEQ ID NO: 712384 - DNA, 136 bp, Homo sapiens
gaggccaatgctgactggttcacctctctgagcctcaagatcctaagccgctaaacagagaaggtggtatctcctcctcaaaggtgcagtgtgcattaacagagaatatgcataaggaaccagtcagcattaacca
